United States Patent 7,868,149 (PLANT GENOME SEQUENCE AND USES THEREOF) - sequence listing, part 28

SEQ ID NO: 13832 - DNA, 72885 bp, Oryza sativa
  unsure (1)..(72885): unsure at all n locations
atatatatatatatatatatatatatatatatatatatatatatatatatatatatatatatatatatgattgtatgatctttatgagatggatatttgaattgaaataactactacttcctccgtcccctaatataagagattttgacattttacttgtactgtttgatcattcgtcttattcaaaaaaattttagaattattttttatttttttaacttactttattatccaaagtactttaagcacaacttttcgttttttatatttgcacaaattttttgaataagacgagtgatcaaacaacacaagcaaatgtcaaaatcccttatattagggagtactactacatcacatacagttgcctcgatcattttaagtttgaatgcttgaggtagccatcatatgagacaggtagtacaagtcaatgtgttcaatttgttgttcacaagttaaaataattgggtagaaaatatgaacgcaatctttcagcacaaacatgcatagctactttggctgtgtttagatccaaacttctaactttttccattacatcaacctgtcatacacacacaacttttcagtcacatcgtaccaatttcaacccaaactttcaactttggaaggaacaacatagcctttaagtattgacaatgttgaaaaatgaggggcatgttgaaatggaaaatgtatacctcttccactctttgtcaatgtgcttaccattgtgctctgcgatcgtgtgaatgtatgggtcgagtcatcagcgaggatgttctataatcaaaactattaatgcgaactactctacattattgagaggtgactagagatcgggcggcttcttctttgtttgtaagccgtcggtttggttcggtgccaccaaactacaccttttatcattttttttacaggttctctattttctacgagatatattcaatttcttatgtataaataaatttgataaaactacaaccatttgtcataactaccagcttgttgcaactttagttgattgcatgataatcactgattttaacagaaatatacaactctgtatgttaggttgctcactgtcagttcatccatgcaatatccgcacattcatgcaaattaggcccacatatcagaaactgtataggataaagtcaaaattttgcaataaaactgtatgttttcttgtagttttgtgaaatgtcgttgtaccaaccgattcagttttataaaatttactctttatattttttctaaattgatatttgattttagaatttccactttgctacctgattttttgtttgatttttcctctgactattcatttatttagtatattcaaatataatgcttatgaagttcagttattgtataaaggattttaaacacatactttatcctgtagtacatttttagatacgttatttgcatctaaaagtgtcggattgataagctccgtagatgtaggaaactacaggtttaaaaaaataggaccaatctaggaaggactagattgatattgaaataaggaggagggtgaggctcgaacccggaccggctagctcgcagcttgcgttgctagccgggaagaccccgggcctttctcgaaactacaggtttgggatcaaccaagggttttgggtgagcttgttgtgcccatgagtgtttgggagtaacacaagtcatgtatacaagttcgagtttcccgaaagataacaattatacactcctgttttgttcactatcggctaagtccatataaacctggaaactctcaagctagctagcatagttcttgccaatttctagaaccaacccttttatgtaaaatcaaagtgttttgattattattttgtgatgaacaattggcatatgtgattattggttttgatatttggagattattggcgaagtggttttggagatgattggattttacagatgttaaacaggagctgctgagttttgggtccggttagaccgggcatgggttgccagtcaaaccgacggttatcgagcggtcagaccgggcgactctgtgttgatttcagtttcgggttgtttgtttggatatccgtgattattttatgtttatggcttctagatggatactacgtatgtaatactgttatttgctaacaatgagtcaagttggagatagcttggtctcgaaatatggtttctttgtttgattcatgtgtaggtgacttgatgcctcgagagagtattgccggtgatggatcgggagtcgacttggggataaagcgatgtccgtgacggtcagatatcatgcaggatacttaggctagagttcaatgcacgtggttggtgaagattccatatggcatacgatggaggcattgtgtgcgtatgggatacggagtcgaatttggaaggagtctaaatttggtatgattggagtttgtaaagtttgtttcttgtacaggaaggtttcctaagtggattaggacttctagtatgagtttggttcatggctttaggctgcctacctcatgtataaatagagagggagcgtgaggcttcccggtatcgcttttgagagtattgagttgatagtttagttagggtttcgagtttagttgagatttttgtgaggagtgctgttgtcgcactttgtaaacacatagagaaataataaaattgtcatctacttcgagagttcttcgatttgtgttttctcgggtttggtggtctaaccggcgaaacaccggcagtcagaccagtgacattgcggcggtcagaccggcgggtacactacggtcagactggcgacggcaacaggaggcagaggcgattttcaggcggtaggaccgggctttcaacgccggtcaaaccgacggcttccaggcggttaggccggcgcatcacctacggtcagatcacgatccatcgaatttaagggtaacttttaattccgcaaaaagtttaggtttttgggtataccaaccattcaccccctccccctctggttggcttagttcttgtatttcgatcctacattttatatgctttgatggtttgacacctctctctctctggggagacaacaaacattcgctcataagcttaaccaagctctatgccggtacagacatcccgtgggatgtaacgccaggcccatttgaagcctcccagttttttccctgagcttcccaacctcctcttttggtttatttttatttgctaaaaattgaatttttaacttttcaccgtagattatttttcagtttttacttttagatcgctaagaatacgcatataaaagttttatttacagattatttttcatttataaatataccgtttctcaataagcgaataagcgaaacgatgtagtcctccatatccatgcccgtgtgaacacaacgaattgttaatacacatatcaaaagtcgaagacaccgtatattgaaaaacaaagagatatatgcattgttacagtagtcatctacatatttatcaagcattagtccattatttatatgacctgtaaattcaaattcttcgggcaaacaactgccattttcacttgcaaatggaattgttcaccttacttctatatatattgcaaatcggctgtacgactgtagccgattcaaactgaccctacaaatatattgctacacaaacacagaggatctgtgtagtcaaagacagggaatcaccacaaaggcatcaattccaaaattaagatgaacagaaggaataccctgtcaagattgacttgatgtaattatatcggtgttggtatacaaaacttctttcctcattccaacaaattattttgacaaatttcagactgtgaagcgaaaactgtgataaaatggagcaattgcgccatacagcaaatcaaaatgaaaaccacatggtgttggcagcagtttaaacatctagaaaacccagtgtaaggggttttcggcacatgtcatgtttataggctgaagaactggcagtttatgatagggctttctggacctcaacagtcacttcctttggtggtttttcggcatgcagatttgcgactatgcccttcttggtgtagtagtcaatcacctagaggaaggaaaccattccacgaattaaattgagtgaacaggcagcaactgctttgcattatggcagataataaacaatatttcacaataaaactaaggattacaaaagaaatgaggaaattgaagccaggagatggaaatatcaggcaacaaagatacataaacgtataccgcaatggaagtgtacttcaccatgttgtcaaaaatcttatgcaatacattatacagtcatatgaaatatataagaactccatctcatgaattctcaaatgatgtcgaatttgtaggagaaaatgaacaagatggttcactgaaaaactcccaatctactcccagttcatactcaaaaagaatttttggatctagagatacccagcaccaagaattattggagctctactaagcagacccacaaatgaagaaaaggtacaaatctagaaatgaagggttggcaaaatgtaatcagaacttaaaaacaatgaaagatatacaggaaacactgtaatgcaactgaaggaatccgccttaactgaagtacgactacatcctaaaagaatatctgaatatttaaaaacgtagttgctaaaggaaacatacaggcttagtttgtacgtggaaggcttcaagccttgacttcaatactgcagctgtgtcatctttcctttgaattaagggttctccagtaacctttgtgaaaagacaaagcaatcagggagcagaagtgcacataatattaccaattaaaagatatatatgatatcaaacaaatttacttaatagcagcacaaatatgtcccacatgaaatcattgctaaagaagaatatgcttttaatggaagcaatagaaacaatatacaatctcctgctacaaaaacatgtcgatgtatctatttatggacacttaaacaggcataattgtcagaaaaggaagcaaaagtgtgtcatgcaaacactgcctatcatttcttgtcaacaaaaggtgcattttactcttcgtacgagaaacaaccaaaacaagaaaaatatatccataatcacactacctatttaactatttgggaagcaaactaaataaacagtggcaagaagaaggtactcaatgaaccttttttattttgaaagaatgatggctcatgttttgttcttaaaaaacaagtaagcagagtactacgatgatcgatgatgagacagggaaattatggtaaaggcgcatatgctgcaagcatcaaacaatatatgtaccaaatctaatagaaataatgaaaatggtaaaaatctgagtatctgacaaatgcaagcgagagcaagtaatctggtatgacttacatcatcaagtccaggagtcttaggaggagcaaattttgtatgataagatctaccacttgatgggtggatccaacgaccggtaattcgttcttccagtattgcatcatcaattgcaaaatttagaaccttgtcaatcttagtaccttgtttggccaacatttcatcaagctgcaccattttttagtaagaaaagtgatacaatgatagaaactgtccatttatatagacagctctaataacaaaaaggagctcttttatatagcggtgcatattgaccaaggacctcaccttctgtgcttgaacaacagttctagggaaaccatcaaggataaaacctttctggcatgaagttttcttcatggcttcatcaataatcccaacaaccaagtcatcagaaacaagctctccctagaagataaggaaagaaacaaaagaatcaagaaacccattcctgctggttataatttctgttgctatatgtttcttaaaaactaccttgtccatagcttctttagccttaatcccaagtggagttttagcagccactgcagccctcaacatatcaccagtggctaaatggcacaagcaaaattcatccttaatcagcggtgactgtgttccctttccgcagccaggtggacctaaaatttagtaaaataaagggatgtcaaaattgtatgtcttaccttttttttttttagaacacgcagagattgtcttaccattctagaacatcaatattcaagctttctgcccagatgcctattaaactatccataaaagcatcaaaatttgacatcactttgcctctatggatatcaagttgtcaacactatcctatcctcaataacatattagggtgtaactggcattcttacaatgctgttaacaacaccagtgtctcagtgacacatgcatgaattagaacaagccatcaatttggagatagctaagagcagacgatgactagattcggtccacttaaattaggtagtgcagagtgtttgtaaattagctatacttcatgaagtaaaagaacaatagaataaaccttccataatgatttgtttgatgaccagtaaattagagtagtgcattgctgaagcagagcattgcgcaacagaacaagtttatttgaaatttgttgtgtcacacagtttacataaccatacagatcgatttggtttactagtgaatattgaaacaaaggagtaatacgtctatctctttgtttttattccgagtgacatttccaaacctttatcgatacatataaagttgcacctttctgttttggttattttaaaaagtttccacatcagacaaaaaaccacgaaccgccctgttgttttctgctcatcctcaacacatgccacatgacaaatttaaaataacatgtgtgagaacaaaaaatgcaacctccaatttcaacacatactactgaatacgaataaattctataccttaaacgcctgaaattcctattatgcgtcgaacaccgatcatataaatatttcttttcgcttgatttctgtcactaatatccttccgtcaaatggaaaaaccccaatcgactcaatcgcaagttgcaagaacaaacgcaatttgaccatcaaaaattgccgcagtttccaaaggtggaaacaacaagtaaattttacaagatttccctcgaagccaaacatttttgtttgcaaaaaaccacgaggagagcggaagaagaaacccagatttgacccaaaaaaagaaagggagacagctttgcacggatctaacgcaacatccccagcaagccacagcaatctttccccatctcccgaccagggcagcacgcgccgccgaaccggatccaccaaccaacgaaccaaaccaccgagagagagagagagagagaggaagaagaaagaggcgggcgttaccgacgaggatgacgcgcttgtcgggcttggagctgcacttcatgcggcggagcagctccgtcatcagctccatcgacggcacgtcctccaggttcgccgccatctccgcagcaacaactactgcactagccttgttcgtcgacgaactcgcgtcgcgtgctctccgcgtgcgccgctgaaatggaggagtctcggtcggatcgaggaggtttaggtggtggggctttttgtttcgtttctggtgagacggtgacaaccaaagctgggctctttctgtttcctttttaagcagtttttttttccaacgaaaaagacgcttctgcccacgcaagcacgcaccgctctcggggagtgtatggcaaataattttctacccaccaaaaagacacatttaaactctaaccattcattctccctctttcattttaatatttaatcctaaccctgattcatttaccaattctaatcccaccccatttttccattatccaaacacaccttcggtgaatctttaacttcctcgtttcctattaggatgctttttaaagggttaaattggtgtgtttttaaaaaataatttatgcatacattgtttaaaaaattcaaataaatatttttttcaagtttataattataaatatctaagtaataatgtgctaatgagctttctcgtttatcatgcgtttgaaaatcaacctccaactagaggatcaagaagccttaaggctgtgtttttctcttgtttcccaactcatcgttctagttttctatgtgcacgtttttcaaaccattaaatgatatgtttcctaaagaaatttatgtgaaagttatttaaaaaaaatcatattaataaaccatcatatttttcgtgcgtacttcacctctcgaacttagccttagatgggtgggcttagccgtctacgtttatttttcttaattggaaattggaattttgtgactgaaataagaatttacaaattagagttgtagtacgaaacatggtttgtaattaacaaccttcttttttatgtgatattaattttgtttctgcactagactacttatttatgacagcatatttctcgaacggttgaattgcgtttcatgaaaaaaaaattaataatttctttttgaaaagaaaaatcgtattgcagtctcagttggactcaaatttcaatttgagcaagatagataaccatgatattttgcgaatttgtattcattgcatagttcagcacaattaccctgaggtggaatagaataatctttggggttttcggtaataaagatactccaagaagcaatttgatgctttgtgacacaagtcagtatcacacgagccaataggagccatcaaaccgttggcactgtcttatgtattctaaacatggtagtacaagagaacgacttgaaattcgcttccattggattacgttttctcatgtcagcttgagcattcttcttaattttcttgcttaattttcctgcaaaaaccatgtccaacgaacaccccagttgattaacaacagggcgtcaccaaccacagggtttggtgtgtccacctaattaatcttcctgcagcattgatttccacgtgccggctaaataatccagcttttggttgtttcaactccaagcgatgtatatagaatagtcgccaggggcccttcttcagtctccacgagtatttttttaagtaaattacaaaccagttttggagattttttttttcactttaggctaggcattgttggcaaatattgtattttgggccaggtggcctatctgtaagtgagacacaaggacgggtgactatgtctcattaatatatggttcacccgatctaaagtgtaattgtaaaaatagcaaatccaaaataaaaagatgtttagtttaaggtggtcaaagtaaattttggtataaatgtgtgccataaactacaatttttttttgcgttgggctgctttctaattaagttcaaaaagttatgatcatatttccttcccaaaactgatttcgagggttattagtgaaagaattggatccaataaatcccaaaagccctgcgttagttttggagttctcatcccgtatatttcgctatgtggatttgagagctagagagtgatccccaccgactcccagtctcccatttgcgtgcttctcctctccttccccgcgtctcttccctccttcccgtgcaagccgtgaaaacgcaccgagaggatcgacggatccttttccgtgcggtcacagagagaaaaaaaagagatttttgttgttagtttaataaaaagggctcacttttagttttgggattatatttaagctttttcttagtttttttacttactattttcagtttaggaaacaaaaacaaaatttttgggtgaattatacatattcttttggtgatgctcttaataagttgaagatccgtattttttattttgtataatcattatttgtgttctttgagttaaaagattaggcgtcgttgcatcgagagaattttaagcatttcaatcactgagattttaaataacggaataaaatttctaaaatccatttcttatgcccttattcaataggaaagcaaacgtgagcttctagcttacgttttcatttaaagtaaattacgttcacggtatatgaacttgtgctgtgaataaaaatatgtatatataataccttgtaaattgaccatttcggtatagtaacttggctagttcataatatcatgatagcttaacgcatgaccggcctggctaaagagacccacgcaaagcaaacttgatgtaatatggtacacattaatatcatgatagcttaacgtatgaccatgttttaaagatcccaagaaaaagatcaattagttgtcctacagaactatattttcatgttcagaacagagacaatttatttcatgtcttggaaaattttgaacctctatatagctcgttcaatgttgttcaatgtaatataccaggatggtttatgtcatgcgttaagttaggacaagtaactttgggaaaaaaatattttaattttcatgatcaatcactccattttcattgaaaatttatttttgaaagtttatttattttcatggtcaggtatttttaatcgttttgtttcagagtcggtttaaattttataaatttcgtgcgaatcataactaaacattttgtcggtctaaaatttgacgtgtaatcaggggcgttcctacatgtatctacccggtgcttatctatttctaggtgttttaggtcatattaagcattatattactaaaaaattagcctataagcatatcaaggacccctggtaatttttttctgggttcgccactgcgtgtaataatagttacactgcaacgtgtgccatgttatatcacttttgcttgcatgaatcgttttggtccagattcgcatggattagccaagttattgtatcggaattagcaattttcaagctattatacccattcatgcagccaccacgcaagttcatgtagcgtgaagataatttattctttcatttgctttgagaagtccaaagcactatttcctttttttttactacaatttcctaagtcccttcaaaatccctggacaatggagataacttgaaactacaacattgcattccaagttagggttcaatacctcatggtacatgactaacatctggttacatagagagaggggaaaacaaactctatttttttttctcaaccacatttacataacagaacttgtgtacaaattaatcaaactattaatgcaggacaattttgaagtgtagttatgaacacataatatatgttcatttaccaggcaacttttctaaactggcaaaggatatctaaagctatactgctaaatcattctaaggttttggctaacaaaatcactacttttatacttaaaggcaaagacgtacagagatctatcactccagtgtaaccaaagataatagaataagtacatgatatgggggcaaattcgtaccagacccaaactactttctccacacgcgaagatcacatcttacacttggacaacctcaattagcattgtggaagatgttttatgggcgatattcccctccaccaatcaatttatagtgccacaacacaagctatatatattatctgttttcaaaagatcatacatgactacatgttagaatcatgaaaatactataggttaattgagctaaggccatgggcggacacaccatgggacataggggtacgcttatacccccaaaaattttttagaaagaacccatcgtatagcatgcatattatggatacatatacttgaaccaaaagagcactttggcataaaagcaagaaattaatcttgccttgaattattaagtatacattacttttgtgaaatctactatctatatactactactgaatatatatgctaatagttgtatcatatttagttatgtctcggtatatttttaaactttgtacccccatcggaaaatttctgcgtctgccattgactaaggccagtgacgaacaaaagcttcgtcttgtagtcacttaagatcaagctcactattacgaaatatggttattcacaaccactagtctcaaagcttcacttaatacaataagatcttattcaccccgagacaagtaaaccctcctcaattgcttccttcaatacttcttctctgagtttcttaatctcatccaatgtggcaactactgaagtagattggttggctggagtagattgcttttccttggcagcacttcgtttatgtcttttaaccactttcttcaccccctaatgaaatttgaaattaaggtagaattaaaaactactatatatatactttaggaatgttattcctccatacattatataatatgaatgcttagcatggttcctgtcctggtttggaatagactggagcttttttcatagaatatgttaacgaaattatttgtctaaattcaaacttaaatttgtaatcagaatcagtgcaataacgttttgaccaaccttgtttgtgttttatgcttatgcagggcagtcttcaaatcatttacagtcacatcaggtggtccatacttcacaagattttctgctataatatcaacaagcctgcaccacacgtacatatttcatactcttttggattacaaaataaatagatctttgagataagaaagaataacagttagttaatcttacatttcttcacttagattagcagttttgtttatcctcataacattcaatcaaggccagctgaaaaaaaatacgagttattacatgtatatatattgcaaaatataacatcagctataccatagaaaaacttttactaagttctgaccttaacattcaattagaactgacaaaattagccccaaactacaatgttgatttctatattatcaatttgggcacatgtttggtcttatattgcatttggtaacgtgtgaatagcgtaaggagagagacacaaacccactaaaactactaacaaattgaggatatgcgtgcaataatagagaaacaaaaggcaacaaatgcagtcacaagcgaagatcatgacaagttaaataagcacacacgcataaagttttgtggtagcattaaatttacatcactttgccatacgaaacaaaagggtacagttcaccgtgcagtttgagtgttctagttgcatcacttgcaataaaaattaattgatgttgctgggatgcaaacgcactaggtatccaaatacccacagtctacacaacacacacgagaaacgtacatccaatatttacaataatcataagattgcctactttctattttagtacaaccatggcatgcatatagtttataggcataactgatcacacataacccatgaagtagggctgtcaacgagccgagttcgagcaagatcacctgcctaggctcgagctcgatacaagctcgagccgagcctataaaatgcttgagctttcaaacagactcagtttgagctcgatcaagtttgagcttgactactaagcttgatttgtaagtacaacaatgtatatttcaaggataatctttaaaaaaacaataatttctaactcatcatattaatagaagaagaaaaagaataaaataaatatataacaccaatataagacatacaagttacatatttaatatcctaatttattaaataacaataaaaaacatatattattggaatagttagaagctcgagctcggttcgacaaagctcgcgagctttgggagaggctcaggctcggttcgtttgaagctcgagctgaacgagtgattattgaacctaggacctaggacgagtcgagctcgagcagcttacgagcctcgagctttttttgatagcctatcatgaagaaagctaccatgaaccacttaatgcatgaatagcaagaaccataatctgaacatactcaatcacatagatatgtaatgaaaacaaataaacaaagcgaacaatccattcatctcacacaatttaattagtttgttatgcacttgcattaacattatcagtaactcacgggtggcataaaaaatcctcaactcctaaaataacaaaattacactcaaattctcaataacgaaagactttgagtgttaaattttatccaccaatttaccgattaaggtctaagcctgaaatcaggaatttataataacccgtcaaaaacatgtcctcgctgttttattcataacacttgaactgctaaaccaaatttagcaaaaaaaaatacatatagaacatctacagaaaattatctacaactttcctatccatcaaaagttataatttagcctctatcactaacagatttgtgccatgtagggccagtttttgttgtatcattattgacagattttgtttaacatctacagaaaagtatcactgctttttttttctcctaaaccgcttatctgaatcgagtgaaacaagtgcctatagaaagatattaacatgacctacaagtgttgtttggaccacatgacctgattcccttactctttaattaatccaagaaatcaaaagaatatttcggactacaatcgaagaaatcaaaagaatatttcagcctacagtcaaaagattaaatttgatataccggcaactaaaactgtatttctacagagactaggatatatgtaactggggactatttgaggatacccttgtagtgaagaaccttaatttggaccactccaatgaactacactgtggaatccctaatttcctcttcgtcttccttttcttcgatctgtcctcttctactggtgagatcagaacagcagcagcaacgaacaggagtagattagcaggcagaacaacagattggtaggggaggatgcagatggcaatagcaaagaagaaactgacaacgcgcgatggtagtggcggcgccgcgcggcagtgggatctcaaggttttttttttctttttatagaaaattcgatccatagcataggaaaaaaagcggtaccaaaaaatagtataaaaatttttcgctttcgattagaagcacaggccacctgtttttcttagctccatagtaattctgtcaggtttagagttaacagcattagattgaagtatagaaaaattttgttggacccatttgcccttcgtcttcctgtgtcatctcgtcctctcggaccggtgcccacgacgacggcgccgtcgccaaattgcgacgcggcgatgatccccgtccccatccccgccgccgccatccccgtccccagccgcgcgccattccatgtccctgtcggctcccgtcccgacgacaacagcagttgtaggaagctgtacgagccccggctggtggccatcaggccctaccaccacggtcgggacgagctccatgccatggagcagcacaagtggcgcttcctccagcgagcacccaccgtcccgctctccgacttcgtggacgcggttcgggccgtcgagcagcgtgctcgctgctgctacagcgagagcacggccatcttggacgacgacggcgacggcttcgcggagatgctgctcctcgacggctgcttcattctcgagttctcggcgaagctgagccgcgcgaattagtgcacttgcaaaaagctaattaggatttaattaattagttgattaatttgttggcgctggcgccgccgtggttgcagatgctcccgatggccgccatctcatcaccgctgccctgcggagacgacacgagcgagctgagcgcggagtcgaagtgcgccatgcactccgccgccgccggcaccatcatcaccatctgttcagccgccaccgcccacggcggcatcatcatcatcgtcccgtacgccgccacggctggcagcaatgcgcccgcacccgtgccggcgccggacgaggaggtgaaggaggagaagtagtagcgcagcggggaagaagtgctcgtcggccatcatcgttgtcgtcgacggcgtacagcggcccacatccatccacgctcgggcagtggcggggagacgaggcggtcgcccggcacgccgatggttgccgcgccgccgtccacgagggagtggaagaggagacctggtggggaatgtggggagcgaagggcaaatgagtccgacaaaaattttctctactccgatctaacgccgttacatcaaaatgcgacggaagtgctacgtggcgaagaaaaatcggtggcttatgctatggatcgaaagtggaaactttttgtgctattttttggtaccactttgtttcctgtgctatggatcgaattttctctttttttttcccaccgtgatgagcagctatttataaagtggataaagaaaaatccgatggcctacatcgatccaacatccactattacatgcaaacacttggtaatagcaaaattgtagcgaaattgccaaactttagttattctgttaggttttgttgcttctggcccatatcgattggttgggctttttttaacttcgaaatcaaatctgctgcttggatggttaagcctgtttaggacatgggcctcatagagtataaaatttttgtgtataaaggttttggggacttagctatacatttgtcatcaaattttaatcaaaaaaatttgatagatatgaatcaatcaaaatgtaattagattgttacttgcgatcccgactcccttggcccaacagcgatggacgagggagagatgaggatggccgagcgacaccgatgacgatgaggccccgcggtggcggtttcgcggtccttcggcccggccatcttcctctctccctcatccactgttgccgggccaagggagaccggttccaccaccgccgggccacctcgtcgtcaacgtcgcccagccatcttcctctctccctcgtgcaacagcggcaggagcggtggctggccctagggctatctcgttgcgaccggtttccaccctccgttgccgatgccgatcgacgctgacaactttttatgaattttgtgatgtgtgggatccttttttttttaattttgggatggtggtgcattgtgaattctgatatttggtatatgcaatgtgaatgtgactcatgaattcattgtgggtatgatttgtgagtttgggatttgttattgtcatagttgaattcattgcgattaatttgaggatttttgcaaatgtactttttgtattttatttttttcaccaaaaatccttatcactggcggctgcattaatggtgtcgcatgtgaaaatctttttggcatgcggctgatcatccgccagggaaaaggtccgcaccgcttgtgaaatcttttttcgcacgcggttggctatccaccaatgaaaattctctattttcattggccattactcgcagctgccagcgaaattctcttttgaccgctagcgaaaatctttttcgtagcagtaggcccttctaattttatttgtagcttaggagttctagagatggatttgttggttatatcaattcagattttgttgaagatttgaacagaacaatatcacccacatgttatgttttaactattggaagttgtatggttagtgggtagattagtttgcaagcaactgctatgttatcttatctactatgagtgtggttatttctgaagcttataaagaactattttgcttagaggtttgtacattgtgttttatggagataagtcttaaattaatatattttgtaatagtcaaagtgcaacatgtcttatgttttacgagataacaaagcgtatagatattactttattcgagatgtcattattgatgatgatatcaagatatttaggaagtattcactaagtttatgcttttctcaaacttggttagtgctatagttcagtcctaatgaatatttactgtgcaatgattttacctacctgagacactttcggtgattgatgagttttacactacaagagtaaattcatcttaaagtggaaattgttaaatatgataaccaaattttaactagcaatatattccgattagttttcgggtagaattttatttagttacgagaatacatcaatgccggtttcaaaaccagcactattgatcccctcatcagtgtgcactgtagtgacagttgaggaacggacactataaggcttcccaactaacactaaaagcattttctgtagcagtagtgaaatcttccttatatgattgaactactggcctcatcttttcacttatacttatgcttatcaggcaaaatttgaatttttaactttaaatttagagctgatttggaggggttttttttcatcgaagttaatttatttttcagcctttgcttttagattgctaagaccacatatataaaagttttattcacaaactactattcatttgcaaatattccgtttcgcttgtatatgctgtagtacaagtgttaacgtagaaataaatttgattttgaatgtagactgctattcatccatatctaacattggaacaacactagctgtagctctggctctgactgcttccgatggtcgatcaatatgctactgatatgaataagaaaatggacatttggccacattcaaaacacggtttcgctagaatgctattccgaaaacgtgtttcattaaaatgccaatatagagcgggcgctcactgccactttaccattttagtcgttttgtgcatttttgaaattattttcgctccttcactaggtaatgagacgaaattgcccttccaccctttcgcgcgcggcaaccctggtgacggcgggtcggagctcgaggaaggcggggaggaccggatggccgacagcgcgaccagatcggcatacggtggcggcgaagcgagtccatagcggcggaggcccgcgctctagctcgccatcagctattgttgcctctccagctccgcgaacccgatgctcaccgcgtctccctccgcctccgccgtaggcatggggcccacctcaaaaccctagctagcgccgccgctgccactcgaccccacgggcctccgagataactccggcggcggggttgtgtccctgctcaccgcactcaagacacaccggatggttaattttgtctcaccacccgacggatgagcgaacatgatttcgaaaatgcacaaaacggtcaaaatggcaaagtaacggtgagcgcgcgtttcatattagcattttaacgaaacgcgttttcaggataccattctagcgaaaccgtgtttcgtacgtggccaaatgtccattttcttgatgtgaaccagtgcatgaacctgcatcgataactttttcaagtacatatgtacatgattgaataggttgggtacaataagaacataaaattgagtagttaatttatattcacgacaaatttgcttgacttgactccataatcaagcattgatatgtatctgatgctgacacacatgatacctggtttcgttgaagaaaaccattagcaagctaggttgtttcttggtcgtggcattacttagatgtcctatgtcctttgagaaaactagcttcctagcttggatctattcataagtagtcatatgagtaacatcattggcccttttgttttagaaaaatcataatgcaattggtaagatctgagacgtactgctccctcctgatcaatcctgctactactatatatgaaaacatgtttaatcatgtgacgttcactctctccgctcggtttcatctaggtttcagatttgattcctttttttaatagtaaacttggactcccttgtccaacttgatgaagaaaaatataaatttgtcagacaacttgtaatgtacggaccgcatgcatgcgatgtcgtaattaaaatgggcctgcatatatatatatatatatatatatatatatatatatatatatatatatatatatatatatatatatatatatatatatatatatatatatatatatatatatatatacatataccaccatgcatcaatgtgtgagttaattaattatctcccatgacataacacagatcatgattatggagcgagagcgacaatggccaaaatcggcagggacagagtcactcctgttctctcttctccactccagccttccagctcagttcaagaccggggatggagtaagcaaaactccatcctattcagtccaatgtattatatcctttttacaatgataaaagtgtatataaacccccagcctctacatatatattgtaatagtggtaatgccaactgccggctaagttatatccatgctatccaaatataacgctcattatcgatagattacctacttaaaaaactaatttaatattttgccttttgtctcacatctgaattaattctatatctttctagaagtacatataaaactggccctttaataagagccaacactcattttccttgcgccgtgtttagattcaaaattttttcttcaaactttcaacgtttccgtcacatcaaatgtttgtacacatgcatggagcattaaatatgaacgaaaaaaccaattgcacaatttgcatgtaaatcgcgagacgaatcttttgagcctaattacgccataatttgacaatatgatgctacagtaaacatttcctaatgacgaattaattaggcttaataaatttgtctcgcagtttacaggcggaatctgtaatttgttttgttattagtctacgtttaatatttcaaatgtgtgtcagtatacttaaaaaaatttttggcacacgaactaaacacagccttggtctctatcctcaacatgtgaaagaagtgatgttgttaggaaacgataggcgaacaaacgataaaaaacaatagatcaatcacagaagacacgagatttaacgtggaaaaccctcccaaaacaggagagaaaaaaccacgggcgccagccagcaaaatatcttcactatatctgatgtgaggttacatcgccgcacggcggcttacaagaggtatatatatggtggaaccctaaaagggatgatgattcgtaccgtgggggctccgcccccgcacccccgggcgtccccaggtgcacagcccaatgggccaacttttgccttcactccgctacggcagaagctagcctttattaagtgcaaatgaatttggatcacaactcaacagatgtaagcatattttattagtaaaatgacaaatagccatttgtcattttctcccagcaaccaacattgtctcctccctatgctcaatccaaaggtctttatcacaaagggaagctggcctttgggctgcagaggctgtcatggcgggcatagtggatttcgaagagggatggcgcctcctggcaaccagcctcgccaagcaaaggagcatcatcgatggtagcatgagcaagagctcttcagaggatgacaacatgcagctctacatgtatgtacaccatgcctacctcatatagtcttatcatattttcttggctttaatttgatctgatctagctagtttaatctatctaagtacattctttgctttgtgacaggatggtgtacaacatgtgcacgcagaagccacctcataactaagcacaacagctctatgaacgctacaagacggatattgatggctacaacagctctatggtatgaacttgtgtttgtgctaggtgatggcggagtactcatagtgtctttccacatggttgtgtgagatgatcgttgtcgatgggtaattaatggtgcaggtgttgccgtcaatgagacagataaatggcgagactctattgaaagggttggttgacaggtggcggaaccacaagaaaattgtcataagtgagacgaggttcttcttctacctcgaccgttactacatcttacggaagtcacttgtcccacttgaacaactgaacttatgttcttttcgtgatcaggtacgtcaacctctattgtttctcccgtcatgtgattattttacatgagtgtatgttattagtgcacatttgctgtgcttgatttggacatgccattgttgtgttcctttttatttgtgatatataggtatacagtgagctcaaagataaaataacaaggactgtggttgacatggtgaggctcttgttctgttctacgatttcttctaacacttctgcacttttgcagaggtgaagcgatgatcattaattttcttttttctgctattaatttccttgatttgtcagattaatgatgagagggatggcaaggttatagaccgtgatcttttgaaggatgtccttgatgtgtatgtccagattgggcttggcatggagtgttacgaagttgattttgaaaatgcgtttcgcgagagcacaagaaattactactcaaacaaagcccaaacttcgattttggagtgcaatggcgctgattctcctgaatacatgcttaaggtatccattcagagttcatagaaatcatgcatagatatagtctgatcttcttgatgaagtctgaaggatattatttaattagttgtgttgtttccacaggctgtggaatgcttgcaagccgagctggaacgagtgtcacattacttgcattcttcaactgaaccaaagttgatgcaggtaagtgttgagtagtggtttgtgcaatgactttctgttctaccatcttttttaatattatactgagtttcacataaacgcatgcaggatttgcaatcagagttgatgattacgcccgtggagacgcacactgaagaagctgattaagttattttcttgcttcaaaggaattgtactgttgcttttccaatttggttcatcgtagtaaactctgatgcaagtccgtttaactaatttggattttattatgggagttgcagattcccactaagtatggatgctttgtgtaattgttagacttctacagtaattgttatgatgacggccgagaagaactgaggagaaaattaaataggggaatcggggagaagcaaaagcatttcagtattttctccaccgttaacgatgtgtttggctatgtttgttttttatgacggagtgcaaagactctagtcgttgaaacaggaaaaaacatggagcatacttgttaggagctacgacttgcagatcacgatcacgcagagcgtaggaatgctcgacgggaggacgaggtctgtaacctcgccgccccggagccgtgttgagaagacgaacagaagaaggtagaaacagagactcggtagatgaatataatttcttgcttgccttcatcctgaattcctggctctaaatagccttttacacttgaactaacatttgctaaaattaagggataacaaactacttaacaacttaatctcaacagaataatctaatcgccattttcttgcgggactgttgctcgtccggcacgatgttcgctcctgtcccggcgtctgcggaaggaaatgttggaacattcatatttcgttgcttacataagagagaacaaaaaaatgcatgcattttcgaggtttgtttacagcatagtatataataactctaaacatatgtaactgtcccaaatacacttcatctgttcattcaaatttgttttttttttacttttctcaaaaaaaagtttataactcatacagcgtgcacttgggcacttctctaaaagtttaaaatcaggaaatctaaactacaccaaaacaagattttctttccttctcttattcatatattactatatttcaatgcacatgcatccctttttaaatcctaagagaatttcataattaatgggctaacaccctttggggaaaaaaaaaggcttccgctgttcggtccggtctcttgctgcttgtagcatccatcctctcttggctggctgtctgtggaccatgcctttcaggctttcactgcattgagaacccatttagtacaactcctactctaaccaccctatcctaatctatactttctttaaagttataacccactaactctaaaacttaacatgtaaccatgccacatcatcacccactaataataattacatattcaacctcatgcaagcatgcaagagcatctacaatctatttaattctacaaattaacatgcaaacatattcaatcaccatctctcacatcattttcacaatagttttacaaatctctctatcatttttataatatttaatatatacttatcaaaatgttctacattaaattgtgaattttatttgtttcatgataaatattgataagccctgagatttgattatttttttctttttactcctagctgaattgtaataaaaaaataatattaaaaattacttagtaatttctatagcaaagtgcggggaatcccctagtagtagtaatttttaagaacggagtgacagctctactctatatttaggatcttgaaaagtatttggtacaactcaaatttcacaggacaaaaaatctggagtccaagctataccaaacgagccctcagttccatagaaattgaaagtttggccttatgatgatggaaagctgcaagttcatagagtttttttctaagccagctcctttcaaagcctagcacttttagcgtggataatgatataacttataagagcaggtacaatagcaactattagccagctataaatatattttaatgagatagaagataagagagaagagcagtgggctacagatctgtagccagctgcagcacggactccatgacacagtatgtgtatgacaagtgggaccatatattaatagtatcttaaacaactattgtatgaattggctattagattggctatagatgaattggtgtcaacccccgattttggaaatcgaaaatcttctgtgtttattagtaccagtctctggatcagtagttggtacacacatacatagccgaatcacaacatatcacgaatgaatttaggctaagagagttaaatgcttacattaaggccaggtaggccaacaactatcagagaaacaacaacggaagacaaaataatataagggcccggttgacatgccacaagcagtcgactggggaacgagacctagaatggaaccgcactccggtcatcttgttaggtacgcaagcgtactaacaagggcttctcttcaacactctgctaaaagatatatagagagcaacaatgagtacaaaagtactcagcaagccaccatacaaaatgcagtaatgtacaggataatacaaggagtggctatggttactttgcataaagctgagtttccaaatatcatttcacaaacctaagacctagcataaactgatcaagttttaattccattgttcattaaacagcgacggttctatccaccatctattgtgttcctaaggatagcttcccgccactggtcgtcatggttttctggggtctaccccttctcgcctctcgagaagttgatccaccggtacaaaatcatcatgcatatcccatcccattcagattaagaaattagagtctagccaagtgtaatacgcgtctcggtgctcaataaccgcgagcacggctattagaatagattgatttactcacactgcagtggatgtacactttacccgtactccgcgacttgcccaacacatgagcctacgtgtaacatactagatttttcagggtacaatttttgcgaaaatatttaaagttgttgttcttcgttctttcgaattggagcctcccaatccttatatttctttagttccctataagtttccgactcccacataattttgtttagtttctctctccaaaccaaatctgagatatccagagaaaattctcaaaatcatcagaagagcttgtgttttttttaagttaaaccggagtcatcatgcaaatgttctaagatcccaaatcctatcaattcctattcaaaaatatcctaccaaaattccatacaaaaatctctccaaaaattcaaatagatcactgtgttacttctcaggcagagttccttgcaatccagtccatattccaaatttcctttcccttgtctctttctctctgttgggccattctagctcatctcctggcccagccgaggcagccgccccaaccaagccgctgctcgcttcactcggtccagccaccgctcgcgctacgcgcgcgtcgcctcgcaccaccctgcgccttgcttgcgcccgcacgcgcttggcccgcactagccgcgtgccgccttgcacctgcctgctctgcgccgcatgccgccacgcgcgcgacacacgctcgcttgaagccgcacggaggaactcgatcagatggtgtagacgttgtcgcacaaatcttaaaaaccgagcaagcaccactgctaccgtcaatctcaatctcccactgcccaactatttaagcaggcaaggtagccatgctcatccttttacccctctctttctcctttactcagaaaggaatcgagttcccaaaatttcttcaaactgccgtggtcgtcggcctatctgtcgccgcaggccaccggtcgtcgtatcctcgcgccaccagactcttccagagccggtgaggccatctccttttttttcccctcctctccatgcttgtactgaggtcctcgcatgctcctgtctgccaccatggctgccaccgtggtcggcatggccgacgcttcatctctatcaactaaccaaaaaaatggaaccttctcgtccgggaacacgttttgacgcgctcacccagccacgttcgccaccggagctcgccgctcaatcttctctctccttcggggcctaaatcctatcattcgcgttccggccggcatgaacatcctctctgagaaccagcaacagcttcgagttcgcagtacctgggaacgaaattacctcaagacgttcttgctgttccgccacaataaccatcatccaggttttccctttttacctctcattctgtctgtgttcgtggttgacagaggaagaagaacagtactagattcaatactgttccaccatggtccaacctgaccacaccacctgagccagcccagtagttgtcaaccaaaagaaaactgattcatatcaattcttccatcagtgatcacttccagattcaaacccaatcaattctagtctttatctctagtatctatagcattaatcccaaagtgcaaccatactacacataccatcaatcataactctaggataaatcgtttgccatccaaatcaagtcaactctggattattattttcttttgttcgggctatgattcacaatatttattttatcgtttatttgtagtatttttattataggcttatttggtcgtttcttcgtgtgcgtacgttagatcgtattgaaaatcccaccgggcacacaggaactgaagtggacctagaaggctacgctgaagcttcagaaggccacgttccacaaggcaagccacagttccaatctttgatcatattgatacctagtagagaaccacttagttattttctgcattgagtatttataaaattattttgcgtatgaattatttttgaataaacttgttagtttagttattacccattattacattgttattattggccaaatccatggattgctatatcacgtcctttgataacctaggtgtagatttatatacttcacaataatattctagtggataagaccaccaaatatctatactcatatacatggtttacccgtcatcacgtggtggcgtgtcgggtgatataaaatgtgttatttgatatgagtcactcgcctggagtgatatggaagattaattccgggtgaagatggatgttgtggtgtctgaggccgtgcatattgttatattttttttgtggaaagtgtatatttacacttgaagtatgcacgggcctatgctagttttggtggctttccccggatataaggactacccccttatgccatgaaaaatgatgtaatttgcgcccatatacatgactgagtaatcagacttagcctagtacatttgtcccactatatgaaatactgtagggtggctctatgagcaggtttggggtggacatgtggaaggggcttcggccaggttgacatgatccgcaatggtggaacccgtgaaagcagcgaccgtctagccttgcttaggcccagcaagtgcccgactactaggacggatcaatattccactgggcagtaaccagtagtaagtgggactctcgaacggctatgttgccctcagcctagctagctgttgacatcaggtgggtaaagctgggcagtctctgcagagatgagtcttaaatcattcgaatgtgccgtgcttccggttaagaagctatgtcattgggtgattcctatttatcatggtatgagtagattttaaattaaaatatggaatatgataaagatgaggatgaatggtgattaatattgctattattttaaaatgatgatttacaattgtttgcaaatgaaatattttacaaagtagggaaaaactatttataataggcttgttatgaaacctccttgatgactatattctttgtacgccttgcatatattctatttgtattattatgggtgtggcttgctgggtacctcggtactcacctcttgcataaaatgtggttcagacgatcagttcttccctgaggaggcgcaggaaggggaagaattctatggtgctgacgagttcttgttctaggtcgatttgctctcaggcattgcctgtggtgtttttatcctattttgtgtttgggtcttttgtttgtagggagtgtgtttggcttgtcggcccctaaaacctgtcttagttatcttttatgtaataatttctgtaaaaacttgggtatatgtatcgaaagctgttctgtatatcaatctgtgcgcgatcgaaatcttggacggtcgcgggtggtttcgggataccatactcaaaccgggtatccccacactacgtcccaatgaatgagacttgccacgacaaagcctttcaataacctcactttggcagtactcgctccatgaactttagtcctcatgcactctaggcgtccaaggtttctagcactgagaggagttctggcgctccccagggggaaagattcacacattcattaagttatagttaagtttaggtttgcacatggcagtcctaccgatggtgacaccactgtaggcacccgcccctcgcggtcctaccaatggttgccccaccgtaggccctgcctcacacacaacaagaaaaccactacggcttgggtaccgcctccgctcggctctttactccgctaggtctatacccacacgagaagtacggttgtacgggggtcgtttcatgcttaacttcatggctcggtccttaattgaccagggacggcactagcctttaccggacaccacccaagtcctccagccgccccagtcgaaaacagttgtttagtttaatttttcctttcacaaatcatgtggcgctcatgtctccacatgtcgtatctcaactaccttccctagggtagttgcccaagcatatagcatttgataaatatgagaatgcatgattctaaagtagcactactaagcttttgtcataattgactaaggactcatatgtaatcatgggtacaagaaaataatgagataagcaataatcaaaggcaaggcataataacaagtaggatattcatcattgcatgcaattttatttgtaaacaaagcaatttcgcaattaggatcaacatgctcaagggatggggtgatgacttgcctgctcaggacaatccttattcttgatataatcttgatcaaccttcacctcctggaagctgcatacgctgcctcacgactaaccgatatacagattctataatacgcgtgaagaaccaatattcaaacaacaatcaaatatgcacaaacaaaatataattgtcggggtcgaacctagggctgttcatactactcgtgtttgcaaacggataatctcataatcattcttattgtcatggcggcttatttaggagctaattatcataatataaatgggatacacatttcgttaattcggagttgatctatctattgagttatagaagggatatgaccacatatatatgcttctaattagtttacatgggttttacagtgataaagcatgttaaagagaattattcttctacctagtttactgtacagtaccaattttatttattagtacatttttaggtcaaccataatctaatcatttgatattaattatgtaacaattataaatatattttattaaacagttaattatataccattggaaagcttatgaatttagatgaattttaggttcaagtttcattcaaattggagttaaaatgagtaagttatgctagtttaaatatccaaatttgaataatagcaaaacaatactgttcattaccgatttatttttattccgaaatccatctcattcctaatagcggctgacaggtggggctccagggttctatttgcttttcaccgtattatttttcttagggaaaaacaggaggtgggcccatcctgtcatcggctcggctgagggaggtcgtcttcaacctccagccgggcagaggcagcgcgcatggcgcggctgggcgcagccgggatggtgcgaggccggcacggaagcggccggaaagatgtggcgaggctccggcgacctcccgccggtggcgacggctcgccttcctcaccgctcgcgtgctgcgcgccttcgtcgacgcccgcaaccgcgagtagttcctgccgagcaaccggtctttccgccacctcggtacgtgttcgacatgttgcgcatatttgatctgttcatgttttactgcttagtttacatgtgtagatctaatgatgcgttcaatctagtttacatctgcaatgtcatgatttatttatggaataaattaaatcattatgtgcttataatttcaacagaagtgaccttgagccccccgactggtttgaatcccagtcagagagagagtttgttggagtattcggtgacgaggaggcaaaaaatctcccaaagcgaagatgaagcgagtgactcacgaagttgattccatcgcacttttcgacaggaaactcgacgtcacccctacctggcgtgccaactgtcaaaacatgaattcggcaataataaaagggggtagcgcacgagacctaagagtggatggatgcggagacaaaggatttagacaggttcaggccctctcaataagaggtaataccctactcctgtttggggatttgaatccgccgggtgtagtatagatctgacgatcatatgtgctcatgccccctagagagcctcctgcccaccttatataggatgggggcaggattacaagatagaaaccttaaccaatatggtatcggtttcctaaatctaatttacaatcttatcaaactaggactttaggccgttccataatatacagggaaacgtagtacccaagtcatgatccgttacatattccatagatataagttatcccctataactagtcggataaccgtgccgtgtgggtatggggtacccataatctcaacaaatggctaggaggagctccgggatagcatgtccaacgggagcttgtcggcggcacaatggtggccaggtcagcacggctatagacactaattgcacaaactggagctggcgctagttattagaggtacaaaggatgctacgggcgtgagagtgtaccatgagaacgcgagacggcgaaaagcggcggagtagggctcgatgtgtcgcagaacataggcagacagcattgacggtgcccgaaagtgctcgtcgacgttccttgcattaacgtccaacctccccaatggcgacgacggcagcgcggctccgcctccacttcctccaacctccaactccggccggggagaccccgcaatggtggtttctagtagcggtgagatcatgcatggaaggtgcttgatgaaatgtattcgggacgaaagctgagaggaatggggattttactgggggcttagcttagggtgtaaggaaaccatggggataagatcgccagcacatggcctggatgagctagagctctaatggcgatcggataagagcaatgaggtggatgacgcgactaaggttcatctccttctccattaaggttctatggctccatcattgtgcctatagcctatagtctgcgagttttagtcctagctggggaaggggactctgttttatccactagacataaagaggggcgccgagacatcattggctgtggataaggtggcggacgtggccatggcgacgcgcgcacatggaagctgtggcggaacggcggcttggttgggcggcgggcccacgcgggcgctgtgcgccgtggtgcggtgcacgggaggcaggtgtgaggcggcatgggcgttgctggcgcggccgggagcgatgtggtgcacgcgatacataggatcgaacggttggcagacaatgtacagtagcgcctagaaaggagagaaaaggaagaaaaaggaaaaagaggtagagtggaggggctaaaatgcaaaacagttagaattggattttgaattgagatgtagctctacacattttggatttgagaattcaaatatttatttgaatatttatttatttattcatatctctaccaaatgattttacttcccattagatcatcagaaattatccaatatacttggaggctttgatagttcaaaaattaattaaaatattcaatgtgacaatttatggtttggcaagcaagaacaaccataacatctagcatgatgcaaaagttttaaaaagtttgaaattttagtgatttttattatcagggattttcaggatgttacaattggagcgggccaataggttaaggcccacttaatcaagactagttatatttatgtcttaatgtttagttttcaacacatgaacaatagggtaatcttggtgtctagaaaaagctgccacataagatttttgtaacgtggaggcaacagagagcagggagaagaaagttatctaatgattatcagtctaatagacagtgcagaaatttcttggccaataacttgaataggcaacctatcaaaattgtattagttgttagtgatcatttaaaccattgtttgtaccaattagatggggaaaaataatacaatggttaaaaggcaaatgttattggcacatccgttcttcgttgggtttgatggcttacaaagatgatactccctctacttttagaatgtttgacatcatttacttttgaccatatatttaactatttgttttattaaaaattatataattattatttagttcattgcggtttctttatacttttttatgtttacatataatttttaataaaacaaatggcccaaaattcaacaatgtcaaacattaaaaacaggagggaatattgttttctataagtcaaaatttcatacagattctaagggaatatattcgctaggcttctgagcatagctgcaaaagtatgatgtatacaaataagtaatgtgtaaggaatgctgttctcttgagattatagtcctacaaatttttatcaattatggatggaaatttaataataaagttcgctttgatgtttggttcatctatgttttctatgtcggtcttctcatcatgacgatgtgtgatgtcttagcttgataataactggattagtataacgaattttggacagaaactcttgagctaaagactgacatttatttccattatctaaaaatattggtaaaaactagttatgagggggcaccccaattagcatctcaccggctcaccgcttgctacaaatgtgcaagtagatgtggattgccggatttcttttttcataattttgtaggatttacatgcagatcagttcaattcacgcaaatgttggagaaaaaaaatatatcccccgtgttaaaacatgacttctgtcgatgtgcatgtggtgccattcctgaatacaaaatagaactttatggcacaatgcagcaactggttaatatcttgtcctgtaaaactagataaaaagggttgttgcttgagcctggaagtagaatctgatgctcgtacttgatggagaccaacctagcttacatgcgactgcgtttgagattcctccctctaaacagaagttcattttctttcataatcaaagtttagttagtatggccatgtttgggaagctacaaatactaaaaaagtagtaagttctagtacaatctagagaaaaagtctgcagtttggagagttttcttctttttttttttactttggaagtttttcatagttctgtattttccctagctttattgccaattttattcagaattttatttttattccttcgggttttcatttttgtttcacgtgtttttgtttttatttagattcgtgttttcccatcctattgtacctatattagttctcaagttatgcatcatccagacctaccattttttattttaaatatttgtattcgtcataaaactgtgacagccacacacccacaccactcgaggtggcataggaaattacagctgtgacttttgacaatgtcgtcattttggtttgcttgcttagaagttttgttttaaaaaagtatgttttaaaatttagattaacaaaggttcaaagaatataaaagcaaatgtcagaaaaccacatttatacttagcatatgacctacatattatggttcagggttttataaaactccatgttaaacatatggagcatatattttcttaaagtattcgtcttataaagtgtctataaaatttttagttactcatttcttaatgcatgtggttagggtaatttattcctattttgaataatattttttacatatgctaaagagttaggattctaataacttcttagtggttatgtgtcacaagtcataatccatgttgttctttttaactttgcttgtgagaatgctatgtaacaaattgccatcctgttcatgacggacgagataggccatcaggcaaccaacattgaatcacctattttctctccttctacttatctattatattgctcttcctctctcttatccacaagagcacacgtaatgccattgctcagctagttgagaggagccttcgtcacctcggatcaacgcggtttgggagaggggggctcccaaagagagagcacacgtaggcaagggattctctcttctctcacccttctattataatgagagggtggagacggcggaggccactgagtggcgccccaatgatggtgacaagcagagggtgcaggccatcgggtttggcgcgctcattgtggtagagaccatccggattttggtattgtttatccacgttgggtgagatctagtggcctccattttggctggaagtacacatttcactctccccttctcactcttcgtccttgccgcctatgacaggatgaacaaactttgtttacctttcttctcactagcaaagggattcatatccatctggctttcttcctcaccgttgatacctcgcaaatatctcatgataccttgcaagtattacctgatacctatcagtatactcacagatataatcccgttcaaggtatgtgatatagcagttccctaactttgaggttttcgaaaaactaattacaagaaaaaagaaaacttcttacaagtccctgtaaaatacacacaacctcttcttatttatccataatgagtcactaacaagtaagccaaatacctacccattatattatgagtaaattttacattgtgccacatattttgaccaagatttcataatggactagggttacattaatgttttcacctagcaccatatatctttacataagtttttagtttggactaggggtgagcgaagcaaggaatgtgagaaaatttacacagggatagttataaaaagcaaaacattttatgttttcttccttcttttcagtgtaagtggtaattaactattttctattttatttttcttcatttgtccctatgtatagatcattttgtatcacttttaaacatatttgcatcattattttagtgtgatttgctgaaaaaagttgttttgtgatttgctatttctttctaaagatatttatcttaatactatagaactaaaaatgattgatttgaactagcttttctctaataacttccattgatgtactcgtgcaaagatatgtggtgctaagtgagaaggttggtttggcttttgcccattgtgaaactttggtcaaaatatatggtgaaatgtgaaattaactcttatattatctttttttttgtttgaaactttggttaacttcatattaaactaactgatgtcaaaaaaaaaattgggaaggaggtagtaggttatcgagagaatggaagctggagtatcaggcaattttcagggtaaaatatgaattttacccttaaaaattttaacctggcggtcatcgtccagattcgttccttgagaatagttttactccactttgcttccatctgacctctttctctgctcatcctcccctgcctgtcacctcgagaacgccgggccgtccgtccgtcctcttctccctcttcttctcgcatcccgtgtcgtcttctcacttcttcccccacaacccacaccgacaaccaccaccactactgcgtgcccacgaactcctcctccctcctcatcccagtcgcccaatcattccacgcgacgtgaccaaacccccctctactctatccctccatctcttcctctcaattctcaatcttgcatcgcgttctcgattcaggccaggtagctcatgttgcacaggcctcttcttcctgcttgctgtttctttcagggaattctctttcggttgggttggttggttggttggaagtcgctgttcttgacgcgtttacttgggttttagcgaaagctgctactatctttttttttcttggtttctgacatcccttctctgcatttgggttcttgatctgattttatgcctggctgctttgcatttggaatgctttgattgttctttttttttgtactgaatttggttgcattaaaatctgtttatatgtgtactgaattcatcctctcagcttcccctttctttagggctttctggtactggatttgggtgtcgtaaatggctagcttaatattaccttagcatttagaccacattcaatgcacccgtactgagccatcttgcaatgctgcctgctaattttcgtagcatttccttctctctagtactgtatttgggtgttattgtggataaagttcctgagctttattccccaaaacccctctttttttttctctcctaatgtatggtttctcaatgcatttcatttgggggcagttcttgcagaccaggtgaacttgttttttttaatctccctccttttctctgatgaaattggttttcagggatgctgcattgaccgtgccgtttgctcagatctctatgcacctctggcatttcccctctcttttgtttattcgatttgagggggtgcttctccatacattctttgttgctttttcatggccatgttgtgatttatctatgatatacagtaagttattatgtaacatagattcacaaaaaaaaataaatagtatctcttcttgtcagttctagctgcatcttgtttatgccacccatgtgatgccttgagttgtatttatgtgagtggttgacttagttctcacctcctcaaatcattgtaataaattttcctatgattttgatgtggacagatgcttctcatttcagttggatttctaccccatttgcagcttttttgcaattagattggttgtaggacttggtgttttggtgtgctttatccttaatttttcatgtacagtagctgccttttctccctttgttagttagtactaacttactaaccgcttttactaattgcaggagcttttctttgtcaatgaacttaatggcagtcgacttttcgttggataattgagagaggactaccagattgtgcaaattgtcaactaggattactatatttaagctcagagtgtatcaactgttgaagcaatggtgctaggcctccgaaccaagacgaggaaggatgcatccttccatgtagacttcaatatcttcattcaagaaatcagcccatggcccccttctgagtccctcaagtctttgaaatctgtggtcctcttttgggaaaatggcgagcgcaattcggggaagaccaatgctgttgcgccttcaattggatcaggtaccacagtagggaaggttgaatttaatgagttcatcaacctacaggctgtttttcagaaggaggggtcatccaagagtgggaaatggcagaagaacctgcttgagctgaatctgtatgaaccaaggagggataagctgaaagggcagcatttagggactgcgacactggacttggcggagcatgcgatgtttcacgaggacacgagtgttcccgtgccgctcaactccaagaggagcttgagaaacaatgtgcagccgatggtttatcttcgaattcagcctttggatggtgataactcgagcgtttcctctagagatgcattgtcaaaggaggcatcagtggacagggattcaaaagaattgatgtcggagtacactgaggatactgagtttgcttcatttactgatgatgaggaggaggaagctccatacccttaccgctcagatgggaacttgcgtgcaggtagtaatagatctcaggagtctctcaaggtaaaaaactgaactctattcctacatgtgtactaggacctatgttgtgtctgatcatcttcccaaaagatgttttttaagacagtaaatgaagattttttttccaaaaaaaaacagtaatttgggcaggccattggggactatctctagccacatttactaaaaatgtgtctgaattagaaaacaagttttcaatttaataaagttttacatacttttgctctcaatacaattcattgctgttggaatttctgaatgggcattggtggttattttcctttacttaattatgtcatgtaaaaacttaaaaaaaaatgctatctgtaaacaggattttcacatgtatgattagtactttcagtaagaatagtattgtcgaaattgtgtagttcagttcagtttttttttccttccactgcatgttttggcgtctagttgaactaaatagtcttcttttatcttttatgcatgattctgaaaccaatttgaaattctctaggggaaggatgtaagaacagttggtaatgaaggctctagatcaccatttgattcccagcgtgaaatgccatcttccagtacaaaagtgaggagcgaagaagttgaaaagtatccaattcaagtccaaaaggcaaatggccatccagggaatctgtctcttttatcagatttgcctggtgaacaaactccatcttttccagcacaaaatgctctcagagctggtcgtaaaatgtcatttgcttatggtatgagtgattccaaccaaagaaactttggggagagaacatatagcactttaactagtgatagagcaaagaatatgaggtacagtatgagagttccggattttagtggtagtgtcattaataagaaagttgattcccagaaggaagaagtgaaagaagttgactcccaagatattgcggtctctaatgatactaggactgatacctatgatggagcacaagctcaggtgccaatacgcatatcaaataatcgtaacgacaccaaagttcgagaactagaacttagggttgagttgcttgaagcagagttgcgagaaactgctgctgccgagataggcctttattcggtgatcgctgaacatggtagctcatcaaacaaggtacacacaccagcacgaagactctctaggcatttcattcatgcgcttaaaaactggtctagagacaagatggggagtgcagcaagaagtgcttcctctggtttggttctggttgcaaaagcttgtggatatgatgttgcaaggtactacatgagacttcctctcatgctcaacattcgcattttctttagataaatgaagcttttattaatctcagacgattacatcaagtgtgatagaaccatactaagaatgctcaaacattcgcattttaatagtgttttcttttcaatggaataatttgcaatgaattgacaattgcttaacttctatatgtcatcattatatagattgcagtaccctgtaaaagtagtttatgtaacttcggaattcctgttgtgttattttatttattgcctaatataacttctccaaccaggttgagtttctggctatcaaactgtgtggtgttgcgagcaattgtttctgaaacttctaaacaatcgaacagcaatgctatcaataatggttccaaaacaggaccaaggaggaattctgcgtcaatgtgggaatcgcttaaccggaagaaaggaaaattgctttcccctgagtttgataactgggaagatgttgacacatttatagccgcacttaagaagattgaatcatggatattctcaagaattgtcgaatccatttggtggcaggtctgcctcgttattagttcaatttatttgctgtttgtgcccttgtctgtaagatttgttaaatacattgcataacaaatcttactttgcaggcattcacaccacatatgcaatctgctaatataagcagtgaaccgatgcctagttcaaatgcaaagaaatgttatggaaggattactgttgtgggcaatcagcaacaagcaaccttatcaattgacatatggaagaaggctttcaaggaagcatctgaaaagctttgcccagtaagagcagctggacatgagtgtggatgtctccctttgttggccaaattggtgagctacatatgattaatcaatagtttgaatttcctccttgaaaattgtaccataacttgtcaccttgaaatattctattcctcaaaatgtgttttccctaaaactattcaaattgtattgttcccattgttttttttttgtccatctcaccttaatttcttttatttaagaatgttttatatgatcagccatatcttgatttaacactcaaacaatgagaatgagaaaatatagacttcatataaatattcaagatctgtactaattcctaacatcatttctctttgataggtgatggagcaatgcatagctagattggatgtagcaatgttcaatgctattttgagggaatcagatgatgagattccaaccgatcccatgtctgacccaataactgatcctaaggtccttcctgtaccatctgggaaatttagttttggtgctggggtccaactgaaaaatgctgtaagtgaaattaaaagcatgctcattacgaggtcatgttactcgtccaatggagcctatttattttatctggctttcgatcaaaagctctgaccatttgtctttcctgctggttatagattggcagctggtccagatgtcttagtgactcgtttggtatggatatggatgactatccagaagttgagagtggggatggtgacaatggtgctgccgaactccgcaaaccattttatctcctaaatgcattgagtgatctcctaatgatccctaaggatgtgctcatggaaaccagtactaggaaagaggcatgcactctcatcttgttcaacaaatgcacattatttccatctgaacttgtgaagttttcttttctggtcataatattgttttctaattctaatacgatcatcctgcttttcacagctttgtcctaccttcagctcatcaatcatcaagagaatccttgatggctttgtgccagatgatttttgcccagatccagttcaacattccttgcttgaagcactggagtcagaggttagtttatttagcattgggctgcattgaaattgtatgttggtttatgttgcaaacaaaagtagatgattgcctgattacctagtctcgtaagtatcagatatcaagtcatgacagtgtgattgaatcttacgtttcatggtggaatggggaaaaaaaaggcacttatgtgattgcatcttatgtttcattgcacatggttatactttaggactgcaaaataccttttactagttatattgggcatacgcacatcgctttttttattacgaactacgggtaacaaaaaaaggagaattgatgatttatgccacttctttgtgaaactaaatatggaacttggttgctatttctgacaatattagcttgcgataaacttactctatttgtacaaccgagttgttttcctggcataaagttgtagtttgctagtttcatgagaagtaaacctaagcattaccttcattgaatgtaccatcatgcatcaaaccacaatttgaggaaaatgaggaattttcagttcaaccacaaacagtactggactattactcatcaaacattcatgctgttaggatcatttggagggtaacaccaagggcatccgagcggtcccgtgcagcgcgtcacccatcctatacccatacccggcatccggagcaatcctaagcatgatcggcgaccccaggaagagcgggtcggccatcctccgcaagtccaacacgagcgacgacgagctggatgagctgagctcgccattgaccttcatctccaaggcttcgtcgaacccgctcgcgaagctgaagcagattgggaacccaaacagtgccaggtacaggctcctccatgaggtttggaagctggatgaccagtagtgaccagtgagggtgtgtcctaagcatcagtgatgctttgcttctctactgtacatacacaagcaatctctttctgatagtctccaggtaatttccagctctcttcggaagcaagaacagaagaagaaatttcaagggttgggttaaaagtaatatttttggtgcttccatgtatgtaagaatgctgtataacttgcatcttgctccaatgtgttaccagctccctagatttcccatgaatttcagtcacactattaccaggcagaagtgtaaattcagcaaaatctcagccgttcatcttgtaatccattggtcgaaatgatgtagtcagctacttagtccaatcatcctccaaggctccaaccaaaagaattgaccgagttcttgaaatggggtgggtcgaatccaacggtccacaagagtcggcccatcaccagtgactccgtgcactgcattgcacaggggcagtgaaaactcttttagtaccacaccgctttcctacctcggacgcatctggtttataagctggagcgaggcgtaggcccgcgacgccagagggtgaagtgtggccctgtgggaggggcacccacgtaacaagcgcacttcacgtgcggctgtaaccctaaaccatactgcctctccctcctccgtggggtttgagtcgcaggggcgatccgcactttgctgcttgatcgatttctaaaggcgtgttctgccggtgctttggccttcataatataagcaccgatgctttgcgtgggtgcccctcccaggagaatagggttggtggcgtcctgagtagtcagggccctatatatccccctatttagtagccctccttttttttatttttgttccttttttttttgccattcattgattgaactaccaatgcttaatcccaataagatggtctttttttttgtcgttcattgattgaactacaaatgaataatcccaataagtagggatataagtgggtaaacccactatccacatttatttttccgttcattgattgaactacaaatgcttaattacccacttgctatttcattcatcacataatagtacaaattttagaagaaaaaaagactagaagttcttttttttttcttttatagttcattgattgaaatgcaaatgcttaattccaataagaagtgggaatataagtgggttagcccactaggccactatccacgtttatttttccgttcattgattgaactacaaatgcttaattacccacttgctatttcattcatcacataatagtacaaattttagaagaaaaaaaagactagaagttctttttttttcttttatagttcattgattgaaatgcaaatgcttaattccaataagaagtgggaatataagtgggttagcccactaggccactatccacgtttatttttccgttcattgattgaactataaatgcttaattacccacttgctatttcattcatcacataatagtacaaattttagaagaaaaaaaagactagaagttcttttcttttcttttatagttcattgattgaaatgcaaatgcttaattccaataagaagtgggaatataagtgggttagcccactaggccactacccacatttctcacatgattaaaataagcgggcaaaaagaataccgcttagcagctccgcttgcatccttaaggttgtatttagatccacgggtataaagttttggcgtatcacatcggatatacggacacacatttgaagtattaaaacatagactaataacaaaacaaaatacagaatctgtctgtaaactgtgagacgaatttattaagcctaattaatccatcattagcaaatgtttactgtagcactgaacgcgctgatgaagcctagagggggggtgaataggctatccctgaaaacttaaaaacaaatcgcagcggtaaaattcaaacagacccagaacatactcctccctcatcaagacttgtaaacatactcctctctcccgtcatatgattggtgcagccactgtccacaacccaacttgagccatcggaggagtatgcctataaaagaaatcaagcttgggatttaggaacccaaacttgtctaagtttgggtcccttgatgttagtcaccaaaccctttggcacccacacacaagtgcggtactcatcattgtaattcccattaaaataagcaaccactttgccctctgaatttttggaaattacatataaatcatagtaaagaccctctggccggaacttcctggcattatacccggaacttccagtcagccccttcggcctatcagaagcccggaacttcctggaacttcctgtcttacagggcaggaacttccggtcattttgcccggaacttccaggtgtctgaccagtgaggggacaagtcacctcacttgcttgtggagcttttccttctctcacaaacattaagcattctttcacatttaccatcacatgcttagacacaggacttccaccagaaaacccgagcccgtgtccatccttgttaggatgagcggtgatggtcttgtaaagggcatcttttgaatggtatgtcttcatgcatccatatttcaccaatgtgcccaaccttttattctctttcttaagagcttgcatagcatcaacattagtagcatgagagttcaaatcaatattgtaacacctagcacaaccattgctagtagatggattggaagaattagaaaccacatttggttgagaagtgttattccaaagagtgtcaaattgaacttcaagatctttatgacttttgtctaaactagcaaatttctcttgaagagtttcattggcatccctaaggctagctagagaaccattagccaaattaagctcattagctagttgttcatttttagcacattctttagctaggctctcctctaaggcaaggtttcttttcttctcaagaataagtaattcttcttgcctttcgagagattgttctttactatccaaagctctcattaacttagccaaatgttgcatagcgggtttgctaaagctcttaagcacatcatctaattcattatcactttcctcatcattagaatcaacatcaagagaggtgtgagagggcttttgagtcatcaccttacggccttgagccatgaaacaagagtagtggtaggagtcgtcgtcgtcatcactcaagttgttgaagagacactccttacttgaagaggatgacttgaaggcgacggtagcaacaccacattctccttcaaccttgtcttttggcttgggcttgggcttgacctcgagatcttcttcatctccggagtaccacacctccgccatgtgtgcctccgccacatgagcacgctccggcttcttcttgcctcccttagccttagctttatttgacttgggacaatcggcaatgaagtggccatattcgccacaattaaaccaagctctctttgattgcctctttcccttgtcatcatcatttctccctttgccatagccactcttgcgaataaagtgcttgaatctcttgacaataaaagccatctcttcatcttcactttcttcacaacttgactcttcttcttgttttgccttcaaagcaacttcttgatttttgatcatggcggcattcttcaccatttgcctcacttcatgagcttcctcttcttacatctcatgagacacaattcttccaagaatgtcacttggggtgagtctcttgaagtctttcctttctcgtatcattgatacaagagtgggttttcttggaccaaatgcacggagaagtctcttgaccacaaagtgatttgtcatgtcctcactcacaagtcatttaatcttgttgacaaggatcatcatcctatcatacatctcttgtggtgtctctttgtcatccatcacaaatcttccaagccttccttccaataattcaatcttggcctcacgaacggcgggtgatccctcatgaaccaattgcaaagtatcccatatctccttggcctcctcaagcccatcaaccttgttgaactcctccggactcaaggcggagagaatttgcattggaagcttgagcattgcggtggatgagttgctcttgctccaaagtgagcttcatgtcatcatggggtacatcaacacctgtacaaacaactttccaaatacttggatgcaaagagattagatgcaacttcatcttgtgcttccaagcggcgtaatgtgtcccatcaaattgaggagcacgcccggaaggcacggagacaaagttgtgagggggaatggtaagtttgctgtaatcaaaaggtatagtagctcccttgggtgatggagttcccttgctgcttgctccatcttcatttccattttccccgttctttccccctaagtccgacatcgtggatcactcaaagcggtgaagcttgaatcaaaagcaccttgctctgataccaattgaacgcgctgatgaagcctagagggggggtgaataggctgtccctaaaaacttaaaaacaaatcgcagcggtaaaattcaaatagacccggaacttcctggtaaggaactccggaacttccggtctcccaggcccagaacttccggtgttctaagacaggaacttccgggtaacagaacagagatgaaattcaaatttggaaacaggagactaagccaatcttcacaagatggtgcacaggtattctaagcagaggatatatcacagaatcatccacagaaacatcatagaaagagacgagagcgattttttcccgaagttcggatcttgcaatcctactctctgttgaggggctccaaagagctgggtttcgattaaccccttgcctcacttgtgcaaaaaccctagaagaaatccacagccttcaaccccaaacacctctacgcaaatttctagaattgagtgaccaccaagatccaactcaacctacttctagaaatccaccacaagtgtgggttgctctacttggaaagcctctagaatctcaacacaagaacttcactaacttacctcgttccctttcggaggagagaaaatccttcaaacttacccgggacatccacaatatgcaacggattctcgcaggcgacacctaaccgtcttggagatcatctccaagagtaataagcaccgagatgacagcccacaagatattccaagtgctcacccaagatcctagtcttcacacctctccaaatcttcttctctccctctcaatctctctatctcataagaattaggctctagattgagtgaagaaggtaagaaacacttgggagaggctagcaacagctctaggtttgaaaagtgaaagtggaatagctaaggaacgagctagaaacgagctgtatatatataactgctaggtgacgtcatctagccgttactcacaattttgaactggaaactagacaggaagttccggacctggaagacaggaacttctggactacacttaggaaaaactttttcacaagaccggaacttccggacctggaagacaggaagttccggacttgcacttttggacagatggagtatttgcaaaaatgactcctagggaaacttgacacttggttcacactaagagcacttgatatatctcagagcatcacctggaacccctcttaatagtacggtttttcctaaaaactcgatttcaaaagataaactatcctatgcacttctcgagttccggtccgctttgaatttgtactttttgggggtctccaagcatccatcttccacaccttagactaatgcacctgaaagttactcaatgaactcattagtcccttaaccacatttgtcattaatcaccaaaacccactagggggttaatgcactttcaagcaccacattatcagatcatggagtaattaggcttaaaagattcgtctcgcaatttatacgtaatctgtgtaattggttactttttttatttatatttaatactctatgtatgtgttcaaacattcgatgtgacagggtaaaaatttttgacatggatctgtttgcctaactcacactgaggcgcggcccaacaaaagaaaatagtagcccactaaccatttccaacaaaataataatgaaataatacggctcctgtctacgtctaatatctttagctaagatgatactctactacgtatcagagaaacaaaacaaaacttaattaattattaattaactgcagcacgtagcttcctgaacttacctaaattaatgttaacttctaatgccctaccctgaaaacatatttattccctgtatcccattatataagccaaagcccacgggtaagcctaacacggtctctaaaactaattttttttcttacaatttcttgtatatgaacaaaattataatcatataaaaataaattcaaatgtcagtttaatgatattattttcagcaaatataattcaatctattttgaatcaaatgttttaaagttaaatgcatgcgcactttatattatgggatgaaaataatattgtatttacataaatcactttccaattgatttgattgtataaatagaatacagagggacggcatcaggccgttgggaggtgacatggttcaccttaatgcaggaaattactattacctacacttacgaacataatacggtaggttatatacgataggatgcccgcatgcatttcctgagcttataataacacaacgacggcaccacatgagacaatcttattgcaatttagacaaccaagtcaaaatcaggtacaaccccattattcattacatgatcatgcaacacttcacgaaagttgtaatcgaattgagatggcagttaagctttcgaacgctaatacaactcggaaagtattcagtgcctacctgcaggcaacactgcatgaggtggtgctacattttctccaaagcacagaagtacattttaagcagaaaacaggggcttagatgcccttctccagcattgcccggactctggtagggagaccatatagcctgatgaacccttcagcatcagcctggttgtagatctccccattctcaaatgaggagatgtcttccctgtacaggctgtatgggctcttccgggacgcgacgtttacggagcccttgtacagcttgagagtcacggagccggttgttgtcgcggtaatgttctccatgaacgcatcaatggattgtcggagcgggtcgaaccaacggccagcgtagaccagctcggcgtacttgagggcaagcatgtccttccactgcattgtctccctgtccaaagtcaaggactcgagctcacggacagcagctgccatgatggtgccaccgggggtctcgtatacaccacgggacttcatgcctacgaggcggttttccaccatatcaatgcgcccaataccatgctttccaccgatttcattgagcttggcaaggagagatgctggtgagagatcttttccattgatggaaacaggaacacctgcaataataccaatctccaaatacctggatgtatgaagcttaggttagatactacagatgtgggccaagtaaaaaaaagtgtactagtgtgggcgaatgaaaaatatatcttagcaagcaagaagatgaaaaacagcacacgcaaaattgtagcagctaacaagaatttgcaaaacaaaatgactatggtatctgagcaagaatttgtgattctcttcagatagtccttgaaaattagctagtcagtactctacagtctcacacagaagttcaatcaatgcccacctaacttaactacgaacttcaagactgtatggcccttgagaattgagatagcccgtaccatgtaccattaagcgtgaaagcatactatattgaatcatgacagcaatttaagaacttcgcataaagagcatagagaatacttgtaaagtaccaaacatataagacatgattatcgcttactcaggttttgaaggtgcattttctggtgcaactgacatcatatacatatcttcctttggctcatttgctggatcttccaaaatgtcaccctgaaatgtttacataatgtaagtacttaactacaaaaagatgcagaagattgatcatgatatcaatacgatggtgtaattcattgatttgaaggtttggagcataagcaaaacataaacaattgtaagaaacgggtagaagaaaatatcaaatagaaaagatcttcagaaagactaggaaggaatgaagagtcaaaaagacagcagaaatacctcatggctaaggtgccacaaatttcgatcacggctgtatattgatttctttgtaacaggaattggcacattgtgtttctttgcatactcaatagcatcttcacgtcctgtgatatcccactccctccaaggtgccaccactttaagctcagggtttaaagcatagaatgtaagctcaaaacgaacctacagaaaaaggttagcatcagatgactgccatattaatattctaattaacatcagtatttacctgatcattgccttttccagtgcatccatgagcaactgcatctgcaccaacttcctttgcaacatcaaccattgcctgcaatggaggtatatggtgttttcaaacagaataaacaaatataaatgatttgcaatatttctgatgttacttcaagcacatcatttccatgtttttattattaaccatttgtgataattactcaattgtatattaaaggtagggtcctacaatccttatagatcctatctcacatataacaaagaaatttgacaggagaccattcaattcccatagaagcccaggaaaagttatcagcatagtgttatttattaacgctattactaaagttatcaggaaatttatcttttgccatagatttatcccactgtttctcatgttacttatgagcatgctcctgataaagctgggcaaaagatgtatttaaaatattacctttaaggaaaatatatattactaaagttctaggggattacagatagagcaactattcaccttggcaataacaggcctagccattgaagtccccagcagatactttctttcataaactgcaccagcacgcaagcaggggtaaatgtattcactaacgaactcttctttcaagtccttcacaacaagctggcttgcaccactagcttttgccttcttctctagcccttccaattcaatgtcaccctgcaaaggtatatgaatcgaagttatggttaactgaaaagaagtaagaaagtttcaaactataatgcaactttgtttgattattgtcaacaaaagaaatataccagtagaagacctaggaaccccccaaatcatgaaatttataaagcaaaaggtcatatggtaaaaaataatgtaacagccaaaagaataactaaagtactactctactaggtaacagagatactggtgagagcaagcagagaaaaacattatgaacgtcttcggtaatgcagcaggaagttgtggttcacatgacattacaaactaaaagaaaataatgcaggcttgataattacacgagtaatgaacaacatacctggccaacatcagcagtgaaacagacaacttcacaaccatagttctcccttcaatcaaacaagcaaatggcatagtttgcatgagtcaaattaatatagaacataggattgtacaaattggtattaaaacaagaagaatatatataccggagccatggaacaataactgatgtatccaaaccaccactgtaagctagaacaactttattcagtttgccacgcagtccacctttcttttgatcactactactagctgttgcggttgaaattccaccatgctcacttgcacttggcattgcacatcttatagctgcacattttgacaaaggattatcattcattgaacgcaacatgctaacaactatagacaaagatgaacagaattaacataggcataagccataaaattccctattgcaagcagtatgctatcataaaagttcatgtacaatcctgaaactagattaaaccaaacaagatgaaccaatctctttttaactgctcacagaaagatgtgtaaaactagattaagccaaacaagaggacatcaaattggctgtataagtgatttcatagtcatgtcctaacagctttttgtgtgtgtgcaattaagagcgtttgaaccaatgtggttaagtccaaggaagaaagaggaggttctctaaatcaattgattttctcattagcacatcacaagaactgatcgaaccagaaagcatagcttcacagatcacatgcttgtactaaacaggtccacattagtaacacaagtaattaatctagcgcgaacagatgtaaccaataacatgtcctacattgcacatacaggtacataacaagagacgatacatcatcatccacaagggcatgaacagtcatataccttggcttttgctccccttcccgctgagctgctgaacccgaacgatggagcctgcggcactgaacaacgccccagccttctcgtggtggtggaggagacccacccctgcacagccaaagccatccatcgatccaccgccgcaaaaaccaatcagaacgagtaaaaacaaaaaacccaacacatcgttccagtaaaagaagaagaagaagaagaagatctagctcaccggcgggggcggtggcggcgcccccaccgagggcgtgcgccatggtcgggggcggcggcgaagggaggggcgttcggagcgggaaggcggcgagggtttaagcgcggcgaggcgagaggggaggcggcggcggcggcggcggaggaggaggttggtgggggagtatttgtgtgtgggcgattgtggcttggtgatctgtgggtgggccgttgaaaaggtggtgggctacgactacgagtcggacttcttttttcttttcttttctttttcgaagtagaactaggatctactatcaggtttaccttttcattttcggtttatcaaaaaccagcaaaagaatagataaaaattggtgactttcgattaagacgatataaaaaccgagtaataccagtcagttttcccaaattgataagagcagctccagtgtgcacctaaaatcgattttaacatgaaaaaaccgaactatgcacactgtgggaagcgaaccgtatgtgtcagatgaaaaagcgacttcaaaacagaagtcgacattgatgataaaaaattacttgttgctacaggttgtgagggggaagggaaaggtgggattatttttttttttcatgggtcccacccaaaatcgattttaacgctgtaggggtcgaatcaaatgtttattcgacttctgtgaaccggacttaccgaaccaacactacaaatgccctaaccagcggtttcatgaaaaccgatcaatttttggattttgtgaaccctgactgactatgactactgcactagctagtagcctagtactgtattcggtttttttatactggcatgagaatttcggttttgcaagtgtattcggcgtggtattactattacatcacggtgcccgtggtttaaaccatgtcgattgattgaaattagttgtatacaaaatagagtttatgtctgtggtggaaatagaagacaaaaatatatactcctatatcgaatctaattctacaaggtaaaagtttttgtatactggcatcagaatttctgttttgcaagtgtattcggcatggtatttgatcatggtgtttacgtattatgatcggcgtagatttattaagattagttatatacaaaatacagtttgtgtctgtgatggaaatagaagtgaaaaaaatgtatataacgaatcaaatttcacctttacaatttattgacaaaacgtaagattacacctacctatctctatttctactattataaaaattgaaaaaaaaaattgtcggtattttggtacgtcatccgtgtatgagtcggttttttttatgttcgttcacttttgaaaatacagatctttatttgagtcgggttttaaatctgagtcatataagaaatctctttaaaaaaaacttgcatgctatcttgagatgatcagacttctaattgtagctcatagttttctagaaaaaaaatatatatccaagcgaattctcacagtgaaactattataaagattgaagatgtttttgctagtactttggtacatcattcgtgtatgagtcggtttttaagttcgttcgcttttagaaataaaaatatgtatttgagtcgggatttaagtccgttcgcttttggaaatataggagcagccgtataagaaatatctttaaaaaattaacttacatgctaacttgaaatgatcagactcctaaccgcagctcatgattttctagaaaaaaatatatatccaagcgaattctcatagtgaatttcaccttaactaaaccgtataataataaaattaaaatagcgttgctacacacgggtattttttctagtatgaagataaaaaccaagagttgtatatgaaatatgattatatgaaaatagaaaccatgagttatatacaaaatgcaattgtatccataaaaacataaactatcaggatgtgttcttcccccacctttcccaactcagctctctcgttttccacgctcacatttctcaaactgcaaaacgacatgtttttttgcaaaaatttcctatgtgaaagtcgtttttaaaatactattaatcttttttctttaaaaatgattaatacttaattaatcatgcgctaacgagtcgctccgttttaggtgccaaagggattagttcccatcccccactaacgaactcagcctaagagggtacatagctaccaggagacaggagttgtgaatcgcaagcgcaatctatggacatgcgatcgcgatctcggtcgaatctccaagggagggtacccaaccttggccgaatcgcaatccacagattgtgcccgtaccttggccgaatctccaagggagggtacctaaccttcccactagaggagctcgtgctccgacataggtcaatgggtgattagatggatcggaaagtgatgctaggttaggctgtgttcggtttcagggaatgggaactaatccctcccgcacggaaaatagagcgatctattagcgcgtgattaattaagtattagcttttttaaaaaaaatagattaatttgatttttttaagcaactttcgtatagaaacttttttgcaaaaaaacgcaccgttaagcagtttgaaaagcgtgcgtgcggaaaacgaggagaggggttgggaaaatgggtgccgaacacacccttagttaacttaaatgcgcttattcttcaccgaattatttggtacacgcttcgaaaaaatatattttctttaaaaaaatattttattatgatgtattgcttagaacacttatcttaaaatgttagttaagtttagttttttaaacaattaatttatttctataatccatggtgataatccatcaaataatctaaatcaaaatgtgtcttaaagcatgtttttttaacaaattgtgatggttattaaaagggtattaggagcttgttcctcgcaaacccggactccaaattaaaccggcgtatatattccccctcgatatttcacatgtaacttttcaatgaacaaacagcacaacagtatagaacttacaacaaacaacttgattatctacttccctcctatataccctatatatatatatcatctcaaaatgatttgatcaattccatccaaaagaatagcagccacccaaaaaaaccaccacttacaagtttcaagaaaaaaaaagctcggaaaaatatttccaagaacccaaaaaaaggagaaagaaaatgatttctcggacaagcatgatcttgtgatgatcaattcacattttgcgcaagaaagaagaagaagaagaagaagaagaagaagaagaagaagaagaagaagaagaagaagaagaagaagaagaagaagatttcgcaatggagctctgatctgcatcggttggtagctcgctcgatcgatcgatcatgaggaggcgatcttgtcgagggtgtcggcgacggccttcatcctggggcggaggtcggcgtcgagctcggtgcaggcaaccgcgagggggaacgccgtcaccacctccttcttcggcagcggcggcgcgtcccggaccatcgccgggtccacaatatccaacaccggccgcgcctcctactggaacccgcaccgcacccaccggaccacctgcggcaccactggagccaccgacgctggcgctgtgcccgtgctcgccgctccctgaccggtccgtcgtcgccgccgacgacgacaacggcgccgagaacgacgccgatgtcgacggcgacgcgtggtcgccggggccgcgccccgtcaggagctccatcagcaccacgccgaacgagacacgtcccacttctgcgccgggcgcgcccccgccgtccgcgcctcgggcgcgcggtacccgccgccgcggtgatccgccgccacggacgacgccggcttcgccgcgtacggtatggcgccgccgagcaggccgcccgacgacggcgccgccgggggcgcgtcgacgacgtcgtcggcgcatccggcgacggcgaggaggcgggcgaggccgaagtcggcgacgcgcggggtgaagtcggcgtcgaggaggatgttggacggcttgacctcgccgtggacgaaccgccgcgggctgcactcgtggaggtacgcgaggccgcgcgccgcgcccctcgcgatcttcagccgcgttgaccacgacaggggtgtttgacccggacgacctggggaaaagtcaacgagtacatgagtcaacgatcaatttgcatatggggatttttttatactggtttttacactttttttttactactgtgttagaagattaaagtggcatacaacatactccatctgttttatattataagtcgtattagtcttttttctaatcaattttttttaaatttgatattgaaaaaatatagtagaattttaacataaaacaaacacattattataatatatccaatacagatataatgaaactaattttgtattttttgcgttcacaaaagaaactaattttgtattatagatgtttaatttttctataaatttaattaaacataaaaatatttgactagaaataagttgcatgaaacggaaggagttccatagaaatttcactcgattttaagccgacaaaactgcacatggcctctcaggtcagcaaatttgttacttatgtccccataaaaaaaatactactacctccatctaatatatatatatatatatatatatatatatatatatatatatatatatatatatatatatatatatatatatatatataagtaactaaccaacgttataaaaaaacatagcaagtacaaaatactatgaacagctaagagtaatataacatgcaccaaattttaactaggacaataaacaggataacaatctaaacaagaatcatcattattttctaccagccacatgattacccaaatacaatttgcaacgacgcatgtgcaaagccggacggcagcttagccttagctcacaataagatcccaatactcacgtgcactcaaatcctcaagcagcatatggaaatggaattatggatcgcccccacgtttattagctctccagctaagtgcccagaattttaatgaccgattaactagcagagcaatgtgtctgcaggaccagatcaagaaatgccttgaagtttcaggctttcagcagacacatgatggagtggcaagtgcaatggcagggcagcactgcactcctgcctggtgactgttcttgttccccccagacagaagcaacccattgtcactgtgtttgattggattcaacatgtcccaggccccagacagaggagacataagagtactaaccattaaccgtaggaggtggatcctctgcagttgtgcgactctacaagagtattaaaagtctctggtgtatgaatctggaggaaaatgaggcccacatataagtggttctcacggttcagataatattatagaggaactggtcgctaactgtaaaaaatatgactacaaccgtgatccctcccattcaggtttttttttttttaaggaaaggcaagaggttttgccttatatatttatagagcagaaatcctcctgccaattaggttgaaccagataaaactagatagcaactcacttagatcaatgcatttgtttctatgttactcctacatagataaatagaatgaagtgacatgtatacacacatagtgataaaaatatttttttatggtgatacttgtgtaatatactgaaaattttctggctttctatgctaactaaattagtagacaccaaacagtttgttgttagcagctcctagagaatttcttaattttctcttccatcattaaaggctgtcaacctttgtcctttcaagcctaaaaccacaacacctgccaaaacaccagcctcaccagccagttctacattgtcattgagcacaacagaaaaggcactctgattatgcaattatcacctcatttttcactttttagtctttttgcctttggctcccagggacagctttaatggtagtctctaatgatagattagtgaccaggagatgcatgctgttagggcatgacagtgacaaaggtttcaggcctgaaaaggtctttctgtctgtcttcccctgtttattctggaggggctggaaaggctccttctatttctcagccttttaattcactttggtttgtcagcattgtgcttatgtaaagacagtaagacagacaactttggagcttgatatgatttgatgtaaagattcttctaaacattaaactttcacaaagaagggtactctttcaccctctttttcccctctcatgctatgaaacagtactacagagcataaatgtgtgacttggttccatatattttaatgcacctagcttgtcgaatgatgcttagtgataattattttttattcaaagagaagaagtaaagtatattcctggtctatgcgcaccaactttatgcaggttacagctgctcctcatgctacttccatcacattggattttttggagttaaaatcaattcattgttctaactgtctaatctctaattgttttatctatggttgacaagccggggaaaaatgaactaagcagtaaaaatagtttatgataaaaacgtttatgttagtgtttttagctgtttaaaaatcaatgccagaaaataaaatacaaagaaaacacctcaaaaccaactcaaaattttaagttctaaaattcaaaataaattttggttgaaaaatgataaggcaataggtagacgacgagatgctatcgtacacattaaagcatatcacattctcaagcttaataaggaggatggattcattcctccaaaataattggaccacgccgtccagtctacaatggatagcagcaatcctccaaccaaacaacccggtaaataaactgcccgtccttctctatcaatttactctttcagttttaaactgaacggggtgtgcaagtgcaacgtacctagaagatgagaagaggttggtacttcatatttatctaaggtgttaacttacttcattggtcaaactgtttgactcagtgaatctccaactaacttgacaaaataattttgccattaattttcttgagaatatggtaagcttataagtaaattgtacatccttctctatcgtattaatcttttagctttaaactagacggtgtatgcaattcaaaaggtcagaagagatcgatactttggctgtctaaggtgttaacttactttcactaatcaaactgtttgactcaatgaatctccacttaactcaacgaaaaaaaagccattaattttcccaagaacatagcaagaatagtaggaaggccaaaaatgagaaggtcgaaaaaccgtccgctgatcgaaaatagctgtttacgcaaaaccattaattgaaccaataaaatccaggcgaatttcattgaaaatttgaaattcagtttgattatttgaatttgactggtttacctagccgagaggctgacatcggttttacgaaccctcggttttgcgaagcctggataggactaaggacaattcttccgagtgatatgcccatggacgcagggtgtggtccagccagggagacaagccggtgtgcctttcttctgccattgtttggaaccttgtaggaggaccaaggaccagtctcgctccagattttgtctgaaagcatttgccttttggtaattcctccccatgattggagatgagatcgatccatccatttcatttcatgtatgtaagactaaattattctgtgctggagttgtactccttgacacgcttccgttgcacggactcctttctgacttacaagttgcttgctgtctgttattgtacagcacacttagccctacttggattggggaattttttatccaattttacttctaggattttagcaagtcttaatggatttaccaagttaggactcattcgactttgatgattttcaatgcattattgtaagaattgaatccttaggattttttttctatattcatcgttcgttttacaggaatatatcataccaaattcctaaggattatagtcttgcaagctaatttcataggattcttagtataaggtgagacctcttgaagaaatttctaagaaatagagtgcataagacatcctaatcttttacttttcctattactttgatttgaaaatactactaaccaaataagcccttagttctcctagttttcgcagaatttacaaatcaaactgtgcctgcggacgtgctgccaaacagaacgcattaagtacatgtggctacatacgagtatacgacatctcaattaaagaactccaaaacaaaacaaaaataaagcacgcagtagacaaccagaacgctacataaaacaaaaccgactattgatagttactaatgtacttctactatacacgtagtagtattatcaagaactgtgaggtgtgtaatcgacaaaagaaaaaaaaataaaaagggtatgtgatggcgacattttcctaagccaatgttcctagattttattgatagtgtcacaaactatttgactgtctaatcaggcagataaacccacattttcctaatcaaaatgttttggctctcgggtgatctcgtcgaatgcaaatcaatcatggtactgcaactaccatgccactccgatagcaacgttccaaaataagtacactgtatgcaacaactaacgcaagacaatgttccatccaatctaataaaaccaacgtcaaaatctcgacaaaattttgtcaaaaaagagaaaaaccaacaattctcgattcttactaaaattaaagacgcccccagtttcgcttaccactatataaacaacttaaaaaataatatataaataaaatctttacatatttttttattatcggcgtaaaaacaaatactcaaaaataaactacataaaaattttaaaatttaagttttcggagtggcttatgaatatccaagagtgttagccatcaagagtgttagccatcgatatgctctgtttaatactctatccgttttatattataagttgttttgacttttttttaagtttaatcaaacttatagaaaaaaaatacaataatatttccatacaaaacatatattaaaaatatattcaaaattgtatttaatgaaaccaattttgtgttttagatgtttttaagtttttttttcaaactttcaaaattaaaggactttgaaaaaaaaaagaaaaacaaaggaggggtagtagtacggagtaaattagtttagcagtaagtgtcatcagagagagtgtttaccacgcatcgcggcggcgaggttgccgttgccgacgaagtcggtgacgacgagcttctcgtcggcggaccagtagtacgcgcgcagccgcaccacgttggggtggcgcgcccgccccacagcccgcgcctccgccgcgaactccttgcaccgctccccgcctccaccgccgccgcccagccgccgcaccgccaccggcgtcgcgccgttgccgaccaccaccttgtacacgatccccttccctcccttccccagcacgtacgccgacgaccggagcagctcgtccagctccaccctgaaccccctgtcgatcgccaccagctccccctcgccgtacttccctccgccgccgccgttctccgacgccgacgagtcgtcggtgtcggtgtcggagtcgacgccccggtgaccccatatgcagcggcagagcccgtggcggctttcgttctcgtcaccggcggcgacggtggaggagcggccttgtttcttgcgatccttgaccttccagtagacgtagactaggatgacgccgacgagggcgacgccggcggcgtcggcgatggagatgagggcgatcaggctggtcctgatcggttggtggtgttccgatgccgccgcggcggcggcggaagccgacgatggggtggtcgtggtcgtcgtggtcgtcggtgccggtggcgactgcgtcggcggcgggacggcgcggcaggggacctggagagggaagccgcagaggccggggttgttgaggaaggaggttgggccctggctggcgagcgagcccgtctgcgggatggcgccggagaggttgttgaagcggaggtcgagcgtgacggtcgccggcagccgccccagctccggcgggcgacgccggagaaccggttgtgcgacaggttgagcgtgccggcgagcctcgggagctcgccgaggtcggccgggatggagccattgaacccgttcgacgaaatgtccagctgctggaggctggccatctcggcccagatccccgccggcacctcgccggagaacgagttcccggcgaggatgagccgctgcaggctccggcagttccggaggtcgccggggagccccccggacagcgcgttcctcgacacgtcgaggttctgcagccgcgggatgtcgcagagcgcggcggggagggcgccggtgagccggttcccgtagaggaacagcgagtgcagcgacgacgcgttcgacagcgccgccgggacgccgccggcgagccggttgtcgtgcaggttcagccgccggaggaacagcagcgagccgagctccgacgggatgtacccggacaggttcttcccggcgagcgccaccccgaccacccgccgccgcggctcgccgcccgccgccgtcacgttggagcacgtcaccccgggccaccggcaggggtcggggtcggactccgaccacgacgacagcaccgacagcgggtcgtcggtgaccgccgccttgagcgccagcagcgcgaggccgtcggcggtgagcgcgacgacggcggacggcggcggcagcgcgaggaggaggaggaggagtagaatcgcggtgggtagcgtcgtcatcaaactcaccccaattaatttttcctcctcttcttctaatcttcttgcttactttgcttgagctgagctgagactcagaatgaaatgagctgagctgagctgcctagtgattgggttagtgaacagtgtgtgagagggagggagagaggctaacactaacactagtaacagactagcactaactgaaacatggagtacttaaatggaagagtagaggaaggggaggagaggttggggaaggttataagaagcagatctgctgatgttggcagctagcttaggttgccatgtgaggcatctgatggttttatggaattcagggtggactctagatcaatgacaatatatttgtcaacaatttttaagtgttttatctggcttagggaaattgtcaaaacattaggtgagaaatacaattacttattctatgtgttatcagggccgtctgtttttcatcggacgactagtcatatgtatcctttttttactcatggtttactattttgatttcgggagattaattataattgttgttcagtcctctcaaatggggaatatcagaggaaatcttcatttttttcctttacttttttttcaaacctttatcatcaattcttttggtcagggtgagcaatttaaatgagaaaaaaagataactaagaaaattcttccttaaatttggatgtcccctaattttttcccttcgattctaaagattttttcttttaaattcaagattgtttttgggaaacattcgccacccataaaaaaaatattcctcgaacaaaaatccacctttactttatttttaacactgatggcgcgcgagtgacaaacatcaccttgaaagcgagtttgagcccttgaaagtggccaccttggatattgaaaatgtagtgaggcgtgcgtgcatgctagtatagtagtgatggatgatgatcctctcccctttgccatgctagtgaggaagtggttatgtgtggagttgcataatagtgggggtcttcattaaataggggccccccaattgtgtcaatgcaactcaattgttagtagagggagaggctacctagagagagaaaaccaaagatattgtgtgtgcctatgaggggagtagaagggaagcaaaggaatgtgttgagttcaagtgttgtgcattgcatacaagtaccactactgcattgaatagtagaggatatgttgacagatagattggggggaatgatggaaggacgttgcggagttccaaaggctggatggatagatggccgttttctcatcatcatggctttggttggtgaagcatgcgtttgctagcttcactttggccgtgcactttgccggcgcctgagtaaacacgcacattgatcagagattcagagctaagctgtgccactgatcatttcagagcacaaggaaaagattagtgtgcatggatgcaggtagtgattgtggttgggtgttaattatgctgtcaatggcatgcttgggttgggttgggttagcaacaggcattgttgctagatcatgtctgtgcctggacttggggtgtgatttgatcgatcttagtgatgcagattatgtctttacagtacatggggcatgattggtgtacatgtggagtctttgcttactttctggtcttttgattaacctgtgtctcaatttgtttggtaaacttggctgctagttgcattgctatttggcagggttgtcctaagtgaaagttgagtgattgattaattgcaattggtaagtagctaagctaggtgtgcagtgagatatcacaggtcagtttattttcatcatgtgctagtttcatgggagatggtaattggtaagtgcaggctgttattcagatgatcctatggacttttaatactgttgtttagctgcctacactatagttataatgtgctaccaacaagcaacaactcttgtcccttgtccatcaaatggaaatatgtaatagtagacaattgtgctttctacagtttgcagtgacaggcttgacataggctgtgtttagttcagcgcaaagtttagattttggttgaaatttgagatgatgtgactgaaaagttgtgtgtatgacaggttgatgtgatgaaaaaggactgaagtttggatccaaactttggatctaaacatagccatagtgattacaaaataagtagctaagactgtgtttagttcagtgcaaagttttgattttggttgaaattgaaaatgatgtgactgaaaagttgtgtgtgtatgacaggttgatgtgatggaaaaggactgaagtttggatccaaactttggatctaaacacagcctaagtcatgcatactgaatttttcgcatctttggtcctcatgcgttcagaactgcaactctggtagaatctgcagagtttttctgctgttttcttgcagtatttgggtgagaaaaaatccagaatattttattttgtcgtatagaatggcagcaatgtacaaagtgtttccactttttaagggaatagttccatcgcctgctgcagactggtcattgtcgttcttgacttcttgatgcttattattacttctttgtccatagtttctggtttctgaacaatccaccagtggagatggagtgcacagccatgacaaagacaatcttcagatatcatcagtaactgaaagattaatgcaggtatagctgctacagacaagtagtttcactttcaggaagtcactataaaaatgattattgttcaatacagaagattcttggaaggttacaaatgcttccgtgattatcagtaaacatacattgtatgtacatagcgagttaatgtggtttatttctgtccattacagtccagtagcggtactcacttgcatgtatctctatccctagtgccctgattactgatagattccatttctctttactatgtctagttcacaagtgatagtgtgcatccaaaatttattccctgcaatgttaaagttaaggatgtgtttggttgagtggatcagggttgatgaaatatggccgtcaagtattttatgctgtttggttcacgggtgagatggatggagcagccacccgaagaataatcctctaagatattggatgggtgtatccagccaatttggccggatgagaccatccatctgtgctagcagagatcattagcaactactaattagtgattatcattttaagattaggattgattaggaataattagtatattttgttgcgtttgattagtaataagcaagcataaccttatgaactagtgtaagaaaaaaactcagtttgggatcgagaatttaagatgaatatacactcccactttgtgattgagaagttatgtgggcttatactacaaagagccagggccgtcgatgaggacgtgccaaatgagcgaccgaacaggatcccaaaaattagggggcctaaattttttatattttaatctatgccaatgtatttcattttttacaaagtctcactcttactcatttgttgatttggctagaacgggtttgtttattctttagctccgataagtattcgatggcaatcaaaaccaaatcaaagtgctatagctcatgacgatgatataaacgtgcattctaggtattaaatattccatttttctatttaataaaattaaatcactacatcatgacataatatttttgtaacattcattttaaaaatcttctttcgacttaaatagagctccactactaatttatttttgtctctttatttttgtggggctcaaaattgtgttttgtaccggagcctgaaattcccatatacggcccagtaaagagtccagagaaagcttatctgggccttcacgttgcttaggccagggaaggatctgcgctccgtccccacaaatttaggaataagtgcactttcgctcccttaactagtgactgaatataattcgtatcattcaaccgcaataccagatatctcgatcccctaactattaaaaccagtgcagtttgactcccttgatggttttggatgatggtttctctacgtggcatcttcgtgatacccctgacatcttttaaggcggtagttaggatatttatggcgtatcttactgaggaaggtacaaccagatgaatatctctgtgttacttccctggtaagcttccatgctcttccttcgaggataaggaggggcgatttctaccgggggcgaaggcagcccgggccctggccatgccgaggccgtggttgtcttcaccacgtaacttgagaagacgtccttgttaaggggtagtagaggtaaaccgagagagagagagagaaccgctaacttgcctggacagattcagctcgtgcccgggctcccggggtgcccgggcccaagttagtccgggacccagagtttgtggctatctcagagctattcccccaactccccaggatgcaaacttgggggcctaggcagcccccgagcaacggtagacggtcccaggctcccaagaccagggcctatgatcgcgtccttttggtttagctccctcttcagaaatgctttggtgtttggttaattattttgacggggaaatggggaccccattcccatttcatcgacagctatatttttggattaaaatataccgagttatgactaatttccaactaattgaaatttcggaaatatccgatacagtaccgaaaatgataaattgaaccctgcttcttcatcgaagaagctccatctatacaacgaaccctactcatttgtgcattgaagacgcaacactctagatagaaaagatgagaccgcgagaacgtccggtggtcttccgctggaaaagttgtttttccaaccctctttcatatatgtaatactccctccgtttcgaaatgtttaacgccgttgattttttaaatacatgtttgaccgttcgtcttattcaaaaattttttaagtaattattaattcttttcctatcatttgattcattgttaaatatatttttatgtaggcatataattttacatatttcacaaaagtttttgaataagacgaacggccaaacatatgctaaaaagtcaacggtatcaaacatttcgaaatggtgggagtactaattaagctcagtgctatgtaacctaaacgcttcacatcaatggaagtattccggtgggaagcttcgcattcacccttttagaaaaaaaaactagacagcatgtacgtggaatccacattagcaaacaaatttgtgaaaatgttgaatatcccatttgaatctcgacaagcttgaaagcagtgcaccataaccatctacaaccacccacttctttacatcaatatgtgatatgtaaaattgatgataaaatgctaaagtttgataaacatattaatgcaaagattaatgctaaattttaataaagattttactgcaatatttgggctacagttggatatagataacaaataggtgcacattgcaaatgatgtcgtatttattagatttagatgttaattgcatatattcgatcttacatagaggttggaatgttgaaaaatacattccatcttgtcacatatatgccgccaaatgcaattcctcttatactatcattcactatgtcgtcgtgagtgtgtttggcaagccttctgcacaaacatggtagcatctgatgctgatagcctgataccatctctcgagcccttctgaacaaatcaaaccaactgaaaagaaaaggcaaccaaacgctttgcaggaacaacattgataaccaaagatgctacataataattctcataggattaaaaagaaaagtagaagttatgtccatttaagcactaccggatagaaacaagaaccttacccctaaaaaaaagtcaaatggagggattgaccagctaagttctctttctgtctacaaatagatatatattataatgattgcaatcaattcacgaaatcttaaaccactaacatatgcaaaaatactgacattgatatattttcataactaaaggcaatgagaaattgagagatcatgtaatcaaatgtttccaagttcccacaaagaaatattttgtttagatccctgaccaatttccatcaatatggatgtgttgtatcttggagttcattaaggctatgcgcatgagaaagggatggcaaggctcatctctgtgtggcttcatcaatgatggaaagaattgtacatgttaaattgatttgcagtgttgtagcaaaagattgttagcatgcttatgcaaagaaaaaaaaggaatccacatcagatgtaccaaagcaagaagttaattttactgggaaactaccatctgcagtttacatggactccaatatcatcctcaaatccctaccggacatatgcatttaacataactcaaaaaacaagataattgcagaagtccacaaccaacaatagggacgcagactaaacattcctcttagtatcgttgcaagtatacttgtcaaatatcaaaagcgagaaacaaacccgagtagaaatcaaccagttacaaataaatttgtgcctctacagacctgacaatctggaccaccgatccaccgaaggctacaacatgggatgctgacttcatgaagttcatagaagagtgtccacgtcaagtttattggcattggtcacacaacaacataacaaaacactgtacgccaatctaatagctcaggttcagactttagacgaaaagttaatttgctatatcatggtaactttgacgtaggttttgattttgagtagagcaagtacagataagccataagtctcccaaacattaaatgaaatcataagtaacgaaatatagcattaagggtgatatgcaatcaggaaaaatcaattatatgaattaggaaagatctgcacaagtctacaaagctaatcagatttactgtatatcatacataactgatcatgttggcagaaaaatgatggtcagagcaacaatacataaagaagctttacctggtagcaattttgcctagacaccattgaacatcattaaaacaagtttgaggtcctctgcaactgtatatttaagaagaattttcatctgcactgcaaaaagccacaaacccatatatgagtatcacaatcttttttaaaacaaatattgacctaagaaggactaaacttcactgcacaattttttaaacaataggcctcagatatctgttatatatgggttgctttgaccaaatttgaaagcgatatttatatatgggaaacaaaacattaggatcacactctatttttatgtagaacaaattgcatgacttgaaaaatttaggaggacatttaccgagtaataaaaggctagtacctatgctgtcgggtattgactgagctgcaaccatcacctacgactccacatggttgtgcacaatccaggaggtactctaaaagaaccattttactccattcgtcccataatataagggattttgagtttttgcttgcactgtttgaccactcatcttattcaaaaaattttggaattattatttatttttttgtgatttactttattattcaaagtactttaagcacaacttttcattttttatatttacacaaattttttgaataagacgagtggtcaaacaattcaaacaaaaactcaaaatcccttatactagtagggtgcccatgcgttgcaacggagaaaaatcacaccaagtgaaattatgttaaataatcattgagtgtaaatcggatgtaacaaaaacattaatatagaactaataataagtatgtcacatatttataattttcacatctttatagtgttcacatgcttaggtttccagcctcgttatcaaatgagcaatattaagaaatgtattttgttcgcagagagcctgttttaatctattttcatgcaagcattactgggagtttttgtccttcgacatttgcaatgcttttggattggcttcgaatattattcttcgtccttagtattttcagtatttccagtttgcacaaattactgaacaagtgcaaaatattttttcatatcattcacacaaggaaaacagggaaaatagtttgtttaccttcgattatgttgagaaggatctgaagacgtcaactggaaacaacaggatatgggcaccgaatttctgctacttaccttcatgaaagtacctacgtagtgaaaaatcgcaaatcaggcttacatcataaagattccattttttcgctagtcgattccagataataacacataagctataacatgagtgagtttcacactattcatcatattgcagtatatttattaagatttcttgttgatccttttaatatagcttaattcatcaatcattcatagtcaaatagtgtcttatcacacaatcttgacattatttgcttcttttgaaaagaaattttggtttgacaaacttaaatactgtcatgtcaaattcccacaaccttaattggatgctctcgtcaatgaccttgacctcaagaccctggatttccataggacagatcaatatgaacccttactattgagaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13833 - DNA, 480 bp, Oryza sativa
ttagtcgactagcagcctcgcgtatctgatcactgaagacaagggagccatcaactgggttaagcattccaccgtgagcatagtaccaaaacttcgatcgatcaggccatttagcggtggtcggtttgataccactctcaatcaaacttgcctccatctcctcccacttcgacattgtgacgctatatccgcctgaccccaagtggtgatggtacttcttcttggcggcattgtttttgtttctggccatcatcgcttgcccttgttgccctgtcttgtaagcaacgaactcgtcccaatgatcccttagctttgggaatacatcgaagttcggtgttagtcccttcaagatgtatttcttgtagagatctcccttgaagctctggaactgttctgccattttcttcagagtccactgtttcactatgtctccgtacccgcgggtagcgtgaacgtctcgagcattgtggtccacagcat

SEQ ID NO: 13834 - DNA, 392 bp, Oryza sativa
accgtgaggatgcccatctccttggccacgcgcgcgatcacgggcgcagcgcccgtacccgtgccgccgcccatgccggcggtaatgaacagcatgtgcgagccctggatggcctggcggatgtcctcctgcgcagcctcggcggcctcgcggcccttgtcgggcttgctgcccgcgcccaagccgcttgcgcccagttggatggtgcgatgcgccgtgctgcgggtgagcgcctgcgcgtcggtgttggccgtgacgaactccacgccctgcacgttgcgcgagatcatgtgctcgacggcgttgccgccgcccccgccgacaccgatcaccttgatctgcgtgccctggttgaactcttcggactcgatcatttcgatggtcatgatggt

SEQ ID NO: 13835 - DNA, 308 bp, Oryza sativa
atggtacacctctaccgttggatgtgtaaacggtagctaggaaaagttgtgagacagattctgtcttgccttctttccagttactcgtattactgcctttcgagtagaaattcttagtttcaagcagatcaaaaatgaatcaatcggtgcaacttggtccagattcactaatttagtacaatccggaccaaccctgtccttacccgagtatgtgcttctgcaatatttccatacgggtttggataaggaatctgcattctatctggacataaccgttggagggtcgttcatgcacaaaacgccgtcag

SEQ ID NO: 13836 - DNA, 612 bp, Oryza sativa
attcctgcagcccctgattaagatgtacattttctctcgatttctattagcacgtttttcaaactactactagtacgtgatatgtttcttgcaaataatttctatataagtcgttttggaatatcaactaaatttatttatttattgtaaataattaaaacacaattaatcatatgctaatagctttcttattcttaatctatctcaaatgccattgtccatcgataattaattactggttgattgatcaaacgagctcatcattgagatcaacaatggcgtgcagcgttcaagtacgagccgtaccacaacgtggtggaggtgccggctgagacggactacgacggctgcgtctcgaccaaccccgtctccgtccactccggcggcaacaccaccttcgagctcgccgccgccggcacgcgctacttcatctgcagcatcccgcgccactgcctcaacggcaccatgcacgtcaaggtcaccaccgtcccttactccgcctcggccgccgccgccgccgccgcggacgccggcccttccccggcgccgctcccctcgcctcccgccgacgagcagcagcacaggtcgaactcggcgtcgtcgccggcggcc

SEQ ID NO: 13837 - DNA, 725 bp, Oryza sativa
atgaattagtttagagttagaaaaaacaatgctgcaaccagaaaaatgggttgaattaaaaatgatgcgaaaattacctctcgttcaacttgtcccttcttactttttccctgcatgctttggagcttggtcgagtgccactttctgatctcggactaatgttttgtggtgccaagttagaaatgatcaaaagaaaacaggaaaggaaatgtagattggataatggatgtgaacaaaccgtttatttgttggctgttctttgccatgttcacagtccacagagccattgatttcagcactggtgaaaaaaataaacttgtacttcagtatgccatatgtcacgataatatacagcaataagtacataaaaaactatacaatgacaacaaaagaatcaagcaaatttaacacaacagaacaatacatcagttaagatgcactgtgtggttcataacaccacaacctatggcaccagaaggtggaagcacaagtcaaaaaccaggacagatttaaaaacacatgagatgacttcctggtgcataaagaaaatgtactagcaccacaagactacaaggtatcataaataaaagaatactcttaaatcaaagagttgcagtaaacaatatcctaacatgaacacgttcttcaataaatttccattccacagtaagcttcgtgctggaacccaagtgatacagattaaccacttctctcaccccgtttct

SEQ ID NO: 13838 - DNA, 1380 bp, Oryza sativa
aattcctgcagcccttcctcggcctggcgggctattaccggaagttcgtccacaacttcggctccatcgccgctcccctcaccgcgctcctgaagaaggacgggttcacatggactgccgacgccgcggcagccttcctcgccctcaaggaggccgtgacgaccgcgcctgtgctggcgctcccggacttcgccaagcccttcatcgtggaatgtgacgcgtccacgtatggcttcggggcggtcctcatccaggacggccacccgatcgcgttcttcagtcggccggtggcgccccgccatcgctccttggcagcctatgagcgcgagctcattggtctcgttctcgccgtccgccactggcggccatacttgtgggggcgccgcttctacgtcaagacggaccactacagcctaaaatacctcctcgaccagcgcctcgccacgattccccagcaccactgggtgggcaagctgctgggatttgatttcaccgtggagtacaagtccggcgcgacgaacacggtggctgacgccctgtccccccgggacaccgaggaggcttccctgagcacgatcatggcggtctcgggaccccgcttcgacttcatcgaccggctccgccaagctcaagccagggacccggctctggtggcgatccacgacgaaatcgtcgctggcacacgggcggcgccgtgggcgatcacggacggcctcatcacctacgacggccgcctctacataccgccaacatctccgctgttgccagagatcgtggcagcggtccacgacgatgggcatgaaggggtccagcgcacactacatcgcctccaccgcgatttccattttccaaacatgcgtcgatgtgtgcaggacttcgttcgggagtgcatcacgtgccagagatataagacggagcacctccaccccgccggactactgctgccgctgcccgttcccaccgtcgtctgggctgacatcgggctcgacttcgtggaggcgctgcccagggtaaacgggaagtcggtgatcctctccgtcgtcgaccgcttcagcaaatattgccacttcatcccgctggcgcacccgtacactgccgagaccgtggcgtaggcgttcttcaacgacatcgtgcgcctccatggtatgccgcagtccatggtctcggaccgtgacccggtgttcacctcgctgttttggcgcgagttgatgaggctgatgggcgccaagttgcacatgacgtccgccttccaccctcaagcagacggccagacggaatcggcaaaccgcgtcatcgtcatgtacttacggtgtttcaccggcgaccgcccccggcagtggctccggtggcttccctgggccgagtacgtctacaacacgg

SEQ ID NO: 13839 - DNA, 16843 bp, Oryza sativa
  unsure (1)..(16843): unsure at all n locations
gtgaatttacatgagtgatgaggcacatgccagttctgaatgtagtatattacaatgctaacaagtcatactcagttttattatctgcatgctcgtgtatggtaattaatattgttatctaaagtagaatagtgggaaaaaagtctcactatgttcctttcaatggttctggcatgatttgttctgttataaagatacattattctttcaatgagcaattggcatttagtttggtcaggtttcttgtaagtcataggcttatcatttcagtactatgatagtttgtatttaaatgatgtattagcactgatttgcaacctgtgtgaccttttatatccacatgctcactttttggttgatatgtaggtgagagaggccttggagtatctacacaaaagccactttattttaagggaacaaacatgcatcgcattctgaaaggttttatggctcaggtactgaaaattaaaccaaatgatccaagtcctctggccactgcatatttctttgtatcaactcacagtatgtttttgttcttttatgggatttcaaatgctgaactctacataattctagaatgtagatatgaatggcttgctagttatacagcataatcccagatttttttttgttccatttgcaggatatatctactctagattgcattctagcatccattttttccctaactatactcatcttatcaaaattttcaactgcagggtggtgatttttcaagaggagatggtattgattcattatcccaggcatcttctttcaactgacttcttgctgttgtacactttataagctcaacgttacatgctgtttccaggacgtggtggagagagcatatatggtgcaaaatttaaaggttaatgactaatgaaatttgtggctgccatagaatttttttaatccaattagtgtcaaatgcattagtatgctttcgctaaagtttttgtatgtactttctggtgttctacagatgaaaacttcaagttaaagcatgaccaacctggtgttctttccatggcaaatgctggaccagacagtaatggatcccagttttttataacattcatgccaacaccacatcttgatgggtattgcttctttctgttagtcagttggcaattttctctgttaatctctcttctagttccttgtgcatattaagttatgcctttctttctttccttactgcacaaagatatagtacttgatatctaccaataccaaaatttaacattctagagagatttagtctattaaaaaaccttgaatctaaaaattctgtacaaccatgaaagatcaattagcctcatgcatacacacataaaagttgccatttgttaaataatatcttataaacagcacatttatgtctatgtatatacaaccatagaaaactctctggagtgggtgtgtgtgtagaacacatcattaagccctactcctttcttaaatgtgtctacaagttgtgtcaggtaatggttgagagtatgtggtggctccaacacagtgtatgttgcccacagaagtaatcaatttcctaatttctatggtgttttcctgtggataagaagtcatataacttccttttaccaatggctccaaaatctatcaacttcaaatgacttaaaattataatcgtgtagcaaacatgtggtctttgggaaggtggtcactggaatgcccttgctgaagaagcttgaagcggtaggttctgataccggaaagcctacttgtgaagtgaaaatcgtggactgtggtgaagtctctgattcccagaatcagctaaagggagagaaaggtaaaaagcaacataaacagataataccaaacagtccatgtgttgtctggttagctttctcactacttgttcttttgcagaaaagaagctcagaagaacagaagacaattctgctgctgaaaaaagggtcaaaacccaaaaaccacctactcatgataaacaaaagaaaaagagaaagcattattcttctgattcctatagctcagattattctgacacacagtcctcagatagtggctcggaatcagaatcatactcttcgtcatcattggatactagctcatccagcgaccacagacacaagagaagaaaaagttcgaagaaggataaacacaggtctgcaaaggggaaaagcaaacacaagaagactaagagaaagagtagaggaacaaaaaggaaatccaaacggtacgttgatgacctgtatgatcttggtagtgttattagcttataatgatgtatttgctgaaagatcccctgtctggagctttttacagaagctacaggagctcaagtgatgattcagatagctcaaagacaggcggcagcagttctgacagtgaaagtgaaggccgtcgtacgactcgtaccaagcattcctcgaagaaaggtaggacaatagaagagtcaattcacattcatttgctatgaaaatcctgagtagtctaaaatatgctgctttgattgaactgcacagatttctgttctgcttgttaatactttggactcgctgtgattgtccgtgttactttaaattttctctgcctgttaaattttctgttttgtggttcaaaaggctgactttgtccactgcacttgctaatccctgcttgcgacctgtccatatctactttttttctgcaactaaactatctattctattctgatacacagaacaacttatgtctgcaactatttttttgattctgtttaccactcaaattctttaagcatccacataattgacgatactcttggccaaccttttgtttattatcatttcttgccgaccttaattacaaaatcattctagaatactttgaactgattctgaatatggtaaatgtagagtttcatcatttatattttttaaattgctaacaaggtaacatctttctaatttatgacagaagttaccatctttgaccttgaagttttgcctgctgtgtttggttatgacgtatgtttcatggaatgtgttgcatttaattgtttgaatgtactgagattgtctacacaattttgaactaataagcagctttgttcatagcagatccagataacaccaaaactataagtttggagaaagatagtactttggaagatgcagataaaggcaaacaaacagctacccttgacaacatatcaaatgaaggaagcaaaccctcaaacacagatggaaatggggctggtatcaggtacgaaaatcagaactcagaagataaagctagtaaattaaggtttgattacttaaaacaaattacttactgtcaggttcctttcagtactactccctccagtcacaaatatgtgacttttggaatgcgtgcaccgtgcagtcaacatgtttaaactttgaccatcaatattgctttgaatattttgaattcaacttttaaaaatgttatgattatatttgtcttaaaaatagtatcaaaatattataccagtaattcctaataaaataattgtcttgatgactgtgtcattgtgcaaaacgtcacttttttgtgactggagggtatttagcagggataaaaatgtcctgttcaacattgagataaccttatcctttgagtacccaattgagatgtttgtttgtatttgcagggatgatcctggtgcgagagctaggagcagtcctattagggctgatgcaagtttaacaaaagtggatggcaacaatggtgctgatactgcagaggctggtatatctagagctgaacctgtgccaaccaatggtaaagatttagcaatgggctctacagacaacggacagcctcaacgtgtcaggaaggggcgtggttttactcaacaatatgcatttgcacgtcgatacaggacaccatctccagagcgttcccctgttcggtctcgctacaatgatggaagaaatgataggtggaatcattttaataggtactgcagttagattatttaccacatttttttaaaaaaaaatgatgattaatttaatgtttggatgccatcatgtgcaggtatggaagaaatggtccctacggtgcacgctcaccagtaagaagatatcgtggttccccaagagccagtagtccgtccaggttggtattcttctgattatccttggaatctcctagtggtcagtaccaattgattgggtagagtggatgaactattttgaatatagttgtgtactcttcatgagttcatgccttctttggggttaacagtgtagtttgttattatttagtaccataatacccggggttatgtgcaacgtgccgaaacatctgattttgttcaacttggaccataatagtggggttttataaaaactttataaaatttactcataactatattatgatgccttcaagagtttagttaatctgaatattacccaagttcataacttgctttcattgccttatatttcatgccaattcttctcttaggtagatagcagaggctatgcatggacaaacctcaaactgggttacatgttaacatagatacagtatattttgcttagatcaatcagctttcttgcgtgattcaaattcaccaaacatttcctttttatccgcttcccttttttaccattgcaaggccatgttactttagcaatgagctatacatttttttaagaaactctgaaccattgcccagatacccaaggagagaccgtagcaggagcaggtcacgcagtccattgaggtaccgtgagcgtggaggatatcgccgccccagtccaaggcacagccgcagccgcagcccagcggagcaccagaggcgagatgtaagaaacaggcttcgatcaggtcgggatggtggtggccctgatcaccgtaatagcagccctcctgtcaatagaggaaggtcaagatccaggtcgaagagccgtgatccctcgaagtccagatcaccagatgctcctgccaaaaaggggagctcaaaatataaccgcaggcgcagcagcagttcaagatccagtagccctgctggaagtaaaggcttggtttcatactgagatgtgatatcagaagttgaggtgatatcaggagttgaaaaccctatgttccatggtagcttggtattgagtactaccctttaagaatgatgatgtagttaatggcttaatgtactcttcttttgtaacgtttctcattcagagattgttgtttttatgcatcttctatttggatatgatatttagacttctaagttctaaaatgcttcgcatcataacctaagcataatttataggtaaatctaccctttgtcgtctttttatgattggaagtttgtagtctcttgtcctattaaagcctgtcggtaactttgtttagatagtctcttgtcctattaaagtctgttggtaactttgtttagatatttgtattggcacgtttcttgttttcaacacgagtttttcctctgttgacaagaaaaaaatgagctgtgaatctgttaactgttatattcatattcctgcattccagtcgagtccatgtttgtttttcagatcccttaaatattgcctcatttttatttttgacggttcataaaaccaacaagggaacaaatgaagcaagctagagaacaaagcatgccatcagcacccacaacacaacatgaacacgaacattagaccattggagtgttcagtgcctaacatgtaacagaagcttaacacaacacaactttccctgtcattttgtctgacattgcttggcaacttggcatcaggtaacagttaaatgggcttggtcctttgggacaatctgttctttgatccacatggagacaggtaccagcacaagtaagaagcacagatcatttcgttttgttggcattgcttggcatcaggaaacagttaaattggttggtccttggggacaatctgatctttcatccacatgtagataggtaccagcacataataagaagcgcaaatcgtccccatgacgaagcggaagatgaaggtgaaaggattcactggtttctcaacatcttcagcctttggaccaagctgcaacaagaacaaaaggtgaaaaaccagataacaaagcacatcagtgtgagctagcatgacacagaactcaggtgtgttagactcactgttaacaaatttaggtgctcttaacatttgatgtttgtaacaagaaagcaattctgagttaatatgaagctagaacacattgagatgcaaagaatacctgcaaaggggaatcgccagacgatcgcttcacgcctgtcacagagcaccccatgatcaggccatggcgtcgaacaccgcggtaccatttgggcccaattctcttgatcttgacatcctggaaccctgccttctggaaccattctatgtactcttcttccttggggaagagcatccacatgtcggcgaagaagcgtgacagccaaaaggttgggtgaaccgggccaatcaaacaggcaactccacctagcttcaggaccctgtaggcttccctgattcctcgttgtggatcaggccagtactcaatgctgacaaaacaacaccattggtaagtatggcatcaaaactgatcaatgaccacatatgactaagcttaaaagtaaatgaaacacaggtcactgatgaccacatgcatattgctttcacatttcaggtaatagattcattggataggagtgatacttaacatcttcacatggacaatataagtcaaaacaatcataagagccagtattatcatattaacagaaatctgatccaacaaatatataaacatctcatcatggacacttgaatcactgataacattaaccatttactagaaaccacactactgcaaatatatccaaacagatggttttgtcatggtgtcaacgctagatcacatagaatttaacaggtattttctttcattgatacagaaatctatacatcaatatcaattcaaggatatgcaatgacaaaataatggcattagttgatgatagatgaaaaaaaatgttattgtacagttcacatgtgaagtgtaacacattcacattagcaaagagaaaattcttgaccaaacttaagttgtgcccacacataccgtatattggtttatcctagtaaacacaaccaagaatgaattaacttcacaatcctgaacacatatctatacaagacagcacataaaatgttttatatttattttaataaatcctgcatcttcttatagccaaattataagaatgattctgtgttgctatatgtcctattaaacacgacagaataaaccttcatgggttgctcatgggaaacacaattgagaaaataccgtaaactgcaatgcaaagaggacattagagaatcacctcccagcagagacatagcgatcaaatgtgtcagtcgggtaggggaggtcctcagcgtcaccctcaatgatgttcaccccattcagtgccaccttctgcctggccttctcaagctggtgtggagactggtctagcagtgtgacattctcattgtccacatgcttgacaatccccaatgtggtgaacccagtgccaccaccaacatcgacaaccttgagcccatggtggtagagttcagcaggctccaatgcatcatccctcatgtcctcggtccaatgccccgggtttatgacatggtcatacacaatggaaaggaacctatagaaccagaatgcttccttcttgtgttgtatgaacctaggttgtgatgctggcctagcagaggagaccgcgcactttggtgcgatatactttacccttgatctcacaccacttctatttctcaaaggaatcaaacctattttggaaggccccaagaatcctaatccaccgggagctctaaatgtagaggaagaaaccatttccttcattgttgtttgaaaacttggatcaaatcacgtatggcttagtgtatcgttgggcaagagaatactggttttatgtacgaaagaatcaacaaacaggaatggactaggtagctcctatgcttcatttgtgaggtttcttggtagatttacaatgcaaataaatagaagatcagtagatcacatatgagtgcctgtacgatgcaggagagagggagctagttcttggccatggtaacctcagctgccaagccacaggaacttgagaacatgcaacagccatgtatgtaagcatgtgtgtgtgtgtagtcgtgtacagtatagaccttttttgtgatgcaacaaaaggcttaagcttctattccatcaggaattcaggatgctgatggctttatttgtcttcatctcctctagttgctccattgatggggacatgtgggttggggattgtaaacctatggatgacaattctggacaggaatgtatgggggacttgctacttggcatcttgcagtccttttagttctcatccaaacattacacctaatttgtttggtttatgctacataaacagctttttttttggaataacacaaattcaaaatgaaagttacaagagctgcccataacagtctaaaatacaagtatcatttaaagtacccataattttcagttctaaggaagattaacagcatatgtgtgattacacaattacttctgcaagtgaaaatattttattgtgtaaacttatggatttctttaagttcacaaactaaaatgggtgcaaatgttaccaacttaccatagacaaaacccatattttggtaatcctaatccacataatccaaattgataggtatacacctctcaactctaatgtggacaaataaaacatgtttatagatcttgctagttaagtaaaaagaaaaggctaacagtgacacctttctgcttttaatgatctgtaaatgactatatatctttagtgccataaaaaattctctatgagataaatatataggtctacgaccaaggagaactcatgatcaaccaaagtaaattgagcatacctggtcaatgtgaagaggaccatgaacaacactggagcagaaatcaagcaaagaattatatcgcatgagctctgatgaagatatacatcacatgggtacatcacagaaggggcagcaaattcatttataattgatttaccattactccaaagaacgtcaaggtgacttccttttttacattcacatggcaaaggtaggaaataaaaaaatgtgtaaaattggttagtgcggaagttcccaggagctaagattgaatttgtacaactatatcattcagagtgaagtaatacttttacagggccctggaagctgggacaagtttcaaacataattcctcaaaaaggtaactaaaataccactttcagattacttgttgagactatggaggatcattcaggatttagtagagtgaattgcagcttggactgtctcttgttaccatagtttcactttgaatccgctttaccttttgcttcactttgaaccccctttttcttcttctccagctctggaaatagcattatctcctaggtcacaccacttccgcggttctgcagccgctgccataatactggcagtggatatgtgcctgagtttgaggagaagggcaaaaaaaaaggggggggggtgcaaaatgaagcaaaaggaaataataggggtccaaagtgaaattatagtaagaaaaggggtccaaaatgcaattcactcgattttagtatacagccaaccagaatcactttactccctaaacagctaaacacctttagatgctgctccttcttgctgattagctttctctgcttcaagcttccttaaagcagatgaactcaatttctcaccctctgctcctccggatagaagatcaacaacctcaacctgcaattgagctcatcaatatttggatcactatgaagcatatcttgtacttgtaccaggttttttttaaaaaaaaataattctagggagtatgaacaccacaccttcagcaaaggtagtcctttctcttctcttttcctatttacggcaaatccaccatttaatgtctccttactgaacataagcagcatcactaggttaaatgaggaaaaacaaaaaggagaaaatttaaagtaagcacgaacaactctacattatttaagcatggcatatttcatacatttttaatatagttccgtagctgtttgatgaatgaatttcaattttggtcagaacacatgcatgaagtaataaagggaaaaaaattacagagacttaatatcagataagagatgatcaaattgtccatacctgacaataatggcatccaacttatcatcaataatggatgggccataaggatcctcaataggctccacttgtactaccagttctggtttaacagactgcattttatacaaaaccaatcatgagctttcaacaaacatcataattgagcatcccagaagcagcagtttcacttttggcagctcctcctaagtatgaacatgcttaattgggtatgtacttatgtgaaactgataacccttacaagtttttttttcttttttttgcggggaataacccttacaagttaagaagcatgcaattccaaaattctatatttttctaaaatgtagacgactaggaacaggtcttcagtacaaggaagttatggaacaaatttcgcagcaagttggtcctaaattgccacataactcttcaccaaaccaattcactgtataacttcttattactcacctaaagtaatgtgccacatgagagaagctaattctcatgcgcgaaatctaaggtttactgaattgtctttgtaccagaataaattatacaccgcctcccaaatcaactgaaaattacacctttgatttccttcatttttggaagagaaaagattcatcttgtcacaacgtctcacaaacagcaataaaaagcagctcagtaacttaattcatgcaaactgcttccactagtcatcacccaatgttccaatcctttgtaggagtatttactaacagaaactatatactacataataaagtaggcaagattatcccccaccttgatgtaatcctccacagccttcatgcgcttttcgacgggctcgatcaactcagcgtactgcaggcacacacacagagggtggaaatcaagaacacaaccagcagctagcatcacagctccaataaccggtgaaaaatggtgtgtcatttctacctctttcttggcgagcatggggcctgtgcagacgcccaccacgatccgatccctcgccaaatccgccgaggcctacacacccaacaaatcgaaaaattcgttattcctcaaagaggattaatactaagctcggttctttaggaggaaaataaaaatagaaatcctcttcttttttttttctcaagctcgcagcaccgcaccttgaggaggcgacggtggccgtcgtggaggcggtcgaaggtgccgccgaggacaaccgagccgtacggcggagcatcctcctcctgactcggcggcggcggcgctccggcgaaggtgtcaccggcgacgggaggagtgatcattntcttttcctacttcaatctgtccacctctgcatgctctgtccggtggagtaaaggtggtcaccggtgaatacgggatcagagagaggcccggggaggaggcggcggcggcggatccggcagcgggaggcgccggagacgagggagaagggcggttttgcgggggaactgacctcgctggaggaagaaatggatgcggggcggtgggaaggaggaggccggcaaggggagcggcgacggcgagccgacggggtctctccggtgatgtgggctgaggttgccggcgattggccggcggcgcgagaggaggaagaggcgaagagcactttctacttttgacttttaccctttatttcgtttgtttatttgtttctgttttttttctcttgcgaggaaaagaggagaaaacgtacacgtggacggtccagattgactgattgacttctttagaaagagaacgtatacgcacggcttccaacttcttctgccgtggacggtccagattgactgattgactttgtttcctagaactccatccgtcccattttaaacgcaaccataaattttcgcgtccaactttgatcgtccgtcttatttgaaatttttatagtatttttattgttattatatgataaaacataaatagtacttaatatgtaacttatgttttttaatttttttaaataagacggcgattaaaattaagcacgaaaacttggacggagggagtaccacgtagtccaagaatttctttattccacatgaaatgaaattctttatctcacgcttggtgttaaattttttgaagaggaatcatatttttccatcttttttctcggtgtagctctattttttttctaattctttcagtagtaggtgataaatccttccacagcgaagcacctgtaataacttcatcaatctcaagacatattggtcaatctttaaaagtgctaatagggataggttgtaagtgtgtgcatggatagcggtggccggtgggtctgcgcgcatatggacacctatatctatattatgtttagaaaagaaaaaagaagaatctcccacctaaactccgcttgattctcatctctataaccaaacaaggggtgtgttcgctaccaggggatgggaacggtgtacagtgcacacgaaaaacggggcggtacattagcacgcgattaattaagtatttattttttttaaaaaaaatagattaatttgattttttaagcaacttttatataaaaactatttaaaaaaacacaccgtttagcagtttgaaaaacgtgtgcgcggaaaacgagtgagagaggttaggaaaagtagcatccgaacacacccaaggtcatcaacttttctcttaatctcccaatcccctttcccaaacacgattctcaatctctatagcaagcacatcaacttcctctaataaactcctaatcccccttcctcgaagttgaaaaatcgaacatgaatttttcatcagaaaaataatttgaaaatttattttgaacgcattactattgacgtgaaattcgtcgcacacgaagacatgggagatccgcttagctctagtgcaggtcatatcaatcgggtttagggcgtgccagtaagtttgataccacaactgacagaatagataaacaaaattgtaccaataaaccaatcgaccgatgttgatatagagtagtaaatacaagattacggcatacatcgggctagtggtccgatgtaaatcagatgaagccaatatctgtcaaagcacttatatatcggctagaaaaccgatgctagtaaggtacatgcagataaacataaataatgatatcagctctatccagctttccgaagggacgaaacctacgagctatcaactttcgttcggttacttgatagatcggtctgaaccgagttgaagttaacaaactaaaccgatagaaaatagatcagtcgtactacggtcgtagatcgactagatgtaatataaagataacttatcggttagccctccaataaaacgtagcacaaaacctatcaacttagcaagacttgattatcagcaacaatctagaggatcagacctaaccgagacagtacgagatcacatctaataaataaactatataaaccgatagatctacacaaacgtgatgtatataacaaatcaatttaaaacaacgtacgcttagagaaatatcaacttatccagaatatcagacctatccgagaaagtcataattaagctgatacgactgtaaatagcgatgcagttaaagatagaattaatatatctaatatgcaacgcttgcatcaacttggatagactatcagacttaatcaagaaagttctagccacaccgatacaggcgaagttgatagaacttacttcctcactggagatcgaacttaaccgatgtagccctactcgaaactaagaactcgttggaataagggtggcaatgcattgaaagtatttgtattgatatgtggagatagactaaaaaaacccgggtgtacatatttatactctcaggttgatactagtcctgatcgaatacgatcatgcttaattaattgatagaattaaactgccatgccatggtttcacgattccttcatgaactcggtctcttctagataggcttctctcagctgatcgacttttttggtgttaacaattacacataggccctctaaacttcgccgaagctcacatgcaaaatttgaacttcaggatatgtggatacgtctactctctctctcaaaggaagccctcaatctttttgtcatgaatagtgacaataacaatgacaatggaccaccacttgatagttgaacacaaaatccaaacattttttttctcattgagagggagagaaaaggacacaagcatatatgttttcagccttcagtgcactgtcacttgcagttcctttttttaattctgtcactcttttaaattctgtcacttgcagcccacaactctcttataaagacaaaactgatgtttatccattgttcagataagagtatctgtgtactgattattgcctttgtggagtcattttatacctgtggctgaaaagaccatacatatggcaatgaaattctgtacattctctatcatccaagaaattttcatcttccaggtaggttctagatcagattttaatctgtcaagatttttcatcaggtacatatatgaaacataactatcactagaatcaccaagtacagccatggacagagtaataaacaagtgaagagtgtatgcacctcttgtaccaaatattcagatctggacaaataacacaatggaccagtattcaagtaggataatttcgcggtagcttttcattgtcctgaaagtaaaaccataattttgctgtagcttttcatgctcctggaagtaaaaaccatcaaattctcatttacttctaacaacaaaagtttggtgaaatacaataaactaccagtaaaatttccacaactgtttttatatttacaacaccatcaaaggtggaaaaaggaggaagtaagctccagagatatctacaagatggagacgaagagatacaccgagctcagaacagcacactgttcttgcgaaaaccgttagatgtatagccttcagttctcaacttatctgatattggagaagattcaatggttcaagaagataataggtgtctcaactgaagcaagtgttcctcatttgtgatgttaagcgaaaggcgcagatttgtcagaagtgactcttgctcccatgtcagtggtcccaatgcatagaaagctctcactgttgattgatatgcttgtagctccagctcatggacatccattttgaaatcacagccatggacattgtcactctcctgcctaagcatggatggacatgaagacatggcatcatcagggaagctgttcctgactccgacagattgtgtgtcagtgttcatagagtgttctgagaaattcacactacaactagccacagaacactcgttttcttctctaacttgaagaggcatttgggatggaggacgaactatgctgtctggttttctctttgttaagttgttcttggcaagatcattgtatctttcactagaaggtctacaaaagagatctctgtggatgtcattctttgcagacactttcagaggctgtggtttcctggtttgccgatgaacttcatgtgcatctactctccttttcttgcttgctcctggaattgaatcatctggtggcatcctagtcagttctaattttttcttcacatttcttgcactagaggaaggacagagattgatcgctttgtgcctcttagtgatgtgatcattagcttcattggagtgatgatcatcttccatcaccatttttgagtgatgaaatgtttgatcaacatgttgggtctgtttttcactctgctttctgacctgaaaagggggcaatgactttttaattaccatgtcaatgaaatgcttgctgaaaaacctgagtgaaactagagaggtgaacaaaatttcagtcatttcacaaaatttgcaataattacacccaactagtaatgaaatatagtacttgagcatgccatgtcatactactgatgtcaaataaattcgtctgctgtcgtatcaatcttgtagccaaatgcttattggaaacaaatcacactagcggaagcaataacaagctttacagattttcaataaagaatctaaatcatcagttgaagttcaaatacactcaatggagtcttttgcaaattcgacaaacatactaacataatctcttcctaagaagtccaaagaatccactaataatcatatatgcactactacaaagcacaaacatggaagaacatgagctaaccacacaacgaattgaagtactgaaacgactagctactgtaataaagagtaacgcgtgggaatcagtactcactttgtctattacagctgactgcttgccatgataggcatgtggaaacctcaagcaagatatgtggaattctctcatttgcatgcaacctgttaccctgatgacgaaatagtcatccttcagcacctttgcgatcttcccaagcctccacgaattacgatccaaaacctcagttatgtcaccaagaacccatctgccttttctcataccaactggccgatgcgtcctaacatcatccttcttcactgcaggcatcccttcagcagcaaagtttagattgctatccctaaagttatgtagcgttgtaccttttagtttcatcatctctcactaagaacctgaccctgcttacaaaaggcagaccattaggaaagtaaaagt

SEQ ID NO: 13840 - DNA, 2760 bp, Oryza sativa
aacaaaaggtatgggtgcacagttctagcatcttgatgtgaaagtacgcaagtaaattgaccaaactccaacaaaatgcaccagattctcagttggggtttgttaaacattcaagagttgacatgaactacaaaagtatttcattaagtatggttcgtggacaactggtacactatcagaagcaagatattgtcccttattcggagatgcgttcacaaaactacttaatgaacagagcaaatccagaatgaacaatatcagaatctggaccgacttctttttcccttccatttttagcaatcaaacggaatcggaccaacttctacagctcaaagttggaagctgaacaaagggggagcagatgactaaactgcaggactgtcacttatgcatcatttaagcttcacaagtccaggactccaggtacaatctatactataagagcttccagtttccatgctctgagcagccatggcttgtttccttagtacaaaaggaggcctaagaaaagcccctaaatcaactagacattctacctaagccgttaattaaccgtgtgaaaggattcactccctatgaccctatctactgcattttaaccaaaattacctagaccatgattcagacaaatcggctatccttctgaattctgattttgagccaagaactaggaacatcttatgatatccggaagtacattcatggaagaatccccagaaaatggtagtaacttttttcctaggaaaagtcaaacctcttctaatctttttttttctgaaactgaaaacctcttcttatctgtcagatggggtagaccaatcaaccaatctggatcagatggcacacaacttcacctaaaaagcatcccttgattccataacattgaaaagcccaatcaagatttcaaggagcaataatagtacagtacagcagctcagatcggaaccatgtactcaaagatctaatttggaccacactaaatatgcaaaaacaggagctttaacgtaagaatcaattaaaaaactagttggattgattgaatctgtgatcccaaaatttgtagcagcgaagtacaaatttcatctcagcccaatttcccttgtaaaatactaagcttcagagtggaaagaaatcagggcagattttgatccttttttgaaactaagggcagagttctagactatgaataacaaaacattaggatcttagtacacccaaaaactccttttttacctcagtttggtgaaaaaccaaatcagaaggcatcatcgagttggaatcacgaacaacagcagctcaagtcggaatcaccaacacaagaaactccaagatgggatttttaacgcgcaatctaggccaaaatgtaagagttggagtacaagaaatccaaagaaaccagcatcaaaccactcctcacctgcaacaagaagccaaccaacggataaactcgcctcgccgatccaagattctcaaaatgaaaacagttttcccctctccagattaaacaagcaactcctaaatcgggattaacccccaactcgtctgttcctccaatccaattcacgcaagaaacagaaagaaataaagaagctagcaaaaaatttcgccacctccaaacgccctaaaatagaaacccaacccaaaaattatgcgaaaaagaaaaaagaagatcagaaatttggtgcatcgaaggtgaccaacctcgagaggagatgggaggattaatccggcggccaggaagaaatcggagcgcctaattccgtgcctaaccgtaggagaaaacggtgtgctggctttgccctgtggattggctgtttctttcagttcttgctttcctgttccttgcgtttttgtcatgggaattattgtttttttctttttaaacatttccgatgtgtttgtaaagtatataaaaaattttatcactggtaattgtaatttctgaaaaagattgatctgatggtaccatggtaatgttcacgcttctgctaaattgattatatatattttttattttttttgtcttttgtttgggagacgagagcaagtgaatatagttttgtgtcactccttggtctctccccctgccttatttgattgttcatatctccttatttttattttatttttttgcataaaaaaagagaaaaaagctaagttccatgaagatataattatactttttgggtgaggaaacccgggcaaatatttatggatctattctcaaaagattatgagtaaccatttggctactcttttgagctataaaaattgatacgaagatttgtggctgacctatcttcttgcaaggctcatatgttcatggaattctatattaagatttataataaaatagataaaaaatacatattgattgtcctaaactgctaatttcttatttgttctgtcataaaatatagcaacgtagaactggatgaaacacattctagtacagcgaatctggatatatactagtcactaatatcattattattatatatgtgtgcttagcagttatattaagaattagattaggattaggattgtgtcaatgttccataagagacttcgaatcctatacgaatctcaattttgcagttataccaatttataccctcccctccgtgggagaatgttcctctatagcaacctgtacacctgtgggtagacgtacgtttcttggcgaaagtagcgccgccgtcgttgcagccgccatccccgcggagcagatcgatctactggcagcgttcggactgatgg

SEQ ID NO: 13841 - DNA, 22020 bp, Oryza sativa
aggaacacatcatctctcacattggtttcctcccgccgctgccgccaccacattatcctttgtcggagtttctgccgccgccgtacttcggcgcataccatgaaccaactatcggatacgcaccccacagcgaatactatggatcaatggtcagccatgcacacccaggtatgtgagataaggaacacatcctctaccttaaaagataggtgactgagtcgcttacatgtgagaccactctactataggatcacatgtcagtgactcaaagtcatgtgacctaatagcagaggatccaatttggttagatatactaaaagttaagtttggtgaattgttatttaaaaaaatatatattgatattcagttatacataccctatatgggacacaccataagtttggtgcattctttcttttatttatttatactgattttctttgttatatgtaggagaagtttggtgtatttttttttaaaaaaaattatactgactttctttgtgatatgcaggatttgcctctccagattaaacaagcaacttctagattgggattaagccccaactcatctgttcgtccaatccaattcacgcaagaaatctatacctacttaaaaaatacttaaggcttccgatcgtccgcttcgtccgtcgtcgtcgtttgagtctgagcccgtctttaaaaaaaatccccttgcagatcagccgattgctcccaacccctttgcccccaattcccaaaatacatgaatgacaaaatcactcaattgcaatcccaaatccaaaccaagaatccccacaaaatcaacatcccaaatcaaaaataaaatccaaaccctaaccctagccgtctcccggagcagccctcctcgtggtcgccatcgtcgccgtcgtcgtcaccgccttccaccgtgaattatcactggtaattgtaatttctgaaaaagattgatctgatggtatcatggtaatgctcatgcttctgctaaattgatttgtttgtttatcttttgttttgttttattttttaatttttttttgtcttttgtttgagagacaagaggaagtgaatacagtctgtgtgtcactccttggtctctctccccctgccttattcggtcgttcatatctccttatttttattttttggcagaaaaaaagagaaataagttaagttccatgaagatataattataccttttgggtgaggaaacccgggcaaatattcatggatttgttctcaaaagattatgagtaaccatttggctactttttttatagttatgaaaattgatatgaagacttgtggttgacctatcttagttcttgcaaggctcatatgttcaaggtattctatattaagatttgtaataaaatacataaaaaaatacacattacttgtgctagtctgctaatttcttacttcctccatcccaaatatagcaacgaaggactagatgtgatatattatagtacaacgaatctggatatatctgtccaaattcgatatggatatatatatatatatatatatatatgtatgtatgtccaaattcattgtattaggatgagtcacacccagtcataggttgctatattttgaaccgagagtacaaattaggactttctccatcctaaaaattttagtactaattagtactaaatatatcctaattactacttccttcatattcttataagttatatcaaatatgatattatttgatactatgttgctatatttcaggacggatagagtatttgatttattggaaaagccaaaaacaaaattataccaaatggccatagattttatccctttgcaagccaaagcgagctgagtttatccatgtcatgataactttgctgagttggagatgatgtgttctatacggtcttctacggttgcacgtgcatacacacttatttgtcgtattttaggacatacactagagcaaagcatatctttcgaatgttcgtgtgttttatcagatttagcatcaacagttatctacaagattttttttatataaaattacgtcttttacaatattaatttaaagaaaaatacttacagtgcatgcgtaagactaatcgatccaatggggtcatgcgctcatttatattgatattattttattgtacctgttttggtattagagtttacttattccaaatctagccaaatgtggggcctccgttctgataaagtaaatgtaatgcacctgggtgtttcctaacatcctgatcattggtagtataaattttacaatattattttttttttcaaaagaagattcaactccaataataaaattttagggttaatatgttagtataaatttcatgattttgaaatatatcattactattcaactatttgaaaccatgtcattataccccttcacttttttttttaattttcagtaccaaattgcagctgtcttcttattttatccccttcttccttcctagtctattttctataaatgtactgtaataaataaataaataaataatatatatatatatatatatatatatatatatatatatatatatatatatatatcttcattaatgttcattgaattaaagatttggttttgttttctcattgaatttgaagatttcgttcagatttcggatttaataagttgaagatctttctgactcatctatataaagcggatgaaacaggctagcaaaagacacacaaaacacgatacctcttcccttccccacttctaacatggagaacgtttttactcaatctgcactactctgtgtgttgtttcttagtagttcaatagttggaggttgctctcctacaatggaagaagaggtacttctcttgagctatatatattgttataattcaaattcgattttattcaactgaaacatagaagtaatagctagtctatattgatttgttccccttttcccaaacaattaaccaggtccaaaagaattggcgaacattgatggcccctctacttcatgtgaatttctcttcatcggatcatatatcaactcaagctgacccagtatattatgtgagtgtcatatactccttccgtccaaatataaaacatagttagaaatttgttccaaaataatgcaactcatatcttcttacctatcatcgatgaataaatcgataaatttctttcaatatcccatcaccgtacctactaatataactttcctattaatttggggcattttggttctttgtctcctttcttaactccaccataggaagctaaaatttgagtttttttggggagtatgttttttttccctagatctaaaagatgcacttgtactcatgatcatgattttcatgaccaaatacgtactttggcagtttgcagcatatggatcgattccttcagacgacgctatcaagtattacggattagaggccaccatggacatttatggctttaatctagagcatggacaacaaaccggaggtttcatttggatttacaatacggatgaagcatctgccgtgaataaagttatagctggatggaatgtaagttaaacttatctgcttgatttggaattgtaatttcaagcctacattagcttagctggttgatgctcaacaggttcatgagcttctcactgtcaatcgaagatgtgtcactaaacaagttactttgattaatcatttgctccatgtcttttagttttaacatttagttgtattgtacctcatacaggttgagcctgaatcgtacaatgattcacagacgcacttcagtacttggtttgtaagtttcttcataaacactgcagtttcctatccatcaatttttatttttattttttttgccataataaagattttgtatttattatgtcataactcattctccaattaatgccagattgaaggttctaatgtttgtcctgatatgcgttgtcctggattcgaaagtgtatttagctcagaaatcgttcctggaatggtgattagccctgtttccaccacctctggcaagaaacaatacattacagtcagagtatccaaggtttaattattgtctaattaataacagaacaatcttacattccttttttttatcccttcatatataaaatggaaatagtataatgaatctggacatacccatgtctagcacaacgaatctagatatacctatgtccggattcgttatactaggatatgtcacattccatgctggttgagatattttagcacggagggagtatgcgtcatgacactatattttgatgatttcaggatcaaaattccggtgattggcaaatctactatggctttaatggggatgccaagcttgcaggttactatccaagatctctgtttacaagcttgtcagataaaccagtgacaatattgtttggtggctatgccttgagaaaggatcaaaagccaagtcctccaatgggcagcgggaatgccccgtttaaaaacgccgcatcatttcgtagtatcaagttttttgatgccggtggcaacgcccatccaatcgattttcgtctcggatttatatcaaattgttacactatttctgttattgaaaatgatgggttcttttatgggggacctggcaatatttgctagtagtttgtaatcgagcttcaacttagtgtaatgaatatcctggggactgcacccacagagaaattgagcttcaatagagttcatcacaactgttgtgccactcttagttgataagtatttagcctcatcgtttgacgtattggaggaaaaaacgaaatggcatatttgcaaatgaaaaataatttgtgaataaaacttttatatacatgttcttaacgatctaagagtaaagactgaaaaataaactatggaatgaaaaaaaaaactcaaaatcagctccaaattccaaatttaagattaaaaaattaaattttggctgataagcataagtggaaagatcaagatacaagattctaatatactccctccatttcgaaaatataagcagataaggagaggaaagggaaaaagaaaaagaagccgaagaggaattacatatgcgtcatggttccttgcttttagtttcactttcacttttacccagggtatttacatactcactccgatttgataattcatgtcatatagacagcgacacattctccaaaacctatctttgaatataattttctattataatataaaaaccttaataagtactccctctattttatattataagttgtttaacttttttcttagtcaaacttcttagagtttgaccaagtttgtagaaaaatatactaatatttttaatataaaacaaatatattattaaaatatattcaatgttcaatttaatgaaactaatttggtgttatagatgttgctaatttttttataaatgtggtcaaacctaaagaactttaactaagaaaaattaaacgacttataatataaaacggagggagtatctaatttaatttgattttttaagtctcatctacacatgttgtcccagtgccttaaaattaatatttcaaaagttgctaattgtcaaagttataaaagtttgacatcacccttataaaagaatgataggaattataaaaacaaaaggagtatgtgacattatctttcggatactttcatcgtaagtgatccctcggagtggatactttcatcagaagtgatctctcaaaaagagagaagaggaggtgtacacttggcatggttgcataaggtaaaattcatatcttgccttttgcttggtcgagctagctagcccatgtcaagccagctcgtatcacaccgtagaaaattaaaccctactgtcacatagattatgagaaaatatatatagagagctatagaaatatagaatctagaaaataaataaaaaccatatttttttttatagattctcacaagctatttctcataatccatagtttcctaaacaataccaaaacatctaggtacttcaacgcgcaatatatatgcaaaggaaactactccttcgtgatgattaaaaaaaaatagggtcatcgaggccaatgtcatgggctcacggcgacattaggatggagtgccgccgcaaccttcttccggccctacgcaaggaggcaggtgccactgtcgccgtcgtccgccttaacctcgagaagcaatttcctccttctgcctctaccccgggaggctgccgtcatcatcgacttggatgccgggaggccaccatcaccatccacctcaacttcgtgaggcggtagccgtcgtctgcccccaggaggcacccaccactgcccccatctactaactccaaagagaacaccgccgtcggctgcttctagcatttcaggtgcctactactcctatgtatctttttagttcatatattggttacttaaggacagtggcggatccaagaagatataattagataaagctatagcttcccttcaaatgcatatatgataaaaaaaatttagtcgaggcttcgtagggctcccatggtcctattgcaagtactctatctggaatggtcggagccattgtattttttttgaacctggaacggtagcatgcatgacatgtgacttgtataagaacactagctatcaggtgctaatgaaatattttactctaaactttatgtcattcctatgcttgtgaatagcgacagacaatcaggtatgagatatgtgccattcacttggaaaaaaaatatatatgacattttacattcaaacatcaaacattatattgatcaaacaattaatatactagctgagctcgtttggccccttttcgaattactataatgtaaccatacattgctgatgagcatacctgtttttcatcgtaccgccaacaattacctgaattttgttcgatcggatagtaccagtaaattacttttactccatccatcaaatcagaaagatgacaaggaatctcatataggaagcgtacatgaacatatataagaccatgatcccaaataaaaataagccagggaaagaaatatttttatttgggatatttttacttatctttaaataaaaataagttggacatataaaaggttcaacgaaagaaatattgatttaaagataggtaaacatattcaatgtgcaacttatgtagaatctgaacattccaactaaatctagaagtacgacacagtcaaacgaacgaaagcttcacacaatacttagggtgtggtgtgtttgagagcagtggaaaggagaagattgagaagacaagtaaaacgagataagtcattagcatatgattagttgaatgttaattattttaaaccaaaaaatagattaatatgattttctaaagtaactttgctatagaatgttttttcaaataacacactattaaagttcaggaaatgtgcgcatgaaaaactacacaattttcttctttgttttggctaaagcagccatgcgtcaagcacggcgtggatgtggatcacaggatggtgggaataattaattatttcccattcttccaaatggtcataaaggatttgtcactatacccacatatcatagatacatgaggacccatatgttatagacaacaagtggcaaatccttaattaccatatttagaagtagcaaatagttaaatggcccattctcttttttttttcatctccttcgatacatggaatgtgcttgctattgagagaatctgtttaatgagaagacgaaccacatcgccactgagccgtaccagagtatggacgctgtttgcgaggcacatccacacatcggcgctaatctccacagcgtccatcctagtttcgtgaatctaatctatgatttacaatttatttaactaaacaattattaattaccgtatataaaaaaatcaggagaatatcacagttccaaaatggagcttaaacattggcatccttaatatccatgcttccttctgaatcattctctaaattcgtaaatgccaccaaacaagatatagggcctttcggctagcactacaagatgccagcacggttcgagcctcacttctgggtctgttcggtggcactggctgcagcagctgcgcagcagcatcagctacagtggctgcagcagccagccaacagctgttgtaccctgtagggcttgtaggggagtagttttttctgtaggggctacagcagtttctacagtcgaacagctgggctgtgcagcacagcccaaacagctgtgaaaatgggctaccgaacaagccctctctcactacgagagatcagaaggagcgtgtttaacgttcaaaaacacacaagatctttcccatgtgtgataatgtcttaacaaattctgatcgagagcccctcctcacatatcaagtgttttttttgcacactctatcagcacttaagtattagtttcctatgatcacctacttgtatttcatacttttaaatagactagaaaaaatgtctatgcgttgcaacgggtaaagactattttaatcttattattgttatatgttttagttaagataaaatctccttgggaacttatttggttatatatattttttaagaaaatcgtgagctgcaattaggagtccgatcgtctcaacttagcatgcaagttttttaaagagaattattgtacgattcctttatatttactaaagcaaacgaacttaaaacctacatatttctaaaagcgaacaaacttaaaaaccgactcatgcccggatgagtaccaaaataccagcaaaaacatcttcaatttttataataacagagattagacctatgcattagtttccagatcacctatatgcatttcacatctttaaatatatcagacggccaactaaagagactagctttctcaaatgcacggttctttatgaagatatacaaggaaaccctacatgtaatgtgatttgaggctagctttctccaatgaacggttctttatgaaggtatacaaggacttaaccctatatgtaatgtgatttgatttcaaattatttttgtttaatagatattcatcaacaaataggaagaacatcatacttcatgggcataccagtgattgacttactgaaatcactatcatgtcataaactcatccagatggcacacacactgaaaatgtgacccaaacttctccaagggttgaatattaccatcagcattaatattatagtgatataaattgttttccgcggtccgatttgtaccatgatgaaagacataccacacaaatttaataaatgattctaaaatacgatgatagctaacacacattagttgtgtttcaatctggccccgtcgtgctaatttttttgtcgtgtttcaatctggccctgtcgtgctaactttttttgtcgtagcttctcctcttcctcctctaataataatttactaaacttttaaaaccgtaacgtatttaacatactaggacttaattaaagtaagtagagagataaagtaagaaactaacaaagtataagtagagggatcaaagtaggacattgagaaacaagttagaactcgagtatttgtagacttaactacttgaggttaaaatataatgttttcattttgttatcagcttgttatactgtatatattaatctaacattgattgtgcagtgcacaaataaaatctccctcaactgttaaatgggggctaatttatcttccttgatggttgtttagattaaattttcgatacattgatttggttatcattttatatggtggccacatagcgtttacatattattaccgtaagttaaaagatatccatgtagttattttaattaatctaaaagtagaccataccgctttcaaaagtgtttcttctcattaaaaaacttaaaaaaaacaaaagaatcaacagtgcattaatcctcttcccccttaaaaaaattattcatgcctcttaaaaactatgtcctaaaatatatctctaaaaaatataaaaacctaatacatcataaaaaatcattttagaaataaactaaatcatatttttatatctagatcccattgtaatgcatagccatttaactattaaattgtgaaccgcaacacacttgaatagtatacatagtgcactatgatcattggattcataacaattgttaatctctaatttatccataaaaaatatcattttatatcgttcaacattattaatctttatagcattctaaattatgtttagcaaaaatatgtttccagttgttaaaaaactagtcaaataccttatataaataaaatatcattaacaaagataatattgattatttattgatgtagaaacatagataatatatattacagagcgcacacacacatgagcagctgctagaaactcccccaaacagaccctttcgtatgagccctcaccggcggatcctgatccccttcatgcttccttaatggccccacctcctatacttccccctccccttctttggctcgcctccatctgcaacatcgggctcctccgcctcggtctctgcctagcggcgcagggggctcgccctcaaccagtcgctcgaccacaccgctgtggcaagcctggaagcagcagagggaggcgggtcttcgttgataacatggtaaggaggaggtggaggtggatgtggatggaaggagtaggggggaggaagcttgacatgcaaaccctacattttttttacttgcaattggcatgttaactctacaacttttcttttattttttagagaattgctacgtaagccccatgtgtggaccaattactcacgataaaggcatgcaagcaccatataggacaaagcaccatcaaaactattgaaggaaacaaaatgaaccggttttattacttgaggaagtcacactatctataattggggatgcaaacttcggccaatagttttgggaggtaaaatatatttctttcattgatttttttcagccaattcggttaaaggcacccttattttatttattttctttttgttgtttttgcaaatctccttgtttttattttaattatggaaacatatatattacacctcaactatcttgtttatctataactagggatgaaaacggatcggatacggacggaaactagctttatcatattcgttttcatattttttttcggaatcggaatcggaatcgaaaactcggatacggaaatgaaatcgaatattatcgaatacagatacagagcgaatacgagacggaacgaatacggtagcggatatttaccggtatataaaaaacccctcaaattgagtttcttgatcaaggaagagatatcgcttattattttagttcaacatctccaacatttgtatcgtcaattttatagacggtcccacaaccctatgtgagaatcgattttcatggctattcctcttagagatccatatgcaaatatgattatcattttctattcccaagaccttttactagatgtataacttacttaccattgtataaattggagatgttatttattttactttacatcttcaaaacttgtaatgtttgttttatactttaaatgctttcaaatacaaatgttataaactacaaagtggtagatcccgttgagctctataactttgatatggaacacatctccatcagatgtcgtttgaattgtagatatgagattttataaaaattaatatggtatattataatgaatatttagactcattaaatgacctcaaataataaaatagtcaataagaaaattgtaggtctcatcaagctctacaatgttgatataaagtttgtctccatctgattccgtatgaaaaagttatgtatatatacatgttttttctaaactttgctcaatgtctgcggatatccgaaaaaaaatccggatagtttccgaccgttttccgattccgacggatagtacccttactgtattcgttttcgtttccgagaaaaaaaaatccgaattcgtttccgaatccgagaatttccggatagttccgaccgaaactatccgaatccgaaaaatggtccggacggatggaaactatccgaaccactttcacccctatctataacaactttcaactcccatactatatattatttaacttgctatcactactttaaaaataatttttcatggcggccaaaataggttttcataagtagccagtggaaccgccagagaccaaaggccaatgataatacaatattttcattggtgttcgccaaccgccaacgccgatccattttcattggtggttttcgtaaggtagccacctacgaaaataaatttgcacaggcggctatattatatcgtccgcctgcgataatctagccagcactaaaaaaatgacggagcgacgtcgctccgtctgcctccattagcgccaagaatcccaaaatccgcagaaattattcccaaatcctcattccctaatttccatcacagttaacaaatccacaaatcatcacaatttatagtcatgaatttccattcacatgttttcaactgtatcaattcccatctccaaataaactaaccagataggatcgtcaattcatcatcgctcccggtcatcgtcgctgtcgctgagagacgaataccaaacactagttgagcaccgccaccgcacaacggatctgggagaggggagggggttggaggagccgcctggaaccttctcgaggaccagccgtcatcatcgttgccgtggcaaccatcgtcatcgtcgtggcagccgtcgtcggatccaccttccggccacgggtccgccgccaacgcccctccctgccgccggatccacctcctccaccgcaaccacccctctcctttgcctcctgcaggccgaatctgtcatcctccccgccgcccgcagcccaaccctccccgcaccgccgcagctccccttgccgccgccaccacccacgattgagggagagttgggaggggaagggagaggagaggtggtcggtgtatctcggaggtagggagaggtgggagagatgcggcggagaggaaatggacgacttggacgtagtctccacgtgatttatgcctcccacaatttttttatggtgatcgctcatagaccccgccagtaaaatcgatttttactagcggggtgctcataagacatttttattagcggggctaggtttttagtatctcctgtgatttttacaagtgaggttttttagatccattagtaaaaataaaacccttgtatcacgaaaataaatcgttttttaagtagtgtatgtatagctagctaattaaggagtcactttcctcgcttcttgctagctggggaccggtctgccattttctctggtcagtttttagatttttatttggcatttttaggagttttgcgtgaggtagattagggtttatcgtttaatattcttatggaggtagatttgtttagaatcttttgtctctcttacctatttgtcgattgccactacatttacgaggtcctcaatgaagatccatccatgaaagtttgtttgttggttgccgatgatccaattgacagaacagggtttaaggcctagaccatcaatttgtttggtgatgctgtcttataggtttgtcaaatgatcgaatatgggggtagatacttgttcaaatactcttccattcttctttatatatatcacgtcagttagttcatatatttagggatggaggtaatatcttttacgcatacccgaagtctcggtgaattgatgcgttatgtctgaacacgtctagctactcatgacttttacttgacttttactaggatgttactagggccctatttagatcccaccccaaaattttacgccctgtcacatcgaacgtttaaacacttgtataaagtattaaatataggcttaaaaaagttgcacatattacgactaatttgcgagacgaatcttttgagcctaattgcttcataatttgacaatgtggtgctacagcaaacatttgctaatgacggattaattaggcttaataaattcatctcgtggtttactgacggattctgtaattagttttttttactagtgcccgaacaccccatacaacaccctatataatatctgatgtgacacgccaaaactttacatcgctggatctaaaaccccctagatacggatcatctttgtgctggcaagtactttttttttcttataacaaagggcttgtttagttggtgaaatgaaaatttttggatgttacatcggacgtttgaccagatatcggaatggggttttggtcaagaatgaaaaaactaatttcataactcgtctagaaaccgcatgacgaattttttgagcctaattaaaccgtcattagcacatgtgggttactgagattcgtctcgcgatttacatgcaaagtgtgtaattagtttttctttttatctatatttaatgctctatacatgtgtccaaatatttgatgtgatgtttttgcgaaaagtttttgggggaactaaacagggtggagtttattttttttcactacatttggtggagttttttttttccgttataacaaatttgttcaaactagtgcggttttcaactatttggcacattttatttgacgctgatgggagtcgagagtcagcaaacaaaatgaaattaaaaaaaaaatccgtgtcctatctcatactcctacctttcttctagacttgatcaccgcatgctagccaactcaactacatacaagtcgactaccaagtcacccggtatttgaaacgtattccaagtagttgtgtatagtacgcatcgtgaaccttttagataaacccctaatgaaattggagtgccaagtgccaactttctgaccatcacgaggtgtacttaataaccataaaatttctccagttcttttcttgcaaaaataatcacctcctttttcatattttacttggcgcgcgcggggtatcatattctctggttaaataggactccctccgtttctaaatatttgacaccgttgactttttagcacttatttgaccattcgtcttattcaaaaacttttgcgaaatatgcaaaactatgtgtatacatataagtatatttaaccataaattaaatgataggaaaataattaataattacttaaatttttttaaataagacgaccggtcaaacatattttaaaaagccaacagcgttaaatatttagaaatggagggagtagaaaatttcgcgcgcgagtatttaaccctgaacgtctggcgccgcgccgccagccaccgttgacgacacaccgacgccggcctttgctctgcagccaatcttcgcaccttcttggtctcttcgtcgtcatcgccgccggaggaaggcgagcagcagcgtcgtcgccccgacgaggccaacgtacagggtcgcggtttcttggcttttcttttttaaaacttacttttgaataacggggtttcgatcttggtttgattttgagcgctgatttggggctctacaactagacccatagatcttcacaggccgacccaatttttggctgtgattacctgtctgcatagttgtgtgaggaggggtccggtttccgaccacatgcgagactgcaaagatccattttcgcggacgaacaacttaaaagggtcgtctgcgataatgtttttaattttgtaggcgaaccttaagccgtccacttgtaaaaaaactaatttttataggtgaaccgctaggagtgccacctgccaaaatcgccgatggaacaactccctaaaaaaatctatgtcgtccccgtgtaattcttatcccaatataataactctatcgactaccccaaccttagatatcctctccctctcaaagtgcgcagcggcggctcagtgctgagaggaggagcagcggcagtgaggtaggggtgccagcggcaggagctcggctcctccctcccctcttcttctcctccccgcttctcccctccaatcctggcaacagcggtggctcggtgatgagaggaggagcggcggcagcgatgacgatggcgaacgccactcttcccccactcccagcaacggtggccggtgggtgctactttcttggcctctctcctgtctctacctctccctttctctctcgatctctccagtctctactctgccactgaagcgcagcagccagcggggcgtgggagtagagcagctggctgggcacgggatccgccgtcgccgcgaaggagttgggggtggcgcggtggagggcaaccacgatgacggacgaccaaatccagcaaagacaggaggtggtggatccggccgtggcggatccagtggtggctgtggcatccgtgatgacgatgatgaccttgacggcgatggcatccatgaccacaacctgcttgctgcgacgatggctggcggcggtgggcgaccttggcccgggtggatccagcaggctttggacggttgtgatcaagttgtggcggatctggctagggtttcgattttaggaatttttattttttttaacaaatttttcttttcacagtcaccctattttcgcatgtggttgctacctgcatgtaaaaatttgattttcgcagacatctgagtgtaggcagtgctactacaaaacacctgataggttacggctcataggtgccggtttagaaatatggtacctattacagtttcccacctctatcagacaaaaatccaagataaaaaccgacatatagtatatgtgttggtttttttatactataattgccagttctagataaaaaataatacctatactataattgccagttctcgcttgcgggacgagagattgttttagccaccttcccactcctgccattatccattcgcccgttctctctctcgcctacgccttcctctctttttcttctctcacctgtgccgtttcctctcctttagctctctgtcttcttttcgtctctccccagcttttcctctccaccggagcctctccctggcggctcgccttgccacggccgacgcccagtagctagcggccagcggattcatcggcgacggcaagggcggtggtacggatgccagatccggcaggcttgagcttgagggcctctggatctgccccccccctccccgtgcggcgccctctagtagatccgtggtggcgatggcggtgggctgtagcattccctcaacgtcgtcaagtgcacgggcgacgatttttgctgatttgtggatgtttttgtcgttgattttgtgtatgttcacgattttgtgatgacaatcgatcagtgtggcgatctaattttgatttggggatttggggcaacgggtagcaactcgatgcatcgacttgaatcgagccgatttttttttttttgcctagcgagcgcctcgaaggtgctggttgcgaaaccaacaccaatggctcggagtcatctgtgccgcgtctgttgtgtcggtgcccccatgtgtttttccaaccggcaccgatgacactttctgtagtagggcaggttatccacccgcctgcgaaaatcgattttgaccgcatggaaaaaatcgattccatagtagtgaactatactattagatatggtgcatctttgtgctggcaaggttgtttttcttatagcaaagctgtaatcttttccgatcctaagtataataattcactcttttatgtatttggcacctttcatccatttgacgctgatgggagtcaaagacagcaaacgaaataaataaaagctgagccctaccctaccttctcttcttcctctcggttccggcttcataatcatactcctcttcctctctctagccggctgcgtggcggtgggtaattcctattgagtattcgtgggtgggtttagtctctcttgtatgctatagcctacttctctattttaaaaaagggataattacattcttgcacctactttaaaaagcaattgtgttgaatctatcatgaaaagacatatatgcccatgcaaatttatcttacttatctgaaaactttgtggttttggccatgttttggtatcaagctttttggtagcattttgacaacaagggtttatatgatttgcatgaattctgaaatgcgaactttgagtattggcttccaatgagccaataaatctcccaatcacaattggtgatgcatttttttccaaatttcactagtactcctaattaaaaagaatatatcagatatactaaggctgtgttcgggaggaggggttgggaacccctcctctccggcacgcaaaacgaagctagtattattgcatgattaattaagtattaactaattttttttgaaatacggattaatatgattttttttaaaaacaactttcatatagaaagtttttgcataaattacaccgtttagtagtttgaaaagtgcgtgcgcagaaaacgagagagggggttgggaaaatgggggaaagaacacaacctaagcaatggttggtaactgtctaacaacaccagtactccctctgtcctataaaaaacgtttatgtccagattcattttattggaaaacgtcacatcatgtcctaggttagcactcaaagtttatcccgttcccattttaacacttctatcaattctcatatcattttccgtccgctttgattgctattgactcaaacacgcacacgatataacatttctacccctcattgccatgcattctacgagtactttttaaggttgattccataaaaattgttttctttttgggaggaagtactaaagtacggaaccatgatcgagtaccaactaccaagtcactgagtatttgaaaggtattccaagttgtatcgtcaggaatctcttgaacaaacccctattgaaatccgaggcctaacaactctctcacgatcacgaggccaggcccataaaatctgcacggttcaattcgtttccttaaaaaaatcacctcctttttcgtattttcttctgactcaagtcaacagtagaaaactcttggcgcgcgaatatactacataattaacctcagacgtccgcctcgcaacgacaccttttcgccctgcagatgagatcgctcttcgtgtctcggtcctcgatcgcccaatcgaatccgctgcaacttcaagcagccactgcccactgatccactcgagcggatcatatcgtccggagctctagctagcctcattattgccgccgtcgaagtggctgaggcaaagagccaccgccgccggctgccggagcggctcgccggagaggaggaaggcgatcgagcgaggagagactgcagcagcagcgtcgacgactaaacgaggccaacacggacagggtgggtttcgtttcttggccttttatttttcttttattttttttggttttcaagatataatggggtttttcttggcttgatttgaggtggtcgccgttcttgagctgatttgtcaggatttttgactggtttgggaattgggatgtagggattcgagattttgtggttttcttaggagggtagtgcggctctgcccccttcctttggggtcttcttgggagggtagtgtagctctgcccctttcccgctgactggagttgcgtttggccgttgaagtagtctctttgtttttctgctttctttttgtttgtgtttttttcttccttcccatggcataagccggtttggctaattgcttgtataaacaaactcttatttcttttaatatattgacgtgcaattctttggcgcgttcgtgaaaaaaaaagattttgtggttttgtggacaaagtttggatctttgtttctttcgtaatatttgttgctgcctcagattacccctttgttgataattggatttcatttaacttgttgtttctccatcctaaaatatagtaaaacacaaccatcactaacacgatagaccaaataaaatttattgtgacccccttcccccctcctccccaacccaaaatcaccctaacaaatataatgcatgcatcaatgggttagaaatcacgagtgtaagagacacggtatctaggtacccaatgttatgcctttgggccatgttacacaagatgggccaggtggcctaaagcccatgcagtgtggtggatcaaaggtaaggtgtaaatcttattccatgtaaataggatttttagaaaacaaatttagaaaagggagaggtggttgttaattgcatatatgcatctgcgccttgtattttgaaacatgaaacaaagtagtgttctgtattttgtaattgaagatttccaaagatcatttcagcagtagtaatgcatgattttcaaaacttcttttcttcccggactgccatgtcaacaccgtcaaaaccacgtttacagatgcgacgttcgggtatttataacaatttttaataatagcacactaatagagttactcgctctgtccacaaataagtggtcctaatacaagatgtaacatattccagtaatacaaatttagacagactgtctagatttgtagtactaagatatgtcacatcatataataggtgtatttattttggaacggagaaatcaccaactaccagtagtaaaatttgctgacatacgagagggataggtgaggagagagaaatatcaatgttaagcttaatatcatcttttagcccatgataaaagtaagttttatagcatgaaggtgggaaaaaggaaggatggataatataagaaaaatatttaagcgactattgtctcaaccattataaggtacacccttcgtttcatatttgttttgactttttcttagtcaaactttttttaagtttgattaagtttgtaagaaaatatagtaacatcttcaacacaaaataaatatatttaatgttaaatgtagcaaaactaatttggtattgtggatgttactaaattttttacacacttagttaaacctaaataaatttgactaaaaaaagccaaacgatttatggatgatgtgtattgtctcaaagcctcgtggaggctcaaagtattgtgcatgcctttatcaaggcgatatatatttagaaatttttttcgtcaaattttgtttaaattccactgggttcgtctatgactgctcgattatatattacagttatctagaaaaccgtcagggccggagaggttttcgataacaaattacattcttaaaccataaacaaattcaccttaattcgtttgaacctaaggataaattggaacggttttagaaatggaagggtggataatgtccagtagaacagttgagggattctttttctacaagcgtgcggatagtttaggcataatatggatctgttcatttaattttctaattggactatgtttggcagcggcacaaggaaaaaaactcactcgttttcttcaatatgtatttttgcaaaatcttcggtgacatgaggaagggggagaataggggaaagagagaggaggctgacgtggccacgctgacatatggggttcacgtgggtcccacgctgacttagccaccacgtaggataaaatcggggtcaaaaccactgaataggggtgaaaacggtacggaaactttccggattgcatacttattttcgaaaacggaatctgtcggtcggaattttttcggaatttttcggaaacggaaacaaattcggaaatattttctcggaaacagaatcggaaatgataagggcggtttccgtcggaactcggaatcggtcggaaactttccgaaaattttctcgaaattttcaaatattttctcggaattaccagaaattttgtgactaaaataccctggattctttttttaagcactaaatagtgaataccatggtgtttggctggtattttttaaaaaaatatttgttatgcaaatctaaaattacataagaatattttttcctacattgggattattcaacaacattactcttttaaacatagataatttattcaattggatttatcagtttgaggggtcttttattccgataaattttcgttaccgtattcgcgccggtttgttttc

SEQ ID NO: 13842 - DNA, 8958 bp, Oryza sativa
cttattcccctgggggctaaggcaagatggagtaaacaaatgcttggccacatcttagcgaacattagcaaggtggtgtcacaatgtaaattcttattgaaattgcatatgtgtagtgcagccagtgcttctccgactgttttctttcttgaacatgcataaagctaaaacaactttatctcacaaaaaaagtgctaatctatataactaattgtatacaacaggtggcttggtgtcaataatatttatgcgatgaagaatttggtggaactatattatgagagggaaatccagctgtttgtcctcgtcagcttcgcactccaagtgttcctctttttcactggcagccttcggcggcgcagcaccaacatattcctcagtgtttctatttggacagcttatttaggagcagattgggtagcagtttatgctcttggcaacctctcaggagtacaggagagcatcatatcaaggagaagtcagctgccactgtcttttttttgggcaccgtttttcctcatccatctcggtggtcaggacacaatcactgcttttgccatggaggacaatgacttgtggctgaggcatttcttgaatttggtcgtgcaagtagtcctcgccgtgtacgttttctggaagtcagctagaaggcagagtgcggagcttatagtttcgggtgtgttcgtgttcatcgttggagttatcaagtatggagaaaggacatggtcactcaagtgtgggagctcaaaaagccttgagagctcacctgggcatcactacaagcaacggtttccggaactaagagactctgattgcgactatcgaaatatggtttccaatgctctatgttcaatgttcaatgtcctcaatgtctttgcagcgcgcaacttgttcggttatagcttcccaagtgttggtccagatgatactcaagtcgacgccaaaaaaatgttcaagttggtggagcttgagctcgccatgatgtacgatgacctctacacaaaggctcttgtgctgagaacaaggacaggcattatactccgatgcatctctcacgcatgctccttcgtggcttttgcactcttccttgcgagtgataaagatcggtacattggagttgatattgcaattacgtattcactgtttatcggaggctttttcctagatttttgtgcgatgtttattgtcataacatctccatggacttgggtctggttgaaggctgcacagaagagagactggctagccaacttgtcctggttcctcttttccagtgatattgggtggcccgagagaaggccactgtggtctagttccattggacagtacagcttactcagctgggactctggatcagaccaaccaacaagatcatgcaaccagaaagtgatggctctggtgagaagatcggcgaggttagtcggcgttggaaagaaaaaattgttttggatgagcaagctgctggacactaagttcctagaggtagatgagaagacgatggagtttgtggtggaggggatcaatcgcatccgcgacgaattctccgatgtcgcgtcccgggcatggccaaagcttggcccattcctcgaaaccataagagttcatttcaccgcggactttggtgctgccattgtcgtgattcactcattcacagaggagtacctgatgaatgctgctgctgcagcagaagaagaagaagaagaagcaggtcagggaggagaagcaaatgatatgatggaggtgtgccggaagctgtccaactacatgatgtacctcttggtgaaccacccttccatgctgccgctcaacgtcagctccgaggctacgctggctgaggctgcgcagctgatgaaggtggtgagagggcgagcactggaggagatggtggatccatgcgacgaaacgttgagggagatggtggacatgtggacgaggctcctcatctacaccgccggcaagtcccgggggccgatgcacgcggcggagctggcctgtggaggggagctcatcaccttcgtctggctgctcatggtcaaggccggcctcggggattccgaggcgaaaaggatcctcattgcaaattctgcttgcgccgacactaatacgaaggaagcctatgccttttatttcgcttcgtgacgtgtatctatgtaataaccatgagccgccggtcagaccgaccaaacacctacggtgtcagaccggctccgtgaaggaataacagttatttccaaattttagtaatgtttttctattttgaatatgatatatgtgttgaatttggatgttaacaccgtcattcctgtattcaaatctttggattcacaaatgtacattattcctgatttaattgaggcatgtagcttggcagtgaatgcccatgatgggcttgcaaaggcatctgccatttgtccagagatatagcacgatctaataactgactccctggacaagcttcccttgagatgtgcttctatgctctcccactaaaaaaaaagcatggatttcaaagaagacgagaggctaagattagaaggtgcttaaccgtctgaaaatcaattagaaagggtactttcgtccatggagagaattaatctcgcatctgatgttggctccttcggcgccggaggccaatacgctactacagctactcgatcattgcccagatcatgaatgcagaacagaagataactggaagaaaaattaacaacgaataggatcatcgatggtatagcttgatggagcattcaacctgatatatccatctcacagttcctactcttcgtctgaatgcggttgcacacttgcactggatggccatgaaagaaaaaggttctctaggacagccaattgacgcaaccccctaaaaagacgctccacgtcgcccacgcgcaggcagctcgtggcgaaccctagctgccagccgccccctcccctcctcatctcttcgtctcgccaccgcattggagtgcgccgctgggagaatcgggcggcaagcgaggatgacagtggcggggctaaacctcggtgacattccgcctccggcgtgggggaggaggcgcggagcttggaagctagaggacgacgacggcttatctggcgtgaggcagcggattcggcaccgccccaaccggatccggtccccacatagccagattcaacgtccctacttggatctggccggggagcaaccgaagtgggtggtggcgtgcggggacaatctgcggcgagaggttgtggacgacgtggtgaggctggaggccatggacagcacggcgggaggcagtggtcggtgcggcgaaaccggtggtgtcaacaacaacaggacgatgtgggcggtgccgatggtaacaagaggctggcacggtggcaccagcggctgcagggaagcagtgaaggagcgacagagctggcggctgcgcggggatggagccaacggcagtgggaagctggcacgagtggccagtagtggaggtgtcggcgacgctgggacaagagcggccagcaagcacgacatggaggctcgcacctgatgagtgcggcgtagaggcgacggggctagtaggagcggtgtggtggagaggccgcctgggcagcaaagacggcagcgatgtgaccaggtagctcgttgtggacgacacaggcaaccgggccaaggcagcgatgatgttagtgccatgaggtcggcgttgatgactgcagttagttcctctccaagcgtttgcccccttgcagatggccacgttgggtgggctagtgcgggggagaggggatccatccttctctctcaccctctctctctccaacctgtccacgtggatggatctggagtgcgtcggaggctgagatcctgctttgatggctagccgacagcgaggtgttggtgcagtggctgcgtgttgaagggatttggctggtggtggctgctgaacctaataggcactcaatgacgcgggagtgttgtccaatcccatcttttttttcatctctttttttttgggtttgtgtggaggttaccccttgtattgcatgaggggtggctcaccttctcttttctcacttatttcttctacctcatcattcaattctatatatgtgacattttcaggtgcaacacatcaagtattatagtacttgccctaacacgtaggtgctttgctaccatcctcactcctcatatgcctccctagggtgtgtttggtagtacaggtttccaaccgggaacaatacgcgcgaaaaatggagcagtccattagcgcgtggttaattaagtattagctaattttttttccaaaaatggattaatttattttataaacaactttcgtgtagaaactttttttaagaaaacaccgtttagtagtttgaaaagcgtgcgcgtggaaaacgagagagatgagttgggaaaaggaggtgccgaacacacccctagggggtccctccctgtgtgagcagccatcgacgcgacaaatgcctccatccattgtgtgaacaggccacgtgatgccacctcttcttcccagctctcaaagctataggggttctatctcacatgacctctcctctccatatcatggccttagggtgtgttcagttcgtgaaaagaaaattttttggtgtcacatcggatgtttgaccgggtgtcagaaggggtttttggatacgaatggaaaaactaatttcataactcggctagaaaccgcgagacgaaacttttgagcctaattaagccatcattagcatatgtgggttactataacatttatggctaatcatggactaagtaggctttaaagattcgtctcgcgatttccatgcaaactgtacagttagttttgtttttatctatatttaatgctccatcatgtgttcaaagattcgatgtgatgtttttgggaaagaaaatttgggaactaaactagtcgagtggatctggtggaatttgaccattggtagcttctcgtccttccggtagtagtgtaaaatagcaaaggggttctcgctggttagcctacttatccaccatcttcgttctcctccctttcatttcattctaggacttcgtccttgcgatattcattctcctgttttcctttagtttgcctataatacttgtgtagttatggatattgtgcatatcacaagttgcgataaattttgagggttcaatgaaattgagggtaaagcctgtacaatatatccatgttcctaattttgatacatgagcatgccatctttcatttttttaatataaactagccacatgtcttattcacgtgtttaaggattggcattgaataatattttttctctttttttacattgattagctatagttgccacacgatttaatgcccctcgaaagtacctctactttcttatagagacattttataaaatgcatcttcacttctagagataattcaccaaaaggtattttgaaaaatgcctccattgcattgtagaggcattttaaaaatgtttctatagtattaaaaagatgtctctacagtgcatttttgttgtagtgtttgctggatcgataaacaagcaattcgtgtggatcaaatagcagtgcccaattccatttaaatttttatgattgttgttttataggtgcctttctagtgaaccgaggttaatagttggtcagccatatattcttgatgtcatgttattacagcacagcagatacctgtaaacttttcattgtgatattttgcatatgaaatttacaataaatatccttgtaacttgtgaatttcacagagataatatatggctggaattctgattgtttgctaatgaaaattttttgacataaatgtagaaggtccctttattttttgccaaaaataaataaattgtttgcagatgtgatttgggtggaacaaatagataatttggtggagtgcacatacaacttgacaattcttacatgccaatctattgcagcaacctttcccgtctagattatattatgtgtagttttgacctcattaatttggcggtaaagttcatttttcatcctgaactataaaactcaaatgcttttcagtggttgtgtttgaaatggatgtggttttcctattttatactcttactgtgcatatttttatgcaaatatcacttacttagatccagagtcgtgaaacatacctgattgaagttcatactatatcaaattgatcaaaaccaccatgaattatgaaatagggagtagaggtgaaaaataattggtttcgtagtttagggtggaaaatagattccaagcaaagttaagggcaaaaaatagagtttacacttaatttggtttccatgtcctgttcttttgatggactggcctcatctttccgagaaatcaactcaaccacttaccaaatggtactgattttgtaaaggttactgaattgttagttgcactgaaattgttgtaagttttgttgatgttttcttaaacatgcatttcatcaaggataggaattacctgatgagtacttagtattgtaaccatatcgataagtagaattaactacagaaggaatagttgaacagaaatctctgaatttagatttacaaaatcgctacggtgctatgttacatttgtaatatctacaaatgttttcccaaaaaatgggagaagatagattgttagttattaatatgacagtgtaactcaatttagtataattattatggtatggcctgtgattgatgttttgttttcaagctttggttctatgcaaattttaatgttacggggtatgcttatgtgtcgcaaatgtagacttttatgttcaataaaactagtcatcttgttatgttagcttttttgtgttattgattttgatttaagttgcacatataaacaagcaccactgtcttttttttttacaaagttacagggtgttcatggtctatttgttgcccactggaatgttttcttaaaagagagaattcttagagacttcttgaatcatatcacttcaactgcaatatgatattccagcttcgattagtataaatgacaatcttgttcaacttcttacaactgtatatatggcgaagtattacacagatacggttacagtcaagagaaaaggaaggagaaaatctgggatatatataggggctggcagctatagaaagcccaaatcatatcagccatgcattatctcttatcacaggaagattgctggttattaatcctaactctacttcatacatagctttagattataaagatgtagggaacaacaaacaaagctactcaaatcagctaaagtactaatcaaactttcaaactttaatcagttgaaaaagaacgcatatgcttccttcaaatcagctgcagcaccagcagaatcagcagacgaaatggacgatatggtggacgtcagccggacccttctcctctcggattcgccgagcccttcccgggccatgagcagccaggcgaaggtgatgagctcccctccgctggccagctccgccgcgtgcaccttaccattggacctgccggcggcgaagatgaggaaccgcagccacattgctgccatctcctccactgcaccccagcttggttggacatcctcttctagtatcatcttgtacatttcctccattgttccttgccttgacacaccatccttattctgctgtataatgttgtatagctcatccagggtcatcttgcttccttgttgtgtcctagacagttcctctctcgatttcgcaaactcaaccacggtggcttcggagctggcattgagcggaagcatggaagggtggttgacaaagaggtacatcatgtagttggacagttttcggcacacctccaccatatcatctgcatctccccctccttcgtctcccgctgccgcggcttctactgcattcaaatatacttgagtgaatatgtgcatcaccacaatagcacatcccatatctgcgacaaaacagacccgtatctttttcagcaatgggccaagatgctgccattgttgttgctcggagacttcatcgctcaagctactaatcccctttacgacaaactccatcgtcttttcatcggcctccacatgctcagtgtccaacgtcttgctcagccagaacaaatcttcttttccaacaccgactaaactcgacaatcttctcactagagccaccactttctggttgtatgatcttggctggtctccaccagaaacccagttcagcaagttgtactgtccgatggaattcgaccaccgtggccttttctctggccagccaatatcactggaaaaaaggaaccaggacaagctagccagccggtcgcatttctgagccttcaaccacgcccaagtccatggagacattatgaagataaacactgcagaaagatcaaggaaaaagcctccgataaacagcgaataggtgatcgcaacatcaactccgttgtacctccgtttgtcacatgtaaggaacagtgcaaaagcaaggagggaacatgcgtgagaggtgcatcggagaatcatgcctatccttgttctcagcacaagagcctttgtgtagaggtcatcgtacatgattgcaagctcaagctccaccaccttgagcatttttttggttccctgtaccgtgtctcgagcaataacaactggggaattagattctggaccattaacaaatgggttacgcgctgcaaagacattgtggacatttagcattgaacatagagcatccaaaactaccttagaatagccatgatccgaatcgtttaattccggaaaccgtttcttgtagtgatctccagttgagctctcgagacttttaaaccttccatacttgagagacagtgtcctttctccatacttggtaactccggcaatgaacacaaggacacctgaaactagaagctctgcactgtgccttgctggcgatttccagaaaacatatgcagctaggactacttgc

SEQ ID NO: 13843 - DNA, 13676 bp, Oryza sativa
agaaagctagtggctgggttccccatgacatttgcctctgaatatcatcgtgtcgtgagaggtaaccaagagcataaactgctgtgaagtctgctcccaaataagctgtccagatagaaaccctgaggaacacattggtgttgcgcctccgaagactgccggtgaaaaagaggaacatttggagtgtgaagctgaggagcacaagcagctggatttcccgctgatgataaagtttcataaaatccttcattattataaatttaagagcacctgtgttggatattccagtaatcatttagtacaagttttaaaaagaagattacattttcgacgtactacaacccagaaacgtaaagaaaaagaagtcagagtaaattctttaaaattctaggtatatattatgatctaaattgcataaatccagaagttttggcacgtggcatataacactggatatattatagtcctacagtttcatataaccgcactgtttattaattttacttgctactattgtgtcaaaacaaaaacaaaaaaaaaatgcttaacttaatggctatcaaactttttatacaatagatcaaataattcttcatatatttcagaattaatttagaacccacaaatatggtcaatcaaataacaatttattaacagcatgattttatgaaactataaaaccatagcaccaagaataatcatatgctccgtgctaaaattccatttttttttgcaaacagcaacaaatcgattcacaatattaaagctcgatgcatgtatgtacaacaagaaaatagtaaataccccggttgtttgtgacagtttttgcccagtgtaattaattagttatacctataatatatcctatctacaattccctccgtttcgttccgttccacgatataagacgttttttatctaaatatactagcatacatatgaatttatacacatctataaacatatatatggatccatatatgaatctataaaatcccaaaacgtcctataatgtgaaaaagagaaaaatacatctatttaaaaatatagcaatcgaaagagatacaacctaatactacgaatctgaacagatatattggtaccatgattgtattcccatctaatcctagatttactatattttgcaactaagagaatactattctaaactcatttctctctctctcctatgtcggccggctttgctgccatggaaaggaaggaggagaccgacctctgcacgaccggcgtctcccgccaggaaccccagccaccggacgacggatcagccgtacgtcgccgtgtccaggaggtagcagatcgagtggaggagggacacgggaggaaggatcggatcgagtggacgacagagagacttgttgttgacgaggaagtgatcagatcgtcagggacgaggaaaactctgtgaaagaccgtagctaggctttgccgattttttctcaagtcaattctactatggagtttggaccacatgacactcacagcctagctaccacggaaaccccaaaatcctactcactccctaggatttttttttaaagaaacatggtagtacacttgtccctataaacacacgtacactttattcatatttataacaattaatgtattgaagttggttgatacgaagaagagaacgcggaaaaattaaataaaagatagttgtgattgattgagataatagtatagatactagagagtctatatttttacaataaaatttaaaagtatggagagtatcaagcatatatcacaagtactagatggagagcggtaagaggccagccggttgcttccctggccacgtgatataatgatataacgtacggtaaccttttcagtttttggaaaccacggtaatcctcacgataacagcatggttcacgataaccacacagtttctgcacatgataaccaccttactgtgggttaaaggtaatctcaccaagacggtttggcgaatcctgatactcaccaggaaattctattgtgtagtgtcatccaattgtgcaaccatggtgatagtataggtggtttcaaagtgaggttgtttttttaataaagatgcagtacccaccatgagttggtacggttattaatcattggctgtattagttttgcttttcatagggctgcatatgactagatactttaaaaaaagtacaatggcactccaaatactatagcgataagcattccacgttggattgcatgctgagctgaaaagagattagtgaagagagaaggcaaacaagtgactaagggtatgtttagcagagcttcaacttcgaagtttatcttcaagagctcgatttgaagtgaagttgtagagcagtttaaaccgagcttcaccttcttaatttattttatgagagcattctagtcagtttcactctagctccctttttaggtggagttgaaactgtttggttgggccttagctccagaagacatgtagttggagctagagctctgccaaacataccctaaatagtcgctcgctccatgcgcactccaagagcgttgtatagtagctttcctatcgcttgctcgtagccgatgccgacaacacccccatgtggtaatgtggggccgtataattagcgacatccaacgccagggagatcatggagaaacagcagcgcggccacctccagggactacgagggggaataggcaccagagaaagacggtggcgcgatatagagcgacggcgacatgtcagttaccatgacgacaagaaaaagaacagaaaggagttgatatagaaaaaataactagtgaaaaaaaggtagggaaatttctgaccataccgatattgttttcataaagaaaagtaagatattgtttttagctttatgtaaaatttggtttttttaatttatgtatgaattatattgaagtcatcactaaaatgttagttagatttataaatataaaaagttcccaaccatagtgataccattttcataaaattttagttattaatatcgtttccaacaattttcatcctaaaaaatccaatcagagaaaggaataggagctcccaatggcagtggtagtgtcctggtcagcaacagcggcggcattccgggctccgcgacacatagttcactgttagcttttttggctcccagggctcccttagagcaagtttaataatatagtccaactactagctccaaaaattaaggcaccatctatagctaacctaataattcactcatataatagttagttgttagttgtatatatattgcatcattaatacttattcacatatatctcttatattgtttattggaacccatgctttagttggctataaatttatagcccattttttctctctcgtcttctctctcctccatataaacacaaatatgatgtgacaaatcgtacatcccgcttacatcattctattatactcggttttatggcagcaattctaaaggaaagggtaggtagagggagaagatgctggaatcttaacatttcagctgatgtcgtggcagatgagcgaattggactctcaactttatcgcaaccagcaaaaccaattaattttacagaaaaactagaaaacgggattctgttcaacgggataacctagccttcacaacataagcatacatgtagcggcttgccggcttacatggagagatcaaccaaactctatacaaaaggcaagggcccacatgcatgtactatccttttttcttgtccatccatgcagctagcttatgggccaacgtgcatgtgcgtacatgctcgacattttactcctgcatgtacggtgcccacatgactttggcagagaggtcgatcagttctatgcggtagttaatcatcaataatgaatacacttattagatcactagtacagaaatataatccctcatacctaatatgtattataactgaaaaaatatagtgcaaaaaatggttccttggatccaatacctacatatatcgtaactgatatctcacaagtatcatcactagtacccatgtatcatcaccaatacctgataggtatcatcactagtacctacgtatcatcactgatacctcataggtattatcactagtaccagacaggtatcgtcattggtacccatgtatcatcaccgatacctaacatgtatcatcaattggcacctatatgtatcttcaccgatacctcacaagtatcatcaccagtacctacatgtatcatcaccggtacctacatgtattatcttcgatactgggtatcgaccaacccagattgttccaactgatatcataggtaccatcgagatacttggtacctagatcaacatgattcccatatgtaccagatctagtactgggtatcgggtatttgggtatcaagtacctggtacctagatcggtctgatacctataggtaccatacctagtgctggtatcaaggtacatgaggtatcatatacctgataccacctgagtatcgggtactaggtgtacctgaattgatgttgaacgatacctgttggtattgggcctggtatcagatactagttttagtatcaggtatcaactcacatgccacgtcacatgcatgcatgcagctagcaacacagccacgtcacatgtatgcatgtagctagaaacacagccatgagtaatcagtagaatgctacgtgagaggaagcaggtgggggggggggctagcgacgcggaacggaagggtatcccgttcccacgggatcctacggtctagctatcctcttaattttatgttatttgagaccattcaacaactttattttgttaacgtacaatagagttagttgttggctcaaggctgagagcaggagcatggcggtggcgcacagtatgagggatggctcttggaggataaggaagagaggatcattgtaaaagcattataggtgttaaaaaattacaaagatgagggtttttttttcttttcttaagggaaaaaagaagtttgaattaccccaaactattacagttgctcgaattacctccttaaactcaaatactagatatttaacaccccaaattctttgaaccggatgaattaccctctcattcaatctgaagcggttttttacaacatggcgtacacatggcagtccaatcagcaaaacaataattaaaaaattgtgtggtcccaactgtccaatatttctctcttctccagctcaactctagcaggcagacatggtgaggagggcgctaccgttgctgcccctattcctctcttccctctcttaccagtatctcagcaggcgaggctggctccagcgaggcaagcggcatccactgccacccctcttcctctctttccccagatcgacctcgggaggtgatgcggactccgggtatcgacctaaggaggcaataaggaatccggcgaggcgggcctcgaccacctattgacgaaaaatctgcgctcagtcgatggtgccagaactgtgttggcgcgaactaagtcaacgaacacaacagactgggagattagcttagctccagtgaaggtccaaaggttgatgagatgtgggcgtgtcaatcagtttgatcctgcaactgacaagatatacaaatagcatatcaatgagccgatcggctgacaagccgatggaataattccagccgatgtcgatagggttttgaacaatcgactaatggtaatgtaattaaaccataataatatccagtagaaatcaatcggctaacaatgatatgatagaataatcaccgatccgaaggttaaaacatacatcggctgaatatccgatgtcatcaaatccacaagattagacaatgaaacatttgttgtgatcggctaaatccaacatgtatgcaatccttgtaagccgatgcaacgtccagatacctcattggctgaaactctgatgaaacccttattggcaatcaagaagcgggctagagattatgattctaagcacgacttagtagatcaaacttaactgatgctgcactaagtatgaaaagaaacataatatctagacaatcaagcctttgactgattttcagggtggtagataccttagctaatctaatatggtaagcgatttagccgataccaatataaaccctaaagcgaatgtcagccgatacaagtaaatcgagctaccaaactagattatctaagatgtatgatagataggtgcttagattgacaatatcagagtgtcgaaaccctagccccgccgatgcaaatagccatgacaagtataaactcgtcgaaaaattagaaaagtaaaaaggtggcgatgcgccgaagttgtattgatcgtggagatagtttacaaaaaaaaacctcgggtgtacatatttatacccatgggtagatactagtcgttgttggataagaaagaaacttttctaaagatagaaggaaaacataaagtctttatgggacactaaacacactttcctaaagataaaagaaaactaacaaactcttcctaattaatagataatttgacatgccgcatcctctttgaattcagtcacttctggataagcttcccttaatatattaatttccttaaccgaatcctccaagaatccgactgctagcgacttgataactcccattggccgattccagaactctgaagccgatactgattttaggtcgataatgtcttcagggcttaccaaatttcactgttaacaccaccgcagccctctttcccaggatcgacctcaggaggcaatgcaggcttcggcgaggtagggcctcagacgccaccaacgcccctcttcttcggcaccgacgagctgagcactggcacatggtcctcgcagagtgcatgctacctccatggttccaggtgacagagctcaaggttgtgaagaggcggcgaccaaaagaggagcttgtgcggaggcggcggtgagctcctggccaacgagcgtcgctgcgcccctcccccctcccccctcccccctcctcgagccctcgccttttgcatcaccctcccaccagccgccgtttgcatcatcttcctgagcgaatcctgcaaggctgcaactctgtcgccaaccctgcctccaacgcccttccctaggaaagcttgagctctgcccgtagccacagctccccgccgtcgaccagagattcttccccgccacgcccgccgttgactagaggcccttctccttagttttacatcactagaagcattgttatttatttcaacttgatctgttgtagatgtgttggaggcaccgacagagccaagctcgctcggggaggaaattaatgggaagaggaaatttatctttttctcccttcatgtgccggccttttgcttttatagttaattggatccatgccaaaaatatatcaattcagaaaaatgccactactatatattcaacacatctgttacgtgccactggaaattgggaaaactagaaccgtgccactccatcatgttatccgtcaaaaaatttgttagcctcaattgcaagtgggacctagctgccagttcctctcttttctttccccttcctctctctccaccaccgtagacggtggtctcgagctaacggaggaggacaagatcgagtgctctgacgacgggggcggcatcccggcagccgcctcgggctcccgtgacagctgcttcggactccgatgacaactacgaggaggacaagatgcagtcgccgtcatcaaccccctccgcagtgggaggcctcgggacttcctctctctccaccaccgttgcagccgccgtcgttgaccacctccacggtgggaggcctcaggagccactgccgtcgacgccgtcgtcttcgaccccatctgcggcgggaggctcgggagccaccgatgtcaccgtcgtcaacctcatctacgggggagagctcaggagtagccgccgccgtcgctgtcctcgtcgtggtcatcagcgagccgcaccgcctccgcccagatcaggcgaggagggccgccggcgttgtctatggcgatagaggaggatggaagaacagctccgcactgctgatggaggaagcgtcggtcctcgagctccgccgcgtcggccttgagcttcatcaccaatgctgccgacgcccaacgcccatctcgtctctccaccgggattgaggaagaagagagatggaaggggaaggggcaaaagtgacatttaacagggggcttagacataggttgagagataattggacggcagtggcgtggttctaattttcccaaattttagtggcacatagccgatatcgtgaatagtatcggtatttttctaatatgccatatttgcagtggcatggatcaattaaccctaaaaataataggtttatcaatatgttttcttttaaggttgttaacataaactaagttcttggaggcttaaatgtaacaaatactgaatatttgggagatgaatcagataaatctggaaaatgtgtcatgcatccaaaatatattttttttcatgtaaagtcggaacgtaattcatcattttacatgaaatctgagaattcacttttaggcatagtagtgtagaattttaagtgaactaaaattaatttagaataatttcaatctgatgaatttgctcatgcgtaaaaatatattgagactggtttctggccgggccaaacaaatacggggagctacagttagccgaccatagataagccaaaaaataaaaaactgactctataggttagattaactaggtgattccccgtgctttgctgcggaaattcttaatatattttttcgacaatcaaactaggagtgcaaaggaaaaaatgatgaaacctcacatatatgccgtacttatcaagaaataaacaaatgatactcgcactttaatgtgaaacatattgataagtatgtattaaatattataaaaataatagatttgttaaagtattgtgcaaatgatgtgaatgtgatgattggatatgtttgcatgttgatttgtggaattaaataaattgtagataatgtaatatgcttgcgtgagattaaatatgtaattattgctagtgggtgatgataacgcatggttgtatgttgagctttagatttagtaggctataacttttatagaaagtcaaattaggagtacaaaggaaacaataatgaaaccttagatatatgcagtacttatcataaaataaacaaatgatactcgcgttttaatgtgaaacatattgataagtatgtgttaaatattataaaaataatagatagatttgttagagtattgtgcaaatgatgtgaaggtgatgattggatatgtttgcatgttgagttgtggaattaaataaattgtagataatgtaatatgcttgcatgagatggaatatgtaattattgctagtgggtgatgatgtggtatggttgcatgttgagcgcttagtaggctataactttatagaaagtatagattagtcatagaagcccgaaatcaaaggtcatttatatttatattgtgtgactacatgagtctagaattgatgaggataggggcacatttataattttttatttagtggatcgaagaatgaaaaatatttaaggatgaaaatgcaatagtgcttgacaaatggtctggcagagccagggtttacgatttcgagatggccttctgtttcgggctctagcggaatgacggttttcacgaaatctggtggacaacctgtagattccgaacaaatttcacaaaccaaaatttgaatacaaattttctgagattaccaataagctcgcaaaaaccggtcagatttggcaaaattccgagcaaaatcatcgaaatttcaatcggtaactagaaaaagaggtaagtatttttttaatttcattattcttttctttcctactgtaaattaatacattattttttaaaaaaaaattatcccaataggttctatgaagatcatactatttataagatttttttctcttttttatcaattcaaatttaaatttggatgaaactcattcaaatctcaaatggtttctacttttgagcctcgtcgaaacgtcgaaatttcgtgaaattcgactggttttcgtcggaattatgaacctgggcagagccgttccatctattctccatggagacgttttcagaacttttcccgtccttaattcaacatttatctgtgatgtgatgtacgccacgtggtccaatcagacccaatacaatccgccggcttgagaaggagggatgatgatatgtttagttgaccgaaagctaaacaatgcaaaaaaaaattctaaaactatattttataagttaaaattgaccgcagctcaaacaaacgagtccaacaaattaaataatccacgagttcattatcatcatgtaatgaatcatcatgaatccaaaaatctataaagtttatcctcactatactaatgttatttttctcttctattgtaaagccatatcaacttagttgttcttagtgttaaatgattcatcaaagatgcaaattaattctcttctaaaaaaacatatcatgcatcctaaccgtttataacattcaaatatttttttaaataagcaaataaattttataactcacatatactatttatcatgtagtttttttttaataacgcgtgtgatttctatctagtaacaataattcgctcattcgctgtgccctcgagaaaatataataataattcaatgtgcgacggtgacgacatgagtgataggactatttcatccccctcatttctctgaccaaataaaaacatgattcactccatccatctaaccaaacatcctatcacaaaatttagagaataatccaatccatctcagctcgatctcacaccaaacacgtactaagataagaagtgggtagatgctggcagaacaagttgacaaaagaagaggacaagatcgatttaggccatgttcagttctcaaaacaaaatttttcacgctgtcacattgaaatgtttggacacatgtaaagtattaaatgtaaaaaaaaataactacacagattgcatgtaaattacgggacgaaccttttaagcctaattacagcataatttgacaatattgtgctacagtaaacatttgctaatgacaaattaattaggcttaataaattcgcctcgcaattttctggcggaatctgtcatttgtttcgttattagactacgtttaataattcaaatgtgtgtccgtgtatccaaaacccaaaaattttccccaactggacgaggcctttacaccccataattctcgagtggcagagtgaagaacaagctagacaggatcgatcgatggccggcggcagcgagtttgatatccaggaagccgcggcgtcggcgtcggcgtcggcatcggcgtcggcgtcggcgtcggcgacggcggcggcggcgccgttgctggagaagaagatcacgtactgggaaggttgccctggctgcgccgtcgagcggaggaaggcggagaatcccggcgtcccctacctgcagttcttccacatctggatcatcatcctcgtctcctgtacgtaatttcatatgtactagctcagttagcttaattaggacactaatttaagtaattaggattgtttttttttgtcctggaaaagattcctcctcagaatttgttgattagcacgccttcttacttaattagcttaggtggaagttgcttaagagcaagtttaatagtatagccaactactagctccaattcatctatagccaatctaatagctcattcatacaatagttacatactacactattaatatatagtcccacctgtcatacacacattacgtcttggagttcgtactacagctggctacaaatctgtagtccgctgctcttctctctcctcatttatcttcttaaaatatgtttgcagctggcttatagcttgctattgtacctgctctaaccgatgaggttccagctggtttcattcggcagtttattattattaattactttctcttttcctgaataattatcatcgttgactaaggttgtttttactttgattataaattaattttaaattattatattacgataaatgaaagttgtatggttatatttgtatcgctacactacaataatataacatatgtttaaaaaaaatatctgtattttaaaagaaaactagttaaaatttaaacttgaacaatgatcgggtcaattattcgataacggagaagagcactgcagagcagagtgagtgatgcctaactgttatccgtccgggtcagtagatatataacgtgcgcgctaacattatctaatattccctccattacaaaaatcctaggctgtttagcaaatactatgatcagatcaaaattaagattactttttactcaattttttgaacttttaagtgtttagattatgtttccaagcatggctttagaatcattgaaatgacgagaataatgcaaattagtctaggaatgcttatatagtggtacaaaatttaaatacaagaagcccttataattaggaacggggggagtatcacagtgtcgtttctagtagtacatcagtacattagtagtctacacgaagatgttcaagtgttaacagatacatcaatgtgatattgtttctttttgctgccctttatttcagtctttttttttccatatgttcagtttagttgttttgtaattgtagcacgtttgccgtctgctataaaaggtggatttctaatattttttttctttttattctaggtttgccaataacatttatatatcccttcctgtatttcatggtaagtgcttctcattttaaaagatcaatagaaacaataattttcttatccacgggattgcattgcaatgtagttaggagcttaggtatcatagtggctctgacagccagctaacagccctactcacttcttcccataaaaaataaaccttgtacgagatgtgaaatatcataatactacaaatttgaacataaggttatctagatttgtaatactagatttgtaatactaggatatataacatctcgtactatgtgtaatttttataggacggaggaagtgcttgtctcagtctcactgactaaagaacgtagtagagggcaaagaggacagtggcagcagcatatatgcaaagggaggctagggtggggtgatagggaggcgaagtagagtgtagaagaaaagagcccaaggagataagggagagggttctggctggtggagactagagacaaattagggtttaagggtggaaagtatgttatataaacttttggacaacaaatatgataacacttaaatggggacaaaatggaaaagattattatggatacgatttttgcttagaaccttatgtgataatattaattatggttttcaataaaaaccatctaaaaattatatttttaattatgttttttgaatagctcatgtgggaaatcccattgcatatgatgtttaagtagaaccatctataataagtttgtgtgacagtgttaagaaaccatttgcaataaggtgtccctacgacttctttttaggtagtggatgttactcgattctcttttttaatgttgtcacaacccactaaacaactaaaactcaacatgcaagcatattaattattattagtgc

SEQ ID NO: 13844 - DNA, 2546 bp, Oryza sativa
taggtccctaaacctcaacatgcaactatagctattacatatacaattttattacatcctaaacctcaacatactaggatgctaaattatcattcctcacataatttttgtaatattaattcaatccaaaccaaatctatccatgtcattgtcatgtggggcacggcctatacacggcgtcgccgggcgcgagatgtgcggagagctgcggagcgagccgcagcgcgtgtcgcggcgcagagcgcgatcaccatgaccgtggatggcaaggacgggctcagtggctaggatcggagtagccttgattctaggagggtttgtttccaagttgttagcgtttatttccaagttagttagccggagggctatatactcttgtaccgaaacatttgagaggaaagcatgaaagttatcgtctaatctccctcttattctgttaagccactagctgaggggtataacctcgcaggtgaggactggagcgcgactacgagttacgtagtcgcggcccgccgtcgttgagcgcccaggcgcttgacaacctggtatcgggatctcgtcgatcctcggcgtccgccgccgccgcgcctttccctaccaccgccgcacccgcgtctcccgaccccgcacccatcaaccctagtccaccacccatcactgccaacaccagtccaccttccccgtcatcctcgtcatccgtcgcctccaactccggtgacatgggtgacaacggcgacctcaaggccgcgatcgacgccctcaccaagaacgtcgccgccatgcagtcgtctatccaggccaacgccaaggcgatcgagaacatcaccgcatcatcctcaggctccggcccacggcaccactccggcgagcaacccccagatcgcccccccaagcattggcgcccggagatgccgcgctacgatggcaagactgatcctctcaccttcatcaacaagtgcgaatcctttttcttgcagcagcggattatgccggaggagcgcgtctggatggcttcgtacaacctccacgacgacgcccagctgtggttcatgcaaattcaggaggatgagggcactccgacatggccatgcttcaaggacctcatcaatctgcggttcgggccaccgctccgctcgactccgctcttcgagctctcggcctgccgccggaccgggacggtcgcggagtactcgtcgcagtggcaggcgctgctgccccgcgcgggcaaactggaggaggcccagaagatccagctctacaccggcgggctcctgccaccgcttagcctccaagtccagatgcagaacccccagtccgtggcgtccgccatgagtctggcacggcagttcaagctcatggccgaatacacgaccgcgccggccaaggctccgggccgcggcgtcctgggcgccccacaagcgcgtccggctctgccggcacccccgccgcaccctgacaagacaccggcggtcaccaaccagggcgagggccgccaggcgaagcgcctcaccaaggaggaacaggcggaacgccgccgccttggcctctgctacaactgcaacgagagctacacccgggggcacaaccgtgtttgccggcgcatcttccacattgccggggtggagctcgacgacgacgccgccgccgacgctcatgaggagccgaccacggaatcgccggtcttctccctgcacgcggtggccggcgtaccgcgcggcgggacgctgcagatcgcagtcaccatcggcggtgcgccactcgtcgccctcctcgacagtgggtcgacccacaacttcatctctgccagcgccgcgccacgcacgaggcttccggtggagtccagaccgcggctcacggcggtcgtcgccaacggcgagcgcgtcgcgtgtccgggcgtcatccgcgccgcgccagtcgtcatcgacggcaccaacttcgacatcgacttgtttgtaatgcctcttgcagggtacgatttggtgctgggcacccagtggatggccacccttggcgagatagtctgggacttcgccacgccgtctatggcgttccacctccacgggcacgccttccgctggaccggggtgacgtctgctgctgcaccatcgctcctctctacggtggccagcgcgtccctcctcgacgagctgctggcgtcgttcgcggacgtcttcgccgaacccgtgggcctaccacccccccgcggccgcgatcacggcatagtcctcaagccggacgcggcgccggtggccgtccgaccataccggtacccggcggcccacaaggacgagctggagcggcaatgtgccgccatgatccaccagggcatcgttcgccgcagcgactccgcgttctcatcgccggtcctcctcgtcaagaaagccgacggcacctggcgcttctgcgttgactaccgcgccctgaacgccctcaccgtcaaggacgcgttccccatccccgtcgtcgacgagctcctggacgagcttcatggggcgcgcttcttcaccaagctcgaccttcggtcggggtaccaccaggtgcggatg

SEQ ID NO: 13845 - DNA, 11708 bp, Oryza sativa
atgtgcgaagagctgcggaacgagccgcagcgcgtgtcgcggcgcagagcgcgatcaccgtgaccgtggatggcaaggacgggctcagtggctaggatcggagtagccttgattctaggagggtttgtttccaagttgttagcgtttatttccaagttagttagccggagggctatatactcttgtaccgaaatatttgagaggaaagcatgaaagttatcgtctaatctccctcttattctgttaagccactagctgaggggtataacctcgcaggtgaggactggagcgcgactacgagttacgtagtcacggcccgccgtcgttgagcgcccaggcgcttgacagtcatcatttctattgcatttaacatgtatccatacatcccacagcaaagcatgggacgtcatctagtttacaatatggtttgaccattcgttagtgattaatgataataatcgtatttgtgacattatattttggtaaattgtcttgaaattaattaagtcgatatatttttcttgaacacattgaagtcaatataataaactatagtgcagttactcttcttttataaaccattgacaattttgctaagtattgtaaaattttgtcctcaatagataagagatttgcatgttgccaaaacaatagaagacattggattttacggaggctttgtaggtaagaacccctccaaacaatttcaatatggttatatccaatgattagatgtgtcaagctccagttgttatataagtaataatcattcttttgtactcagtcatccagcatcgatgtcatgttcttaatatttgtaggtgcttcatatatgcttggtagagctttaacttcaactatttgggggatggtagcagatcgtatcggcaggaagccggttattgtgtttggaattttcttcacgttagaaatttttttctctatttgtattgcacctattctttgttaccttcatttgattcattgtattgcactaaatatcttaggctggtatttaatactttgtttgggctaagcacgcagtactggatggcaataactacacgttttcttgttggatcattgaatggtttacttggcccaataagagtatgattactgactgaatcagaactctattagatatttaaggatgttaagtttagtaacttgggtctttgatctttataggcttacactactgaagtttgtcggcctgagcatcaagctattggattgtcacttgtaagcatacaatattttatagaaatatgttttcactactcgctaatgcaacaactcaatttatgatgtttgttcctctccattattaggatagcacatcatgggcaatgggtcttattattggatcagttattggtggatatcttgcacaggtataaaaaatattagtgatataggaatttaatatgcacttatccactaatattattatgacactgttattttgtctgatagccaacggaaaaatatccaaagttatttcctggcaactcactattcggaaggtatttagtatcacatatgaatacggttataatacatttattaaaaaaaacagttacaatagacaagtggcttcaacttactgtttttaaaaattcttttcataggtacccgtacttattaccttccttatgtatatcggtcttctgctttattatctttataagctgcatgtggctcccggtatgtgcaacctttctatgttattttgctaaatattcgatgtgatgcacacttatgtatgtttttgcaaatatataaaatagtattactttttctacttgaaaatccataagaagatatatagaattacaatggaaaacaaatgtttgaatatttaagcacgaattttgcaattaacaggagctgttgggtgattaagcaatgaaatgtcacatgtggagtggttgtttgagtatggcatatttttaacttgtatgctttcatcgaagattggaagcataaacaatatatggattagttattaaaagaaattgcatgacataatatttcaggagacactgcatgatctcaaagtccacaaaaaggacgatggaccaattgaatctccggttgcacattttgccaaatctgaagaacttcttgagcaacatattactccaactataaataagaatttgtttaagaattggccattgatgtcatctatcattctctactgtatcatctgctttgatgatatggcatatacagaggtgtgtatttaactactttttagcaataatatctatggtggtgcttttaaaatatatggatttttaatagaaacaatgtaatatagtgtttatcatctaccagcaaacacaagcattgacaaaaggcataactaaacatccatacttctttgattatggtaatacaaaagctgagaccaactaaaaatatatattggttgcctaaatcaatacatatagtaggagcttcccctatggtttctaggtcgaaaaaagaacttccatatagttatatattccaatgcctttactgcaattaataatacttatagttcttgttacctgatccaaatagctacattttttctcagtatttatttttctagtcattattgcatttaatcatttcatttaaattcaactttatatgggtacaataaaatgaaatagagagatatgtatagcctttaggctgtctccactaagttgatgagttgattatagatatttctttatgcaaagaatgttttgtttctatggaatttctctaacgtttcaagtcacattttagatattttctctatggtctgaaagtgataaaaagtatggtgggctaagtttctcccctgaggatgttggtcaagtacttgcaatttcaggtaaattctattcataattgcactttccatgtcaactttttaattacatatcaccaataccaattgtcttaaacgatttcatcttatattttctctttctataggtgtgagtgttatgttgtatcaaacatttatttatcctaatattgagaaaattcttggaccaatcaatacttctcgtgttgcagcggtgagttcaatattgcaagttagcatgattttttttacatatgtttaaaaaaattgtacatatcatgattaaattttgcaggttctatctatggttttgctttttacttactcacctatgacgcacctcccaagaccttgggttcaaatagtactaaatattgtttcggtacttaaaagtaatcttgttgtgagtatcaacatgcttgaaatatttattgatattgcaacatatatttgttttgtttctctatgtattagagcaagaaaaaatttaaatatcaacaacaatataggtatatatttcttgcttttgttgaacatatttcataacaacatttcatgttttttgattctctagaaaaagaaaatgtttgtttataaagaatgtttctataataattagaaaaatacatgaaattatcaatgtcacatagccaaattttaatttatgagttcacctaaagagtttttcataggattattgcaattggatgttatatctgatttcttttcaatatctgaaagaagcacaaaaatatagcatgggtcaatatcttaattactaacatatttttcctattgttatggttattaggtcaccattgttacttgcacgtacatacttcaaaatgattctgtggtatgtgccactatatcatagtttaattccttcagttttattataatatcttctttttaagacattgtccctcaatggaaccataagacccaagatcaaagaggaacggcaaatggtttagccaccactctaatgtcctttttcaaggcatttgctccagcaggagctggtattgtgtaagtattattttatttctagtgtttatgtttgtaggaaaataagcatcaattctaacttacgaatttcaaatggcatgaagctttcattccaaaaatgtgcactagatatgttcccttttggaggctgttaagtaatttacatttttttttattcaacttggtatacatttggaatgtacaagtgccaatctggtataaaatagtcatctgttaatgcaggttttcatgggcgcaaaagcgtcaacatgctttcttctttccaggtattgtgaactagtactatttgtggaaataactttaaaacttcacattcttaaataaataatattatgaatcttgtaatatgactaaaatttagggggtatttgacacagcttcagatctaagactttttagagctgggtattcctagctccataaatccatgatttgtatctacaatatatttataacatttggacgaatcattttatttaaattttagatgaaatataaaattttaaaccaatataatttaacatacaaacttcaaatcaagtgtggatctgagatctggagttgtgcccaataggaccttagacactggtacacactgtctggtttgttctcaaattctttccttcgccatatgataatttcatatcatgtagtctatttgatcttctctacccattttattgttaactttcttttttgggtatgtaggtgatcaaatggtgttctccttttgttcattgtcgagtttgttgggctggtttggacattcaagccttttcttgttatgccagaaaaactttctttaaactattcctccaactgagatagagtttcttgagaagttctgtgacatggactacaaagagtttgtatctcctaggtaattaaggcagcctttgtccaccttcttctgcaatttggggagctaccgatagttgacaacaaagggtggacccaaaccttgggccacccaagcagtggcctggggcctggaagtgaagacccatataagctcatctgatttcaccatgtaaaaggatctgagctaaagttggagcggcccagggcctgtctaaagtatgggtccgctcccaaccatataaattcttgttgaagaattcgaaatattcagcaagaaagaaaaatggaagtacaagacgatgaacataaaaattgcgtagttctaagcacgcatccaaaaactgtttctgaaagtggaaaccatgtgtttttttaaaaaaaaataatttaaattgatagtgttgacactaggaaactggtggaaagcctgccgccggctagtaacctaatggactttggacgatcacttatgattgtttttcttcttggtcattgatctcataaagtttgtttcaatcaatgagatcagaatagtttgtttcaatcaatgagatcagaatattaatttccaatcagatatttcctttaccaaatttgtccatagaatagtttgtcatgttcgcgtaattgtaaacacgcatcaatttcggtcagcaattttaaataggtcggttcaccaaagaggcttgtgcaattaggattgtatatatcataccattacatatagatgcttgaagatctgactttaaaggtatatactagaaaatagatgctttaaacccatacactcaatcaagcggctactctcggggcattgattccaggggtgccaaggtgcaagatcgacggatccggagatggctaccaaactccagcatctgccatggtaaaggtggaagcatggaggtctcggcatagccgtcacgtctgaccagcgagatggttgcggtggtgtgagcttggcaagcagggcgttcaccgccattgaggagtccaattgatcaacaagtcttcgatagcactccaatattcacggaagagccatttagtgcgagtgccatcgcttatacaatcaagtattgcagtcactgccaccaccattgctcctatttaatctcattgcgtagctcaattcttctttcgattgtcaactccttatttgatttaatcaggtaaatgattcccctataaatgttgtttgaaactttttttccttcattagtttgactacaatattgtcttgtttagtgctaaatcatttgaaatgagaccagaattgaagatactggagttctagaattgtgtggaaatagttctttctaaatacttactcttggtctcttggggaaagaaagagagacacgtgtcaacatataattgtgcatcatcttaaccaatcagcgagcagcaaccttgccggcttgagatatataaagatattgctgaaactgcccgttatatagtataactacctagaatatataaaaaatgtgacttttatcccaacacttcccaattctcatgctacctctatcatctactaacccttaaaccgcaccacaccatccattaatgagggcattgcagatcttttaccctaatcgttaatttctccaaaacatagaaagctatattttaggacagaccaagtatctaaagcatattgtgattttctctaggtcaggagtgatgtacgtgtgcccttgaaggtactgctaggatcgttcaacagttcttcacaattcaggaataccaagaaaacatcacaacaggcagatatacgaggataattttcagaagcactttccagtttcctttgtacaatggccatatatcagtttaagacaaacgcaacacctcctgctacataagaaggcctattttggaacacgggaattccatggatccctacagggaaatatacagctaaagcaaaactccaactgaaattcccatgttccaaactaagactatcatccccaaagagcattcactaaactgtataatgtaccaatagtgatgccattagctttaagttttcagtcttctgccatggtttaactacggacttctcacgcagcgaatccacaaaaaccatcatctgtgttggaaaatattcgtcattatcatgtggtcaacctgctgtagtacatgaatcaacacaaagataagatgttgagatttaagtgtgctcaataccaatttgatatatggaagttacccttacattttttgccatgcctgcttcgataggactgcgctggttggcgagaacttgattgcctcacctgaacagagtgaaatacaaatggtcaagttatatgttggattgtaacaacaaaattaaatatcagaaatcaggaaacatttaacaagttagaggtgtatccacaggttccacccaggtttaagggtgggaggaagatctagagaatttgccataggaaatcatacctgactactgattggtgttcctgttagtccataataaaaagctgaaaatgcgtgatacattacatatattatagtccatatggaggagtcctttattaattgttagcaccagacacactgtataacatacctaggtgtggaggatatctattgctgtcatgataatgtggcagagaagattcagcagtagcagggggcagcgcaccatagctgacataagaggatgcaaaatgattaagtgagaaagaatccgctactctattctgataaataatatgacatatggggatagtttagaatttcagatcaccttgatgctgctgtagtataggtgctaccctcatgacgacgacaagaatgacctctcaatggataataaggatcaccctggattaaaatcaaaactacgagattaaaagatcagtatgcagtttttcaagacgatatggtttaacctaccagtgttgaaaagggacgcttctctccagaataaatgtgggtataatcttgaacagggtatcttactgtttagaggacgaaaacatcagctgatagggattttaaagagaaaacaatatggcaaaacttcaaaaatatattgtattggacgacatgttaattgtaggaggggagcaaacacaatataataggagcgcacatagccagagtggcagcatgaaacagctagcagattttgcagcctagtgaaaactaagacaacaccatccaactatggcttgattttatcaaacagctggtaggggcttcacatgcattcagatggtttatttgttcaggggaaacggtttacgaaagacatctatctaatttacacaggtgaagtagatattagagaatatgctataaaccagtcattacacagataaaaaatgtcaggcatcagacatcatgaaaccagcttcttttccacataagagcaattgtttctgaaaataaatctgagaactgttatacaacctgtccattttgagaacaaatgcaacatgcatacaattcacccaatcaattaatcagttaataaataatcatccaccttatattcatttgcattttgcactagttttatttttcgatctaaggaaaaggtcaagaacatgcaaatggaggcaattgcttggtttcttggtcaagggtctgtcggcctattaaatatggaggattatgaattcatgatttgaccactctcagttgggccttcggtatgtattgactttggttgcagaaaaatgagcctcatgaccatggaacggtttgcaaattcagattcactcaaatgctaaagataagtttgatatggcacttgttatgacaattggggtatatcttgctctttcattaaaatctgaagatttatgtgtcttgagctatcaatcttcagattataatgaagttggttgattaatgtagttaatatttacataggagaaagctggcagccacagatgggtcaaacaattggaaatagacgacaagatggatggaattgggaatgactaacttttagaagtcttcattttgccttccccagtaatactagatttatggtcttccttggtctgcttgctctgttgggcaggtttagccaatgaaactttaatattcacctgggacacgccaaaagatgtaaaaatcctatcaattgtaaactaatactctgaattaatccaagtcgagaaaagacctttgagccgttcttactgaactcttccttgtcaaaagattcaagacacgagattgcagcctcacgagtaatgtaattaataaaggcaaagtccctccttttagctgacggcatatcgcgtgacagaaccacactttcaatcttcccatgtttcttgaagatttcttttagctgagcatgatcccaggacgttggtatcccatccacaaaaatcgatttaacctagatggaacaaacagtgcatcagagtacttagacttcccagggaagcgaaatcaaatatgttgttaagtgttcagaacttcagatatgattaaaggacttgaacggggatatgaataaagccaggtatgttaacaagtggaaacaaatggtcgttaacttatttatgtaataaggaggacgacgatgcacttcgaaccaagggccaaacatatgaaggtccaagaaacattgttcataaaggacatggacatactagtcaaactgatttttccatccaacagagttatgaaacaattaagacagaacagaaggaaagaaatctctcccaaggtttggataaagcaacatcatgaataatatgtccaggtcgaaatagaacagttgacatctgtaagaaccaatggtataaggaccataggataaaaggttgatagcgaaaaaactgaactctacgatcatcaatgaggccaaatcatcagcaatacagagatacagggatgcccttaaaagaacagaaaattcatttcgtgtcagaacttaagcataaacagttacagctagtataccgatgtatatccaggatataattgtgatagcaacagaaccagtaagacacaacctgtgccttatgccaaatgataggataagtgacaagaatgccaaacgtatgactagactgaaagaaagtggaggttgtcttcaaaagaaaaggttaaaacaaataagatcatctgatttgacattcatttgcagtttcagtcttattagagtcacaaaaccaccatatgcatatgatatgatctctataaaagctaagtggatgacacacataggcagtatgttggagagagagggagagagagacctgcatatctttctcatctggatcattcaatggttcagcccatgcaactcttatattcaggcctttgccaaaagcatttttctgtgaaagctttttgtatgccatccgtgcatctctactagtttccagttcaagaaatgcaaaaccacgattacagactggattatttgaatcagacttaagtgttacagaatcaatgttctcaattccaattttctttagctgcttgatgacctgctttgaagagcaacatatgagaatataaaaatgaaattcaggctaacacccaatcaagtcaatcagaacacaaaaatgaaaatgttactcacatcttcttttttccatttcttgttgatgtttccaagaaaaattctgtcattcccaactggaactgcagctcgacagagcttcccacaaatctgtagcagagtttccataaacaaaattggagaaagaggtgtaataagtactattcattacagcaatatgtgggactagaagacctggtctatccaaaattttcacaagaaaccatttttatcacagaaaattggcactgcataataataaagcaaccaaatatatacgaaatacatgtagaagtttatggatttgtgctatgatgagtcaaccataacaaatggtaaacaggataggaattaagatcaatgtggcatatcccattaggggatgctggatcaactagtacgacctgactcaataaaatcaatcatggcatcgtagagagaagtcactggtccatttgacagtggaaaatttttaagctcttgcagtaagcttacatggtcattccatccgatacttaactgaaaaaagtatctgtgtaccggttgcgatattatgaaacaaatatgcagcattgtcccgcatttgatgattgcactaatgcacaggtcatacagcaatcagcactggtgcgggattacaatgatgataaaatcaaaccaaaagtgtgatggcactaccttcacattgccgaattccgcgatggccttcttcgcctgcgcggcgtggcggtagcgcacgaagcagtaccccttgttcttccctgcaagaggattcattatcatccggacctcggtgatttccccggccttggcgaacaccgccctcacatcatcctccttggcgtcccggtgaagcccaccaacaaacacctccatggtcatcctcttccgccgctccgacatccccgcctcctcctcctccactcccttacccaccactaaggccacctcctcctcctccttacacaccgattcttccaccaccgcaacggcattgcaatccgtggcaggtttggattcatccaatttttgctcattcccaactccgccgtcctgatcacttgctggctcgtcggttggggcttctccccctgcctccgatgatgctgctgctccggagaccgccgcagcagcagcaaccgccgccgccgcggccttccgagcggcgaacgtgcccttggggacgaccttcttgacgatgaccttcttaaccactttccgaaccttccgcgccgccgccgccgacgccggcgacgacgacgacgacgacctcgccgccgcgtcgtcgacagcgggaggcggcgccgtcgagggcttcgtggaggccgagggctgaggccggcgtcgcggtgtccaggcgggggggattggtagggtgggctccaccgccggggtggggggagg

SEQ ID NO: 13846 - DNA, 1718 bp, Oryza sativa
ccacaagtatctaatatagtagatattatatcaatatgtgtaatttacaatgcaaaatatagaagttgcattgcacttacattataattacattggacttacatatataattttagaacttacattatgaatacactaaaattacatatgtaatttagatacttacaatgtaaatacatattgatttttttttaaaaaatatggcaccataaatatagctactcccatgagttttcttcccaaaattcaaaactatgaacacatttagtatttagagtatattttactgtgtcacctttttattatcaatgtttcgctttggatcacactttaaccattgttttcacttcaggtaatcttacctttgtttcattttggatcacctcgatactcttctaatgcatataaacgatttcgagtatgccagcttttattcgtcaatgaacttacgtagctatatttacactattgtttgatatacgataggttgatgtagatagttaaaggtagttaaagtgccacaaaaggtagatttacaatgtttaaagtgaaaaaaaaattgtgaaaaggtggtacaaaacgaaacaacagtaataaaagtaaattttactgtagtatttattaaaaattagatcaaaatataaacactcgtagagtactactcaaataattcgaagtacttcgtattagtagcagatcatttaattttcttttcatattagctccaactaccttctcacccaccatacctcatttaacctcattcttttgctaaaatttctaaaggagatttatagatgatgtacatagatacatctatattgaattattgagacgaaaggagtatattggaatggatgtagttatgtatgtattcatctttgttgcgaatataaaccacttgtatgatttttctttttttttttggaaatgacacatttggcagagatagccatgcttgataacaagtttgttgaggtgttaatgctagtgacatcgtagtatcataagtagagtgagtaatgaattacacctatcatatcatatcatgcatgacgtgtcaactgtctagagataacaatttatagcacataagttgatgtacgctttgtttagtttccacataaaaaatttacaccctatcacatcgaacgtttgaacacatgcaagaagtactaaatatatgctaaaaataactaattgcacaaattgcgactaatttgcgagacgaatcttttaagcctaattgctccatgatttgataatgcggtgctacagtaaacatttgctaataacggattaattaggcttaataaattcgtctgactgaataactgaataatttaaggtacaaacaaattaattaactattatagaattgaaaataaatttaaaacaatgttttaagaaatttatatatataaggtttcttttaaagtgaaccatttagaagtctaggaagcttgtatattattattctatttatttttcccatagttgcttattggtttgctatcacaaactctgcttaagtgcttagtatttgctctccctcccggtttctcacttaatcacaaatcaaatgacatcgagtttcgttttgctttatactctttctttttactataacactaatatgtcaataatatacataaattagtggttgaaggattcttaattgtagaattatctttttattagggaaggttagtttcaaa

SEQ ID NO: 13847 - DNA, 2673 bp, Oryza sativa
tacaaatccatagatctagattaatgattacagtggtactattttgataaattattttgttcccagtttatatgaattttaaaattttagatcacaattttacatataaactacaaatctatggtggatctgagatctgtagttatgccaaagaatacctcatattgctgatcctttctcgtatgctttctaatggagctagtatctgcagctgtattatcagaaatacatttaaatgagatatgttttgtatgacccagttgacggcctcacaaaccctaaacaggagggaaccaagcctgagctctaggcttggctcctaaatcccattcaaatattcttaaaaaaatcacatatttcttttttttaaaaaaaatagtaggatgattaggccgaatatgtcagttgagccttaggcgtggagaattttaatttggctctgtcaccaccatcaggaattgaagcagggaaatgagagctataaccgttgaataacctctcaaaaaatccctgaattttagctgcatgagcagcttaaatgtgggatcaatattcattaagctcaagttactaacttgaaaaatatacagcatgtgtgtgttgttttgaactctaaaaatacctagacggagttatgcattattgaaaacataacatatgaatgcaaacttatactagaaaaacccatgaattctaaccttagtggtttttcaccaatatttctaataaggggtcaacctttggaagatgagaactctaccatttgaacacatgaatagtgaaaaatcaaactattaaagcttgacgggctagggccataactgagcattgccacgtcagattattgtacaattatactactctagcagtacatacactcttggctgtgtactgttgtacgaaacggagagtccaaagtagtagactgtccatatagttcagtttgatggatttcacccggagatacaccgtacgatttaattgtaataatacatagaaccatttgttttttttttgaactgaagaaccatttgtttttcatttacttttactttaaaacatggacaatgaatttgtttttgaacagggcttgaaactcttaactccgagcaaatgaaaattcaaacagcagtggattcaatattcaactcgaaacccctcctttttttcaactaaaaagtccgcaaaacttcccaataattaaaccgtgaaatttcagcgagacctgtatttaaaaatatgggccaaattcaaaatccaaagcaataaacaactgggctacacacaacatgcgacggcccatctcatcaagcaacaaggcccagcccactcgacacccaccgaatccacgccgctcaatcgaaaccgacggtccagatctcgccgcgccaaccccatcacacaaaccctagcaaccccccacctatataacctctctccctcacgccccgcctccattcgcacgcccgcgccaccacaaaaccctagccgccgccgccgccgccgccgccgccgccatggccacccaaacccgccccctcgtctccgtcaaggccctggagggcgacatggccaccgacaacagcagcagcctcgccctcgccgaggtgttccgcgcgccgctccgccccgacgtggtccgcttcgtccacaggctgctctcctgcaacaagcgccagccctacgccgtgtcccgccgcgccggccaccagacctcggcggagtcgtggggcacggggcgcgccgtgtcgcgtatcccccgcgtccccggcggcgggacgcaccgcgccgggcagggagccttcggcaacatgtgccgcggcgggcgcatgttcgcgccgaccaagacatggcgcaagtggcaccgccgcgtcaacgtccacctccgccgcgtcgccgtcgcctccgccctcgccgccacctccgtcccgtccctcgtcctcgcccgcggccaccgcatcgagaccgtccccgagctccccctcgtcatttccgactccgccgagtccatcgagaagacctcccaggccatcaagatcctgaagcaggtcggcgcctacgccgacgccgagaaggccaaggactccgtcggcatccgccccggcaagggtaagatgcgcaaccgccgctacatcaaccgcaagggccccctcatcgtctacggcaccgagggatccaagatcgtcaaggccttccgcaacctccccggcgtggatgtcgccaacgtcgagcgcctcaacctgctcgacctcgcacccggtggtcacctcgggcgcttcgtgatctggaccgagagcgccttcaagaagcttgaggaggtgtatggcaccttcgaggcgccgtcgctgaagaagaaggggttcatcctgccgaggcccaagatggccaatgctgatcttggcaggatcatcaactctgatgaggtgcagtctgtggtgaagccgctcaacaaggaggtcaagcgcagggagaagaggaagaacccgctcaagaatgtcgccgctgtgctcaagctcaacccctacttcggcactgcacgcaagatggccacccttgctgaggctgcccgcatcaaggccaggaaggagaagcttgactccaagaggaccaagcttagcccggtataacttactctcctctcaattttgttgattcagttattataaaatgatg

SEQ ID NO: 13848 - DNA, 2060 bp, Oryza sativa
cttgttataagttattgacctcattgttgtagctcagtgtctgtcttatttctacattgtgttcctagaagcctttgaatgtgttaattgattcatgataacatacagttgtgcaaggtcatttagttatttttcttaaattatgtctctatgcattcaagtttaggtttcatgtaatgttaatattctagattggctccttgtccttggtgaaatggtggctgagttcttggcattagaaggtcatttatttggctgtgttttatatttatcatagcatgtgtggtttgttgttgacttgtcgtagctgtttatttacactgatcttaggttctactatcattttttgtctggtttattctgccattgatatttcatttgctgtattgcccttagtgtttttagtgggatacttgtttagtcctcaaccatttggagacttcaatctcttggtgccttttgttctaactgaaaattcctgttgattcattgtaggaggaggctgctaaggttaaggctgcaggaaaggcatggtacaagaccatgatctcagacagtgactatgctgagttcgacaacttctcgaagtggctcggagtgacgcagtgagcgttgtcttgttttaagttttgagtagcagcgttaccggatcttatctcaaggatttatcaatctgtttttacctgaacatctccataagaagttatctgtgggattttgagactagtttctctgttttgttaatgtgctgtcgtgagaacatagagtatgtggtttggaccagctatctaaattatgtatgcacttccatgttctctgtgatgtcctgtattttgatgctgtgatcttgtatcgctgtatcatattgttctagggctcatggcttactcggtcaccatggcgctgattccattcacagtgttcagcctacttaaacatatttgcaattttggttagatgagtttgttgtgaaatctggtcagtgggcatgcctagcaagcctaaatcaagttgagcgagcctcaatcttatcttgcttttggtgaggaaaatgttgtctgttttgtggttgtgttagttgaggaaaatatggtcgtgccattgctttaatcctggaatcactgtgatgactgactgaaacgagtttgctagttaaccaaactctgttaccgtcaatgattgaggaagaagtcttggctcgtgctgttgcagaaattgcacgggattgaatcagtggcaacttgagttctggatgaattttcttccaaacaaaacctcgacagttcgactgtgctggcaaccactgttccttggtttgcattctgttttgcgggaccgcttagcgttacgacaaatttagggcctgttcactttgatgacattttcaaccttaccaaattttggtaaagttgccaaaaaagtggctacatttagtttgctaccaaattttggtaactaatgaaatcttgccaaaattttggcatagttgtcaaaatttcagcaataccaaaatttagtaaggattttttttaagtatcaaagtgaacatgcccttagcaaaacactgaaactttgtccgaaatttgatccaaaacgaacggtttgaggaagcttcggacggaattcgaactaacgccgtgtttagttccaaataattcttcaaactttcaacttttccatcacatgaaaactttcctacacacataaacttccaacttttcatcacatcgttctaattttaaccaaacttctaattttagtgtgaactaaacacaactaagactgtttagttcaacgcaaagtttagattttggttgaaattagagatgatgtgattaaaaagttgtgtgtgtatgacaggttgatgtgatgaaaaaggactgaagtttggatccaaaccttgcatctaaacagtaaacacagcccaaattcgtaaaccgtcgggttcattcacttcaccccgcgtcaaacacgcaacggaccggagcgcgccgcgaagccagctcactcggtcagtcgcgcacgtggccccactccaccggccacgtcaccctccacgt

SEQ ID NO: 13849 - DNA, 2647 bp, Oryza sativa
tgaacgtcgcgcgcgtcaacatgtgccacggggaccgggagtggcaccggggcgtcatccgcgcggtgcggaggctcaacgaggagaaggggttcgccgtcgccgtcatgatggacaccgaggggagcgagatccacatgggggacctcggcggcgccgccgccgccaaggcggaggtgagcttagctgccgctggattctgcctttggcattgccgccttgctaatttgctttcatgcgttcgatggaattcggcgagtaccgcgtgcgtggtgctagcaagtacgtgaattcatactactagtgagtaggaatgcgtgctttattcgacttggaattcggataaagaagatgtcctgacaccgtgactcggtagatctagatttgagctcaggttcatgtttgcacagtgaaggggaacactagtattgttatggaatattcttccatgaaatgctactagcacccaacattccctggagtggggataccagtttggattttgcgcaactttatcgcaagttgggtgataacatgaatccagattctactgcagagaatataagagatgctcaggtagatgcaaaagagagagccacatcataatctcacttgagcaagtgctccagccccttctgggactaccatgttatagacctgtcaacaagctaaattaaccacctatttaagcgtgtaaccattccaagtgctggcctccttgttaactattgaatactctgcaacttttcatgctattgtccacgctggtagagaaacacagttagtttggcctaattgtcagctatgtatgtgttttgtacatggcccaacaggctcttgttcctgtaatgtcagcctatagtgtaaatcttgctttccagctgaaaaaggaacaccgcatctgaattttgtttattagattcagcagaagcatgcaggcatctgtagtttgagttttattgacttggtttggcagtcataagctctgttcttgctctagtaaagaattgaagtttcacattaaaaaaagggtaaagaaattgaagttaacaatatctgatgctccaaagtttctgtatcacctatgtcaatgaaccatgacataatcttagagattaatgaattctctcatatgactggctcaccactctcaaaaataagattcttgcataatttttttcatttgaaacatattacaagtggcttgaccgctatctagcactccctcctagtcatatccaatgataactactttactttttctagccatgccttttattggttctttttgggttttcctagtggcaatatgcccctctaatagttatttattttaatcctttttttttcttttgttggatttcacaggatggagaaatatggacatttagcgtaagatcctttgaggcacctcccccagaacgaactattcatgtgaactacgaaggcttcgctgaaggttattttcaagcagatctcttctgttggtcttatttatatttctattcccctctgtaatgtgttttttgaacactacacagatgtgagagttggtgatgagcttcttgttgatggtggcatggctcggtttgaggtggttgagaaattaggaccagatgtcaagtgccgttgcacagatcctggtttgttgctgccacgtgccaatcttacattttggcgggatggtagtattgtccgtgagaggaacgctatgctacctaccatttcatcaaaggtaaattcactagcatggcaaatttgttgctgcaagcctgtaatcaaaaagtaggctgaatggttatgtcattttgttgcacaaacagttcatgttttacatgttactactgaggtcagcccaaatgaattacctggtttactcaaaccattgtgttgtaatagtgaataatatctgcatatattcgaaaaagtccaccatccatttcttagaaagctttatgtggactgttaccaagagttattgttgttgagaaatgatgattcttatttctgtgcaacttctgcaggattggcttgacatagactttggaatttctgaaggcgtagattttattgcagtttcgtttgtcaaatctgcagaagtaattaaccatctgaaaagctatatagctgcaaggagccgtggcaggtaagatgagtataaatactctcttcttgattgagctcatacctccatgaagctaagtacatggtttgatggttgaactgatggcaccatatgtatgactaatactgtaactatccaactcttgtgcatttgctgcttttggttcttgtccaattctgtggtaccagttgggtaagcttttcagtcagctacccctcagatgatcagcttagtatgaacgcactgtttttaactagttattacttaaatgttgagttagccataacttgctatagtgtcaactcttttgcaccaacaatcttggtttttattaggacatggtctctttgttgttagtttctccaatcaattttttcgatttgtagtagagccaagtggactatggcagtaagttctgatgtgttgaagattgtcttggttgctccatacctgttcaaacaaaaaaactgatcaatatattattttgtactgtttctagtctcgatttgggggcgcaggaat

SEQ ID NO: 13850 - DNA, 3378 bp, Oryza sativa
aattcctgcagcccagagatattacatatatttctattaaaaaagctaggcattgcattcccgaaatattagtttcctttttgctaacctttatggttattgtatattgtcactcatcagcgatatagcagtcattgccaagatcgagagcattgactctttgaagaacttggaggagataatccgtgcttcagatggtgccatggtagcccgaggggatatgggtgcacaaattcccttggagcaagtcccctcagtacaacaaaagatagttaaactgtgcaggcagctcaacaagccagtcattgttgcgtcgcagcttcttgaatcgatgattgagtatcctacgcccaccagggccgaggttgctgatgtttctgaagcagttcgtcagcgtgcagatgcgcttatgctttcaggtgagtcagcaatggggagatatccagagaaagctcttagtgtcctccggagtgttagcctaaggattgagaagtggtggagagaggagaagcgccatgaggaactggaacttaaagatgtttcatcttccttctctgacaaaatatcagaagaaatctgcatttcggccgctaaaatgggtaaccactgccaactctacttctattgttggactgctgctgtatatatgaatcgttttttcgctgttacttctttttgttattgtgcattgccatggttattatcaactcagactactgaattttgccatttgcatatctgggcaaggcctaaccacagctaatttgagttgcagccaacaaattggaggtagatgccgttttcgtctacacaaacactggccacatggcctcactgctctcgcggtgccgtcctgactgcccgatcttcgccttcacgacctcgacatctgtgaggagacgattgaacctccaatggggcctcatccccttccgcctcagcttctcggacgacatggagagcaacctgaaccgtaccttctcgctgctcaaggccaggggcatgatccagtccggcgaccttgtcatcgcgctctccgacatgctgcagtccatccaggtcatgaacgtaccttgagaatcatcatgctcccctctcgtgtttgtttgttctgcccaaaacggaacacggctttagttgacatcatcttaagggcggttttctggtttgaaatttattcgtttgttctccattgtgttagacgacagaaccagagaatgttacaacaataatgctgcaacttccagcgcgttgtaaactctatgctatttagcctgatgtataaggccatgaactgttttgtcgcttactatgataggctatgtatttaccaataaacccttctatttaagctatgtaagaattttcctcatcagaaattactccttgctagagcccagtaaagattctttaaaaactccttgcacatcaaattagaactgagtagttttactttcatatggactttggccaaactagtcactaaccttttgagtgaaatttttaccttttttttttggacatgtatgtatgcagggtattagttgacctgatgtagccatgaatagtttttgcattggtacgtttgtttgaatagtttttgcattggtacgtttgtttggcatctgtcacaacccacaagtaggacgctagcaacgacataaaaatattttattggggcgtgaaaaatgggagaattatgttcgcaagagggtttgaccaggtagtcatgacattcttatgctaatctcaagtctcagccatatatcaaacatcttaatgcacactgcaacgtgttacgtgagtctcctgctaccgctagtctcccaagtctaccaaatacttgacccgtttttaaatacactcagtttgaaaccctccgttctaaattaagatgtttttgtttttttaccaagtcaagctttttttagtttgaccatatttatagaaaacataactgcgtttttagcacaaaaacaagtgtactataaatatagccagtaatggatttaatgaatttggtgtgttactacgtatttctatgagcttgctgaagaaatctgacttagaacaaaagactaaaacatcttacaacctagaaagtagaaagagtacttattagcatattctttccaaaatcaaaatttaacaccgccgcaaattttgaacatgatattctgtcaaaatattgtatttccaatttttttttcatggccaaattcaaaataacattgaaggtactaacaagtaaatgagaacgagatagtaaatatattattaggggcgtgaataaaaaagttgaacacagggttaccctactgttgtttgggggttaccgctaccccgtggttggcggttaccgtagtaaccacaaaaaaccgtgtaaaatttacctcaaaaaatttgaattaaaaaatcggttgttttggcacagttactgcatggtttctagcgataaccacaatattcacatggttattgccggttgtatagcagaacacatcttaactagtgaaaactaaatcacacgatgcatcaaggaatgtgccacgccttcaaaatagtggctctgttcgggtgcaatttttattactatactgcagtcaataggaacagtgtttgtactgcagtcaataggaacaatgttttgtattggcagctgcagcagtgcagccgctgcatataacagccgaacagactcaatattaattgtcagatatgctaatagtgaaacgacatatgtcgttggataaacatagattacaaaactacaggtgctggtaaatcttcatgaggcttccagagtctccaaatccaaactgagataaatcggtgaggagagagatgtgcaatactgtaagctgaggacatatgtcaatgcaattttgtaatttgatccttccataaaattcattatatatataagctcttaatttaatatatctttgatttcttgaaatggtcgcattgtactaccttctcaacatataagaagtttaggattcaatacggatatttaaaaaataggtaaaattcaatgatagtagattacgattgattgaaatgaggaaaactggtggaatgttgtaattggttatttactcaattttttatggattttttttacaatttttgaccatgtataataggcgggtttgagtcacgcgaatgcgtgacttcgtagcctagtgaaattgaaatttcactagaaaaaattcgaaaaaaacacttaaatgtgtgcataaattggggataattggaataatatatctaacttttggggtgtaaaatacaaaaattcggcattaatttttctatattatggacttcaaagcaattcaacattttatagcataatagcattacttgcatattgct

SEQ ID NO: 13851 - DNA, 13473 bp, Oryza sativa
ttatattactctatttccaaaaacttcttcaccatctgccactaaaaatcaagaactacatccatgaattcttttgattttttttggaattttcaatttgctcgaatttcattcaaaccatatcgcggaaaaccgttactgtgccccgacggtaaccgcaattattgcgcgataaggtaaactctgattgaacgatgtagtatgaaatctgatactccatccatcataaaaatataacacatatataaggtagagtctctctacctttttgcttaaaaaatataacacatatatctctataagtgaatggtgaatcccaagaattaactaggatgagccacataatcaacaaaataatagccactggatccacatgaagacaaaatagaaagaagaaatctgagccattggattcactttatctagaaacttccttaacctactaaaaaactagtaaggttatggatatgattttacaatgtacacttttatttaaaaaactattttgcaaatataccctattactctatctatgcaactttcctttgaggaaaaaaatacaaatagatcattgacctatatttagaaatattcaacaaatgttgtgcatataattttacaactctcacggtttacaaataaacctcattttttaataaagattaatatgatccaactaagctttatatcattcaaagttatatatattagtgatgagcatatatatgtgtgtgtgatatgctgatgtaactattagttatgcacccattaaagatgttatgattaatcatcattacaaatttaagcttattattgctaccacaatctatagacatatttaatagagagggagtttatagttgcacaatgcacaacttaatataggatgaaccacataatcaacaaaataatagccactgatccacatgaagacaaaatagcaagaagaaatccgagccattgtattcactttatctagaaacttccttaacctactaagaaaaaacagtaaggttatggatataattttacaatgtacacttttaattaaaaaactattttacaaatataccctcttattctatctatgcaactttcctttgaggaaaaaaaatttacaaatagatcattgacctatatttagaaagatccaacaaatgctgtgtatataattttacaactcacacggtttacaaataaacctcatcttttaataaagattaatatgatccgactaagctttatatcattcaaagttatatatattagtgatgagcatatatatatgtgtgtgtgtgtgtgtgtgtgtgtgtgttgtgtgtgtgtgtgttgtgtgtgtgtgtgatatgctgatgtaactatcagctatgcacctattaaaaatgttatgattaatcatcattacaaatttaagcttattattgctaccacaatatatagacagtatttaaaagagaggtagcttatagttacgtgatgcacaacttaatatactagtatacttgagtagatacaacctaataaaagatttggtactatatttttttatagtactatatggtatatatcactatattttattttatgttggaggaagtattcataggaggatatttcatctcgaacctatattaatgaattgacctgcagccggtctgagtcgaaggaggtattcgtcatggactatgactccttctacgagtctcctgcaaatctcgagtctcagccgtctaaccaaacatattaatgcacactgcaattgacttctgttgctagtcccctctagtcgtctcgcccgtccaccatattagtgcacacgctcatcatgagtaatgacaattgatccattgaaccaggggttagctagacgtgtttttttttctcaaaacggattaggaatcatgcttctcatcttaatttgttcatcggcatttcttaaaaaaatattttctaaatcgacttttcaaaatttaaaatatatttcttttgtttgttccttcaaattaatttctacaacagaaaattataaaactttatagttattttgggttggtaatcatcctatataataaagaacgatccaacggctatggtattcttgatgatgtgtctacatgtaattgcagataaatgaggctaacttgtataggaatagtatatttggtcaagctaaaagaagtgacacgtgaaaatataaaatttagatatggaacaaaaggattggaagattattcagagctgagaaaaaactacaataacccgatggtgaaatttttaattaatattttaacatcttgaaaagtttgcttatagattcagatggtggtaactcgaagctaataaacacaggagtgagtgcaattcactggtttaacatataaaatgttacatacacgtggtttatttgcctattaaagaaagttgaaaaaatacctaaaagtttcaaagcaatttaaatttacagaagagttgagatttgctaaaaccacatacatgtagaattggaggaactattaacttttgcatggaagtgcatgcatgtgggctggggatacattaatgcctacaccctctattttgcaagttataaacattcatggaaattttagcaggaattaagactaaagtgagaaataattgtgattgcctgaaatgagaatgtaaattaattaatttaacaagaaataattataattggatgagacaaacgagtagatggagaaatgtgaaatcctataacacttatatttaaaaatggaggaaataaatttatcaatggtgtacatgtcctttgtacgtggaagccagaacagaagtagagccacaagcagacaagctaacagcaatttgcaccagtccagaactgagaatgcgttgaataagccaagacttgggccgagtttagttccaaactttttcttcaaacttttaactttttcatcacattaaaacttttctacacacacaaactttcaactttttcatcacatcatttcaatttcaatcaaacttctaattttaacgtgaaataaacacacccttctcgagcgggttctaggtctttgggtcatagattaatttgagaatgtgtcggcttctaatttcgtccaaggcatgagtcaagtcgtctcctatcataatccatgaaaaatcagtatataattaagtgtcagtgtcaaacactggactaaatttaatttcaataggtgtcaatgtaatgagttgactaaatacgagataaatccaataacacataagtatatactaagtatatatgaaagatcaggaaaaaaaactaattatattgtaatcatttagctcttttctatatagcaaacatgaacatatgtcgaactgaaacatgcatgtgccctaactgttgggtgtgtgtgtgtgctgctgggatcgccactgatcggtgttcaatgtttcttaattatgctttccattaatacattatgacaatataatgatcagaactccagaagagtacttggctagcttgccacttgaattgttgtaatgtgaaagatcatctgtgctatatttatcatcaccaggattcaaaatgttggcctgtaactatatagaaccagagacccattacgtaaatttaaattaattgttcaaattttgaatttatatttaaagcttatttttccacacccggttataggttggtaattaacctcctagttgctgataattttctttttcaaaatttcagtttgcaatttcgtcctgtaaatttccggtaaccagcactccagcagtaattaattagccagttaccggtctgtgttttcttttttgttaattaaagactgtcatggtcgggattacgtacaagcgatgaagccagagaatagtgacaatgatcgattccatttgttttgattcagtttgtcacttgtcagcttgttatccttgagaagaccagtagcagggccgtcccgtcaaattcggaggtcctgtgcaaagttgaaggataacaacttaattgatgatataatatgaaaataatttatactctgtaatatatttcatagcaatctagaatgacctaaaatgataatccaaaattagggattaccggattagaaattatcagaaagaattagataggggcgcggcaggcgtcaggtggcacgaccgcacgagagaaagaggtgaggcgtcgtttactcctctcgttcgttgtgattggcaattggcgaggttcacagtgggaggcgattcaagattgtgaaccggtgcaactgtgcgaaccggcaaaggcgtaatcgaagccgaaacgacgagaaaaataacagattttcggaactagctgggctaccaatttacttattgagttgtatatctagtgttgaagttttgggcctaggggccttaaaaattgggggccctctgcgggcgagctggccgcacacccctacggcttgtttggcaacttgaaggaaggggattgtgagtttacacgagggaattgatggttagattaagatgggaatttgatttttaatcccagtatcttatttggtagatgttgtggaaattgatagggagtttagttggagattaggtcattaatgaaaacggatggctgagatttgtttagacaaaataaatgaggaattccctcctaattaccatcccctacccaggtattgaaaaggagggagttcctccctcaattccccatctccatcccaccaaaaatcctatgtatcccattcaaacaaagcagttaatagcctaatccctctaaactcccaattccttctaaaaactccctccaaccaaacggacggggacggccctgaccagtagcaaaacaaatggaattggttgttgctaacaaatcctgtaattgaagtacaaatgcgaatacacctagatgtacccaccttttatatgaacacatacatatacattaccaatgaatacacatctaaaagactaagccggtatattgaaaatatattgaaagtaacgaagtaataagagctttgttgtagtttggcacatatctacattagtgaaaagtaaatttcaagatttcatcacaatgagccacgtcacatattgattcagggccattggatcagaagcaaagaaaaggtgaaatgaatattaaccgtccgatgtacagagagaaaggcaatcaaaaagtgggattctagacaattccacgataccttacccagcgggagaacaaaataatctactactacttaaaaaataagaggtgcttccatcgtccgtcaaaaaaaccgggtaaaaaaaaccgggcagaaaaaaccaagtttgtccgataaaaaaaccggacgaaaaaaagtccgatccaaaaaaaaagtgaaaaaaaaaccgggcgaaaaaaacacccgtccctggtaaaaaaacacccgatcccttaaaaagggaaaaaaaaagtccgagagacaaaccgtttaatgaataaaaaaagcgaaaaaaaagagtccgattccctggagaaaaaaaatctgatttccctgaaagagatccgatctgtattggattggagaaaagaaaaaaaacacttctctaggtgcttctgtcgtccgtcaaaaaacgggagaaaaaaaccgagcgaaaaaaaaagaaaagtccgataaaaaaacctggcgaaaaaaaaccgggcggaaaaaaaacaaatatgtccgacaaaaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcatggagcaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaaatttgtccgataaaagaaaaggaaaaagctgaaaagaatctgactccatcgacgcggtaaaaaaaggcgaaaaaaaactttccgataaagaaaaaggaattatatgtgacgcggtaaaaaaaataaaaaaaccaggcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccaggcaaaaaaaaatctgtccgatccaaaaaaagggaaaaaatcaaaacgattccgactccgttgacgcgataaaaaagggcgaaaaaattgtctgtttctaaagaaaaaggaattatacgtgatgcggtaaaaaaatcgaatcctattatatcttgaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgtgcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagtaataataaaaaaaagagagagaaaaaaacagctacaacaacgaagcgaaaaggcggaatacggaagcgtggagggcggaggggtgatgggctgatggcagatgtaactaccttattacaatttagtcctacgataaaaaggattttaaaaactagcctcataagtacaaaatgtatatccatgttaattaaataattagccctatgctagggatataaatttatagctaacaactttagtacctctacatatgtgaaacaacaagcgttttaaaaggaggatgagctacatcatctacaatgatatggaccgttcgatgaactggtaaatgaaaatacaccattggatcatcatgctcatctatgactgtggaaacacgttgaaccaatccggatgattccagatcatcatgctcatctcaaaaagcagagaactcatgtgcttagtctatttaacaataccgttcaaaaatagtctttttaacactatacatatgtttaattaatctcctgactaaataaaggaaaaaacatatgacgtcttagctgtaaatttatattgaatttatatgcaaatttatatctataatgtacgagagtgtacacacaaatgctatgttatactactttttgcttggcattggaacaacacacaacaactaagtagcatccactacgtaccaattttattttaaaatagtccatacgaatgcacacacgcacaccctacagttaggagcacttagtgttattactgtctccactctaaaatataggtgccttaacattcaaaatttatcctaacattcaaaatttatcctaaaatatagctatttcttcttctactccctcatcttaaccaacatagtcatatcctatttaatttcttcgcctattttctaatgtcaatcaattacaacgttcctccatttacatctctagctactgcatcattcccaaaataagtatttctataattcaaattttatatacaaatataaacatttctaagacactaatttcaatacatattggagtagctcgtgttcggaaaaagccaattggagtagctcaaattaaatttgatagtaagtgaaaaaagagatcattcctccttaatcttactctttactaaacaaactagaaatacttatatatagaaattaatgaagtatattagagaacaaagaaaataacgtacttacgaaaccagtcccttcaattaatatcaggatcaatggtctaattatataggtaggttatgctaacactcagagtcgcgcaaaacgcgactaagtagctagtctataattgaaaactaaatctagaactcaaactttcaaacttaattagataaaattatttcaccattaaaaaaaaatctaaccttcgatttgtactacgtacgtacataatccggatcatgagacaaaggtggtgttcttttcttctaaagatgaagatgaagattaagttttttatgcaaaacgatttggtattaacgtatgattaattgagttttaattattacaaacttgaaaaatagattaatatgatattttagagcaactttcatatataaagttttcgcacgaaacacaccgtttagcagtttgaaaagcgtaccacagaaattttaatcttcatccaagtcttgttggagaaaagaacgaggccaaagcctgttttctaaacattaatcatcaaaccatgtttttttttttgctaaaaccagtttcaaaaaccttgatcatcacaccgtccaacatgcttttccaagtttccagcgtctagtcaactttccgggttacacaaatcaaacaagcttttattattattttttgtcaccagtttatacagctcagtaatttacaccaatcaaacaagctttgaaaggatcaaagctcacagttaagcatttacactcgtctaatttggtccatttcttcaatccccgccattaatacctttgacttttttttaaaaaaaaatagacttcatccttgatagtactttttaataaatcactggagggatgagattcctcacaataattttccattacaaaggattgaagagaaacaggattctttgaaacaatataatttttttaaacaccaccataattgattggccgcgttataataagaagagtgcttcattttagagaaaaaacaataccaaaccttacaataaatagttgataacaggaaaactgtgctaaaaccccagacacgacctagctttcctaaccaccaagataggactagcaccatccaattggacgactccgacttccccagaaaaatcaagggaacaagatgtcaatagcccgaccgataccaacttctaactccctggacttaggaactgctccctccatccataaatatttgacgccgttgactttcttaaacatgtttaactgttcgtcttattaaaaacttttgtgaaatatgtaaaactatatatatacataaaaatatatttaacaatgaatcaaatgataggaaaagaattaataattacttaaattttttaaataagacgaacggtcaaacatgtttaaaaaagtcaacggcgttaaatatttagggacggagggagtacatccctatgtctatcagggtttaactgaacatgacaggtcgtgtacaaattcaagatgagaaatgaggacccaagtaaatgttggactagttcaagagatgtacattcctcttttaatgcctacactatcgcagcaagagcacatcgtaccaagttgaacaaaaaacaagtggcagagctctataagttcttaagtactccttgtcatgatgcatgcccccttcaatctcgatctgttaattaaatccatagaagagtgaagcctttatttttctcctttttcgaggaaaagagtgaagcctttcaatctcccgttggtacgcttctccgaactctagctacgtcgaaaaagtaatgcttatcatttgattgatctcttattttgtacttgttgtgtatcacctcatgcaaaacgatatatcttggcctcaaaaatagttctttcgcatagaaaggctttatttgcaaggcaaatacctgattcttttacatttacagttataaaactgtcacgatagcggcattagtagacggcataacgctattgaagattcaaacttgacaatactgagacaatttgttaacaagatttagccaaaatctacaacccgaacttgataattataatatataaggaatcaacgagccttaggcctcccagtcgttctcttgtctagccatgcaatcatctcagatggtgcatctcttgtttaaaatagtctaaaataagagtttagctacaaatccaatcactaactgacaatgtaaacatatttaatacaaactctaccttggcgagtatgctacaccaatttgaattagttccgtgtacatttgaatctccgtgcacctgggcttaagctcattcattgctcatgcggagctatctgataagccttcaccaggtcgttcataactagacaaattattttgtggatttgctctaaattggttttttccaattttcctagcaaaactatagttaaaatttgtttgtgttcgtatattgtgaattgtccattttttctcatgtaattcaataaggtatgagagttagatgttttaagttcaagtcctaggtagcacaattaaataaaatcgtataactcatgtatattatattcgacgtttgagatataagggaccattgactaaggaagccttgagcgaggggaagttttccaatatagtgtggggggagtgttggaatataagtattcgctcgtcaatttaattaagcttttagattgaattgattggtgtccgcaactcaatattctcaatatatgccgcagatcacacctagacaatggaggttagcatcggcaagccagatgacgggcaatcgcttcttgctaatgttgaggcctccgatgaccatgccgcctttgatgccatggccacaagctcgcgccgtccacctagcttgcgccctctgcggcaccccaatgtgacatcccttgcaccagtaagtcacctcatactcaaacttattgatccattaattctgccatagcagacatgaacatgaaagggtgggtgagaccgtgtttagatgggactaatcttttaagtccctatcacatcggatgtttgacactaattataaatattaaacgtagactattaataaaacccatccataatcttggactaatttgcgagacgaatctattgagcctaattaatccatgattagcctatgtgatgttacagtaaacattctctaattatggattacttaggcttaaaaaatttgtctcgcgaatcagctttcatttatgtaattagttttgtaactagtctatatttaatactctaaattagtatctaaatacagaaactaaagttaaagtccctggatgcaaacaccacccgagtcattgtcgtttgtcttctttacagttgccaccactccatcgctgtgtaccacgacaaaccgaggtgatattcccgccacttgactcaccggactcctccgagctgaagaaggttatgtccatcagcctgccagcaacaccaaccggctttgccgcacctgttgccggtgccagcgactcgtcgggcatagatctccggaggcaagccatggcgtcgaacatgacacaaaggctacagcagcgctcgccaacgtcgcagagcaacaacggccggcggctcacagacgagacaacagcgttccagtcacccccgcctacccccggtggcggccggtcgtcgatgagccgggacaaacgctatgattcattcaagacgtggtcggggagactcgagaggcagatcagccacctggcgggcatcgggccggacatcccttcacctgcagggcaagtcgtggatgccgccatggatagtcaccaccattctcacactgtgtccacgcccgaggttggccgcttctttgccgcactggaaggccccgaactagaccaactcagggtaagctatagaaaaataaatgaaacaaccaaaaaataattcatatatatattagcggtttaaaagccaatgctgaaaaataagctacaactcgtatagtcggaggaggagctggtgctgccggtggataggacatggccattcctgctgcggttcccggtgtcggcgttcgggatctgccttgggatgggcagccaggcgatcctgtggaagaggatcgcggagtcgccgccgacgacgaggtacctgcacgtcgccgccgacgtgaacctcgtgctgtggtggctctccgtcgcgctcacctgcgccgtctccgccgtctacgcctgcaaggtggtcttcttcttcgaggccgtccgccgcgagtacctccacccggtcagggtgaacttcttcttcgcgccgctgatcgcctgcctcttcctcgccatcggcgtgccgcggtccgtcgcgccgtcgacggcggcgctcccggcgtggctctggtacgcgctcatggcgccgatgctgtgcctggagctcaagatctatgggcactggatgtcgagcgggcagaggcggctgtccatggtggcgaacccgtcgaaccacctgtccgtcgtgggcaacttcgtcggcgcgctgctgggcgcgtccatggggatcaggaagggccccgtgttcttcttcgccgtcggcgtggcgcactacgtcgtgctgttcgtgacgctgtaccagcggctgccgacgaacgaggcgctgccgcgggagctgcacccggtgttcttcctcttcgtggcgacgccgagcgtggcgtccgtggcgtgggcggccatcgccggcgagttcgcgctcggcgcgaggctcgcctacttcgtcgccatgttcctgtacgcgtcgctcgccgcgcgcgccgtcagcctcttcggcggggtcaggttctcgctggcgtggtgggcgtacacgttcccgatgaccagcgccgccgccgccaccatccgctacgcggcggaggtggaggacacccgcctcgccagggcgctctgcgtcgcgctcgccgccgccgccacgctcaccgtcggctgcctcttcgccaccaccgtcgtgcacgccgtcgtgctccgcagcctcttccccaacgacgtcgccattgccatcaccgaccaccgcaaggtgaagcccaagcccaagcccaagaccaccatggaggtgcactacaagatggatggcaatggcgacatcgagggcggtgctcctgccatgacgccatcgccatgcatgccgatggcgacggcagcttagaggatttcttttcttttctttttgacctgccaagccaacgcgtccacatgcacatgcatggttttagcggt

SEQ ID NO: 13852 - DNA, 6727 bp, Oryza sativa
ccgttcgtcttattcagaaaaaattatgaaatatgtaaaactatatgtgtacatgaaagtatatttaacaataaatcaaatgatatgaaaataataaataattacttaatttttttaataagacgaatggtcaaacatatactaaaaagttaacggtgtcaaacattttaaaacggagggagtatatggattagatgactatatattaaatgttatagaaatgataggtaaaatttagtttaatatatcgtgaaaataatgtaagtaatgatgatttagcatgtttttatgttgaactttaaaagataataaatcataaatataatattatagttttaggtgtttaatgggtaggaactttagagtaggtataagtttggttacatactttgagcctgtgacgccctagaataatcggggaaaaaaaaagatggagcaggcagcagcagctagctagctgtagctggcggcccattttgctggtggccttgggcccatttgcaataagcataaataaagcggaaaaagttcacttcagttccttcatctgtcatcaagcttcaaaccgttcctaaaccggaatactaaatataatacatccattatctttcaaaaccgagtcacactaaaggtgtgtttagttctaaagttttttttttccaaactttcaacttttcatcacatcaaaccttacttttcagtcacatcgtctccaacttcaaccaaattccaatctaaacacagcctaggtagtaaggcaatgttgcttccggttttaacagacgtagcactcttaaagcaaaaattaaaaaaaacataaaaaaccacgtgggatccgcatgtcagtgaagctttagacggttgacttaagtgaacgagctcctgctcgcgcatcggcctggcgcgcctctcctgctctgttggaccgccgcgcccagagcgctcgaccagtcggcgggcgatggtcgccgaggtgggcgaggaggcgggcaccgcggcggaatcgcatcgggagcggaacgccatcgccagccgcatccgccgcgccgacgccaccgcagcgcgtcgcccctacatcaagtgcaacaactgcggtgatgtccgcatcgtcaagtgtgaccgcgccctctcgacgactggctccgcgacgacttccccaaccaccaactctgcaaggtgcttggccccgatcgatcgagctctttttctcgccgctcctctacgtctaggtacagtacaggcctccatccatcgatcaacagtttattcagcgcatatgtttttgacccaaactcatctacgtgtgaaaattgaaaatcgaactactgattagctgatagttggagagcctatggggattcttggtgaaaatctatgcaagcttgtgtggtacgtcgcaggtgctcaacgtcgcctgaggcggccacccggggcgcgtcctaccgagcacaccgctgcacgagtggttctcgcggagtcgctcgacggcgaggataaccagctgatggtgaacagctaccactgcaccaccagggagggcgtgcaggcggcggctggcggagcggttcgtgccgatggcgttcgatctgcgctccggatgcgattctgccgccgcggcgccggcctcccgccacctccgcgcccatcgccgcggcggtcgagcggctgctgccgtagtcctcagcggtgcgctaggccgatgcgtggccaggagtgagttcgttgaagccaaccggctaaagctccactggcatgtgggttctatgtagttttaattttttttaatttttgtttttagtgccacatcagttaaaaccaggagcttaaccacttaaccactcggatgctatactaagatgaaataattggcctcactctcctttttttttttactatggtttagctaaagggccatgcattgcaatggatactataagagataaaagaaagtaaaattacaagtttatagtattggtatatttttagaggggttgtataggtagttaattagtcatataatgtcatatccaaaataaaattattcacgtgtgagaattttatgctgttagcttataatgtcagagacagatccgaacatcatcactaacattatttaagatagtatagctaccgagagtctgtgagtcttgactagcttgtgagtaatttttagagaaagtaaatcaatttactaggctgtgaaaaaaaaacgagcaagttaacagaaagtacacgcacgaggcgtcgacatacacggacgtatatacgtagacgtcgcggtcgtatggccgtacgtctctctgtattgcttctagaagcatcctcaagattggtcagctgctcgtctcaaccgctgctaaacgccgccaagctcttgactttcgaatagccgtactccctccgtccttaaaaaaagcaaaccctggttttcgtgtccaactttgactgtccgtcttatatgaaatttttttataattcgtattttcattgttgttagatgataaaacatgattaatattttatgcatgacttgtctttttaatttttttcataattttttcaaataagacggacggtcaaacgttggatacgaaaaccagggtttgtcttttttttgggacggaaggagtatagtatatgatcattggtcttttctatcaatcgattcagattttttttattgtacttaattattgtttttgtgattgtacgacgtcgtcctagccattattttaaacagttttttaatcctactgcctctacttaaaaacaaacttcattcgtggctataaatctaaataagcacttgtccaaattcctatccatattcacgtaagtacaagaatcgatctaagtattgaagagaagagcggaaaacctgagtaggtcttatatgtagacaaatgacattagtacattataagaagttctgagtatcatgacagagtcaaaattgtgaagataatttaaggctcctttgaaatgtgggattgaaaaaaaaacggagaaataaaaaaaacactgagttttgactgaaatgcatgcaagtataagatagagattgtaaacacacgtgaaaaatataaaagtagttgtccgattaagccacatgaaaatattaggaattggatgaaagagttaaaagaagttagagctcttcctaactctccttcaaaatcttgagatgattgtgcattccacaagaattttaaacaaaaggttagggttcaaatctttgtttttaatagggattttattttcgattatggttaaaatacaccaaatttcctttttcttttacaaatcaaaggtggcctaagtgccgggacaattgaatttggatagtggtatatacatatactgtaaactaggaaatcataatgttttagcacttcctgaagattgatcagattttttttatggtctctgttcatctctcgaccattaattattcgttggtcgtcccaatctaaaagagacgtcaatattgaagttctcgagccccttaaaatgtccctaaacaataaatagtgtttcttataaatgtagtatattattccttggaaaatatgactaacttagttagaaatttttttaaaaggagagatatcattataaacgaggtaaattgaacgttaccaatcattagaggtataaaataagccaaaatagtttggggttgcttcgagggaataaaatgaatttttcttacaaaaacaaatcaaaacagaaatcctttagaaaacttaattatttcaggtcggcagtgacaatgcaaagcatacaacaaacagctgtctgcagcgacagtcaaaattttggcttttttagaaaaaaaaaaacgtgttcctttaattttgagtggtaagagtcatgggccctgtttggttccatgggctaaacattagcccccaccttttagccatgaattggccctcaagtatccaaacatgtgggctaatttttggttaaagtgaattagcctccctccaaacattagcccctccaaggggtgctaatggggctaattttgcatggggaccataaaaaggcagccctctctctccttctctctcctctctttttactctctctccaccttttagtcttgaattagcccatggatccaaacataccactctgggctaatgtttagcctaccaattcatgactaaacattagctctcaaaattagccatgggctaatcttccaaacaagcccatggaatagaagcttctttgccggcaaattaaatggtcgttttcgcacacgtgcaaacgatgaatcacgtatagtttataagttaattactttcttggaggtatgaattaattattgcataggatcgatggcgtggtcgttgttcatgagaactgagaaagtatgtgggagcttaagatgtgtctagcgtgttacacaggcacaaaaggtatcgtttttggcattgtaaagtaagtaagtcataatttatattatgacacctaatgtttgtaccaacatccaaaaactattgcataaggacaagggttagcctctaccaaaatttaaattttaaaagtaatatattttatggtattttcaacgtagattatttttactttggatttttaagttgctaagtactcctacctatagaaaagtttaactcataaattattatttaagtcattaataagtcgtttatttataatcggctcatggacaaccaataggctctaagaaagaaaactccattttacttcctcaatctattcaattaaattatttaaccctttcaactaattaccccctaaacagttgaaaacacaattcactttactcttaataacatttctctttctcttacttttcctctttatactagtcatatataagctgaaattttgagagccgtagatgacaccatattatcaaagctcaaaagtatttcaatttttcatgactgattgctttttaaaaaatatcattgtttgaattagtctttggttctttcaacctatataaacagtgataataaatttataaaatgttgtgatgcgagttataatgcacctatgatcgtaccaaatttcagtgcaaactatgatttatatagaaagagaaaaaaatggaaaatacaactatggagtaaaatgaattgttttgaatggtttgggtgtaaaatgagccaaaaatagttttggggttaagaatattttgagagagtaaaatatactttttttccaaggacaatacctttttcatatgaatctttttgttataacaaacttggctactttctatattaaggatagactctgcaataaataggggcaaacaaggaaaaccatatataaattggtatgcatgctttatatttgaaacaagatgagaaaaactatatgccttatagaaagaaacagatggggtacatacatttgataatgttttttttatgacttggacgagtagtggctaagctattttgttatttagttgctaacctttcaataaagcatgcaaaaagggtagttgcttgagatagcgtaccatgattaatttatgtatatgttttttagcatatttaaaggcaaaaaattttcatgcatttgtgtacgtaaaaatcgcaatgttatccatgtcatttcacaatgtttatccctaggcaatgtcggaagtatagcaatattactaatactccctccgtttcatattataagactttctagcattgcccacatttatatagatgtcaatgaatctaaacacatatatatagctagattcattaacatctatatgaatataggtaatgctagaaagtcttataatatgaaacggatgaagtagttgtaatatgcatatgctgaggaaaactacaaattgtactgtgagatttatgttccttgatggcatatcaattaattaaacttagctatcctttgtttatttgcatatttgtggagtgattgatggctccatagtatatgttgtcaaattttccatgtttatttagatggcatgcatgcaagaaattaacaataatatatgatcaattttaaggtctaaaaagacttctccatagtgataatagagctgtaatgtgtgtgagtttttgtccaaatgcatatggaggcatgtagacattcatagaaaaagttgatgacacaaccaatttagcattttagccacaaaaccaaaattctcaagtcagaaccaaacagccgacctaggaaactaagcccacatctaatggcgccatgcatgaagataagatcagaaattaagccatatacatcaaacccacacacactgacacagacacatttgcaagaagacatgaattgcaacatacactttaacttgacacaaagctatccataatctctctcccccatctgtaattaatcaaaccaaaaacctctcattatatatccccgataagatatcatcatcacctctatccctatcaagggcttagcgtgggagcagatggctttgtggcaatcaaacaaaggctccaaaaaggcattgctttcatgagggagaaggttaaaaaaatgaattttacattttgtggagtgaaagtggtgtgtggacatgtggctggtgaggccactgttctcccattcatctagaatgttgaattcccagcatcctatttatgttgaaaaatagataggtcgcaatcgcttatacgtgtatgcataatattatgtgtttgcaaaacctatgctccatcaagat

SEQ ID NO: 13853 - DNA, 11174 bp, Oryza sativa
acatgttatggtcatagtgaccccactattaagtgcaaatgaaagtgacctttcatgacttttgtagtactgctatttcatttgagaaaaggctcttggggcaaatcatgcatgcatccttcatgatttccctaccaaatcactacactgcatttatttgagaggaaaatcactctacatgtctagtgttgcctttgtatatgtgtatggttagtgtaataatttatctgccaatcatcacaatgcacttacttgtactgtagttttctagggcttgaccatatgaaaggcattcttcaaccactcaagtattcaatatatacatcctgaataataattacttgggttaccaactggtacatactggattcatattaaccaaagtttaccttaattttctttgtttttttttgaacgaactggtacaaggtggtgcaaatgtaatttaatagatatctaggaaaaaaactttctatgcaagtatgaaaaggaaaggtataaaaaggaaaaagttctatacttaatttttattaatgcaacattaccttctgaaactagatcatttatactactcactctgtcccaaaataagcgcaaccagtttatgtgtccaattttgatcatccgttttatttgatttttttataattagtagttttattgttattagattataaaacatgaatagtactttatacgtgacttatgtttttatttaaaaaaacaaataaaacggacgattaaagttggacacggaaacttatggctgcacttattttgggacggagggactatatatcaaattgaacaacaaaaaaaaatgttcattgttgtgatttttcatattaactaaactgatctaaatcttgcaaaatcttaatgagagcaacattgctgctgactgatgagagaggtagcagtatagcactgtcttctttttccttggaagtcagctgtagctgatgtgatcttcccttttcaagctgttcaatttgtagggcctgatcttccctttgattgctatgcacattgcaatgttctgaaaaacaaaattatggtttcagaatgtctatccatagatcctaatactgctaggccttagaacacttgaagaactacactcatgcttataaggctgtgtttagttcagctcaaagtttggattttggttgaaattggagatgatgtgactgaaaagttgtgtgtgtatgacaggttgatgtgatggaaaaggactgaagtcagcctaagttacaatgatctttacagtgatcgatctgcctttcttgctggtgcaacctatgatcctctacctactcactacaagtagttcctttcaatattttttggagtataataatctaagagcctcgatgtttgccaatcatccaccaccaaaaatttattttggagttaattttaagttatttttaacgtagttacttttttagcgttagttttaagttgctaaaaatctggtttttaaatcttcggctatagtagcggttatctccagctatagctatttgagaagggtctaactgtttggtctcatgcacaatttacctactatagtttcatttagtccgctataactgtttgagaaagccaatcaaaacactgctacaaacatatatatgcataaattttactcagaaattattttttattgctaataagctgttttggcatataatcagcttttggccgattgatggggctgtaactatgatgcattgatctaatgtatgaaacgcattatacttcacagtaagttaaacaaaccaatattgttgagtttattcatcgacattttttttaataatgtattttataaaacctagcctctacaccaatccaacatgagtgtatacagccacttgtgcatagacattactattaattagttagttcatatccagaaaccagtcaatcaagcagaagcagatcatttcagataagggcttattttaccagggcatgacgccaatgacggcaggatcacactaaaagttctgaatttcttaagacagattagcaaaccagttgtcgacaacgtctttactcagaacctgacaaggcaaaccatgtgtagagaactagagatgacacctctatcaaaccagagttaaattaattaccataaagttaaactatagttatggatgcgtcacgcatgctcaaactaaaatatcctatgtgaaattgccaaaaaaaagtatattaaattaattataaatattattgctacacgaatggatgtgataacatctctatataaataacaatcaattaattaccattatcaatggacgtacttgtgtaagacaaactccccaaatatatgatttggtgtaaattattaacaagatgagatcgtcatagaatatgccaaacttgtactacattaattaattaaactgtctacaaattaatggtgacacattggtccacaagaattgaactagatagtcaacttaatcgcgcgcaattcctttccatggacaggaaattggaataggtatagtactataattttaagttacaaattaagatgagtactgaataatatttgcaaggcacgaatggaaagcgacacatatacatgcaaaactgattttggaattatcttttcggaggatttggatacgctaattatattagggagttacctttcgtgttatcgggtaattaagttccatgaagtacctaacatatattttaacatgatgcggaggccagcttggcgcgtgaggcgcgtccggtggaggaggccggcttggcgcgagaaacgcggccggcggtggaggaagcgacctaggtgtgaggaggacaagccggtgggtgtggtgcggtcttcggcgcacgaaggctggccggcgggggacgccggtgcaagggtcccacatgtcggcagagcttgcgtggtggtggagcatcggtgcgtcagccgtggattcgcaggtggtgagcggcgggtgaaaacccagtctggccttggccggaccgacaacgatggttcattccccctcctgagggcgttgtcgtgctgtctcacccctcaagggtgattgccgggtgaaagcccagtcttggctcctttgagtcccgacggacggcggcggtagttttttcgtcgcttctcttcttgaagacgccgttttggcatcccctagggggcgatctcgtctgtgtccctttgttagtctagtggcagtcggtcatgcttagcggcggccggtccggtgttagtcttctcctggacttgtgtgttggcaatgtcggtgtgtgggtggtggcatatttttttcctggttacgaccctccaaggttgtaatcttgtattttttttctgctctatcaatagaactttgcaccatctcgtgcaagtcgttcaaaaaaaagactagtttacagtgatgggggatatatactctctacatgcagacttcctcaaactattttttaagataataaaaatgttttacatctacatctccaacctctgtagttgcgcacacaactgatgagtttgaatacttcaaaaaaaatgaaaaatatataagaaacaaattggtgggacaaacactcaacttcctcaaaactgaatagaatatatagtgaatattttgataggactatagttgggatttagattcaagtaaaaaaatatgtatatttttctagctttttattgttactagagattccctgttttcctctttgttttatgggggcaaacttggacagtgtcaatgacttacacctaaccagcagttgatgggagactactacatttttttgcagttggtctgtcaaatcattttaggttgtgatcgcctaaccaatgcagcatatacccatcaaacaataattaagcacacatcatcaagggaaaagccagtagttacacaactaaatcattatcccttttgcttatccattaataatgatgagaaaaagaagtgtgagtggggtgttgtctctataatttgtgacttttagtgagtttagaatgcatactagtgtccttgctagtaaaaaagaaaaggacagattagtgtttaacatgtttgattatatatggttcaaattaaatcactcatactactgtggactgtggcgtgtgctttgtacgcttattttaaaaataaagtctatgaatctcaattaaagcaagccattgctgtgcatgttttgtgagtgcaaatctctgctttagctttaaaaataaatcaatatctatatataaccttcaatctaaaattttatcatatgcttcatccagatttgcgctcacctaatattaactaccttgacgcgaaagggcctgtagcctagtggttacaagagtctcagtagcacctgaggtcctgggttcgactccccatgggagcgaatttttcaggatttaacggcgttgtgctttcagtgataggcgacgtacccgtcgacagcgaggcgcctgtggtgacttcgtcaatctctccagaatttgccggccaagtcttcgaagatgctcataggggtaaggtttgcgtgcgtgtgttcataggggtgagtgcgcgtgcgttgtgagtgtctgcgttgtactgtgtaattctcaaaaaaaaaatattaactaccttgacatgaaattagtagacttttgaaaagaggtgtaccgaagcaacgccctacctgcacaaaataagcaatgtagtatatggagagatcatggcaggatgaacctagctaccagtcaagtatctttagggcatcaattaattcttgccttctattatgtactttactctttgagaaaatcataatatagttctgttttggactaaggatttttttaattagtttagttatgcaaaatttaacattgtgccaaaaacatcttctcaaccttataaacacaaaaagtccagatatgaaggccaaatggtgcaaaatatccagataaggaaaatatatgacttacgtgtgatccaagaattaggcccaattggaatatcgtgcagttccttcgagctgttcacaaattagaagacagagcagatcatttacgcataattaattacgtattaactataataaatttgaaaattattttttaaagaaacttccatatagctttcttgaaaaaacaaaatattgtttaccaatttagaaagtatgctaacgaaaaatgaaatattgtttcggttgttcaaaaaacttagtcttacttcggaaagggtacacaaaactagctaacttggttagttgggtatacaacgtaatactagcatatcaaaccaaaaccatgggtttcctaaagtctagctaccggttttcaaagggacaagaagttattagtgaatgatccatatcaaatcattgtatcagcagataggtgcaaattaccactcttagctaggcctcattctcccaattatcaactctgtggtcttagcggtcatggaaacaaataagtcaagtaaaaaaatatcatctaagaaaacaaagactcggatatattcaagtatgtagtaatagtagtagaaaatggatgaaaacaactactacatgcttcaaattttcgtatgttggtaattgtatatgcaaaattaagggtgattgcttgcatatcatgatatcgttatagtaacaatgtagttgctttttagaaaaaaaagggataaaatatacaattgaaaaaaatagaactagaaatgattgtttggtgcaatttagatttaacctatcctttctcgaaagatgtattgtgcatgcaccagcacctacctgaagcagacaccttacagacagaacaatcaagtggaaagggacaaacaatattcacaaggtgaccataatgatgcgatggtttctcttgtagttccattggaaaaaaaaacataaaaatcaaaaccggccatattgtcaaagtatatataagcatccatggttcatgaaaactagcaaggggcattaagaaaatgaatttggacaaataggtttaaaccatactctttgcgatttttttagttaaccaatgattctttaatttagattccatgtgtaatgtataaatcatcaaacaaagttatttacgtcgaacaaaataggaaataactagggtaacaagccattatttacatcgaacaaaatagaaaacaactagggtaacaagccattacttgtatcaagtaatcacgggaacaactgtaattggtattaaaaggttgttgctattgatatttcacaagttctacaaaacactaaaatatatcatgctatccattcactcattcatgtcctgaaaaatcaaaatgtggtgttgtagctgataaatccaagcctagaccaccttgcaaccaatccaaccgctgtccatcccagcaaggaaaatgagatagtgttgctatcaaaagacaaaaaaaaatgtaccaaatgaaatcataaactacacagagaaaaccatacgatgtatctggacatgtacaccacacgcgagagtagaagatcccggaaagcacgtcatcaccgctctttggtgcgcgctgtgcttgtaggacggttcaccaaaatgttcttgatccaaaatgggagataacggttttcctaatgttataaaaaatgtttaaaaacagttgaatcccaacacaatatgatcaaattttaaatattagcttgtattttttttgaaacttaatcagaaaggagccaacgtcaaacttcgaattttaaaacttaattttagagttgatttgatgtttttttcggcgtagtttttttcggctttaacttttaagttgctatggatggatatacaaaaattttactcacaatttttttctcagtaataaactgttactaccttataatcagtcataaactaccgatgagcacggtcattccggggggatttgtttttggccttttggaaaaagaaaaaacgccgatccctactgagcacggaaggcatcatcccggccgcgatgcgcttgtggccgtgtctgtggcttcctgaggccgcgccacgtgtacttggtcgaatcggcccggtccaaccgaaagcgaggtgggcagtgtggagcccaccagctgggccgggatgaactgtatctttttgggagggtttgtttgtgtagaactgtagatcaatcagtgggtttggcttgtgtacgtaagcatcaaattatcactgtcaaatatatacgtcattgtccagtatttaattagttagtaaaattttaactagtctctcagtcccaaaatagttgagaccagatgtgacacatcatagtataataaatctagatataagtgtgtctagattcatcataatatgtcaaatccgataggaagttgagtttattttagaacagattgagcagttcttaaaaaaaaagtacactttgacgtgtgacagtcacttatactgccagtttaatagctccaacccacacaatttttttaatatgttgtatagagtttgtaggctaaatcagtggttattttactgattttgctagaaagctgctaatattttttcctctcaaaactaattttcagtttgtggccatccagttgtcgaacccggaatccttggtgggaagccacgttagccaaccaaccatgagtaatttttagctgaatttacactagttacatatcgtatatctacaatataagtacactttaattatattatagtatatttgatttaaaaaaaactgacgaatttgtatagctaattttttaaaagacaaatcagtggcttcgaaccactatttatgttcttccataataatcagatgatggctcaccaataactttgtctaacctaactctatctcaaaaacctagctctatctcaaagaatatttagagctaagataccaataaacccaatgaatactttgaggctggttgtacgatactaccatctccattctaaaataagtttatttttcacttatcccacacataccaatacaaaaccacaaatactataatatccctacttattaaatatctcaatgcaaatatttctcactttatctactcccaacataattattttcttttttataaactctaatgcaatgattattaaaaataaacttattttgggataaataacaggagctaatagtaaacttattatgagatggaggaacaggaagactaaattaaactgaaatgattgtgctttttttcgaggaatgattgtgcgatttttaaccattattctaactgttaatgtgattttcaaaggtacatttgaaatgaagtagttattaacttatttatatatcaaaataggcagcgatagcgttttcagaacacgacagttattacaatatcatagtatcacgtgaacaaccgtgatggttgatatgaccactaacttctatatagcatcgatatatacattttttattattttgaataatttcatatggtttgtttttttttttcatgttggatgtttggttcttaccaattaggaactatcatcaaaattgaatatacttattttgattggtacaaaactgtcgatgttttatatataaaagtattgtactgtttttttctctgtgtagctaattttgatattcatattaagttatgctataaatgacataacagaggcttccagtttttatagcaacccctcagtggccacttttttttaccaggcctccaaagccatgattattaaggcgctatgaatctcgaaggaaattcataggaattttagagggtttcattcatatatgattttttactatatagccctttgaatcaaaggaatagatcctatggaatcctatggaattcctatggattgtcttttcccatgcaagttttgaaggaaatttaacatgaggtagaacctcatggaaagaatcctttgtgtctttatctctcctcgaattcctgtgtttttcctgcgacccaatcaaacagtcattcctatgtttttcctgtgttttgcaatcatctgttttacacttgcattcctgtcagaatcctatgtttttcatattcctctgttttttcattcctgttattcaaaggggccctaagggcttgcttgtttgtgttgtggcttataattttaaattttagaactttatttttaaaattaaattaaaggttttgttttataagtttattttcatttgggtttgactttttttaatgaaacacattacaaacgaaaacgctcataatatgtgcacactcacatctataaatgcacacacacatcctactcctatgagcaccttgagaagattgagtccaacatgatgaagtcaccacggatgtctcgctgttgatggatacgtcacttaccactgacagaataattagccgcaaatgtgagcacccatgtcaattttagaacttgaacccgactaggttggtttcagcaaaataaactaaccagttaaattatactcacttcaccttttgggtttgacttttgaccgcatatagcagaaaggcaaaagccttaatttaaaattacaattttcgttattatagaaaaatatattgaaaagtacaaccacagagtttataacttatttctatatatatagagagtaataataacatagttaaaatgtatacttgcatgtttaggcatggcggataataaaaataaaaaataaagcccaaaaccctatcgaaaagatcaaggcaaaatttactacagaatacttaaaaaacgtgtaattagttgtgggacaccgcaaatatgtgaattggctataggacatcccaaaagagtgataattagctactaaacaccggagacattattttatcatttctggtggaaacggagagaggaacaatggaaaaaggaccagatttccctatgtgagccaaggatgtcagcatctccactattttcatgtcctcttactcctgatgaggcacaccacacgcaatacggcgccgctgacaccgtccttctccatcacgccggcaggctcgtacgcaaacgtgggtagggcatcgatggcgtgataattagctactagacaccggagacattattttatcatttccggtggaaacggagagaggaacaatggaaaaaggaccagatttccctatgtgagccaaggatgtcagcatctccactattttcatgtcctcttactcctgatgaggcacaccacacgcaatgcggcgccgctgacaccgtccttctccatcacgctggcaggctcgtacgcaaacgtgggtagggcatcaatggcgtcgcggacactcacatcgtgcccactatgccacgtcacgctctccgcgcgcaccctcgccgccctcgccgccgcctgcgcacagcgatgcagccgcaaccggcgaggacggcgacgccaatgcaaggcggtaggtgctgcatcgacgagaagtggtgctattccatcggctccttgccgtggccgccagagccagtgcccgaggcagcggctgttgctcggcttgctcctctcgccttgcttgcgcctgggctagcatctgatgcacctgcaccgccacagccccagacggcggcttcttgatggcatgcgactctaacacaagcaaacgacacgggggtatgttggtacttccagcgctctttctctctctgtttccactagaataataaaataatgcatcaagtgtctagtagctaattaccactattttataatatcctacagccaattcacatctttattgagtcccacagctaattacacgttttctgagggtcccgtagcaaatattgccaaagatgaaaaccacatttccatcagcgcgcgaaatcccaatcctacccctgcacaatgacatccaccgaggggcaagcccgtcatttcagctgcgcccacggagtccacttccccctcctcccccacaacggcgacaataccgtgagccacccgccgggcccacctgtcaacgtcccctccacccactacgccacgtcacccccctcccgcctttataaaacctcgcgaacaaactcctcgtcgtcccccctcctcctcgtcgtcgtcgtctcacccaacgaacttttccggcgaactccccgacgagatcgatggccgccggcgaacggcaatctaacaaggagtactaggacgcccttctttgttgtttcttctcggcaagatcagttggttggcacc

SEQ ID NO: 13854 - DNA, 6478 bp, Oryza sativa
gcgccggcgccggcgagggtgtcgaggttccggaggctgcttgtgcgggtgtccgcggagccggagcgggcgggcggcggcggcggcggggaggtgagggagaaggaggagaaggcagcggagatggaagtggggtcggtggggttggaccggatggtgctcagcttcatggaggattccgccgccgccgccgtggagcggcccccgcgtggccgctgcggcagctgcttcaacggcggcggggacggcagcgacgacgaggagttcgacttcctcccctccgactcctccgccaccgccgccgcttcggccgccgccgccgccggcgacgccctggacgcgttaaaggtatagggcctttttccccggctcgattgttgtttccaattgctcgccggagtgatcaacgctttgtgtcgtcgcagggcttggtgcagagcgcgagcatggcggagaggaacctcctcgccgacgcgtcgaggatcgccgagaggtgccgcaagggcggcaagaagaaggccgacgtccgctgcgccgtcgccgacggcctcgccgccctcggctacgacgccgccgtgtgcaagtcgcggtgggacaagaccccctcctaccccgcaggtaaactaaacctcgcccccaattcgatgctgctgaatcgccggcgctgaccggcggcgacggtgggcggcgcaaaccttgtgcaggcgagcacgagtacatcgacgcggtggtggcggcggagacgcggctggtggtggaggtggacttccggtcggagttcgaggtggcgaggtcgaccaaggcgtaccgcgcggcgctgcaagctctcccgccgctgttcgtcgggacgccggaccggctcgggcagatcgtcgccgtcgtggcggaggccgcgcggcagagcctgaggaagaagggcctccacgtcccgccatggcggaagccggagtacatgcgcgccaagtggctctccccgcaagtcctccgctgctccgacaagccgccgccgccgccgccgtcgcccccgcccacgccggtatcgctctccagcttctccggcgagttcgagctacgcttcgacgccaagaccccaccaaacctcagcgccaccgccgccggcgacgacaacgacaacgacaacgacgacgaggtcgaggcgaagaagattacgatggtggtgtccccatcgccgtggcgcccggtggagccggaggcggcgagcaagaaaaggtcaccgccgccgccgccgcggcgccccgaggggaaggtggtgaccgggctcgccgccgtgctctaaccgcggcgaagaactcactttactacactagctaattaaccagctctcctccctcgccaattttctctgttttttttttcatttttccatcgccgctttgatccgtccgaggcttagctcatggtgttttctcagttttttttccgattttttggaaaaagacatttacagaaaacacctccatttttcttttttcttttttttattctagaacaaattttggtttccacaaaagggaagtgcaaggagcagtagctgtgacagcttctaggccccctattgttgagaagaggatgaaaaatgaaagtatgaactagagatatgcaacattatctggttgcttaatcagatcttaatcactacttgtactagcgtgagtgtatcatatcacttggtatcatcagaggctcagagcaggcagtaggagcagtattaaaaaatatgcaagtatggagtactactagtagtgatgcatacttctaaaaaaacctgcagcgtaattatacttcactaaccactgctgcgaaaatatttggaattccaaattttcaaccactttgccacaaattagatagagcaagtaaaccaactataaacatacatatgtgaaaaagataacgagaagtgaaaaaaaaagagagctataaatttatagtcaaattatagacttctaataacaatagactttaacatgttgtttgtgtatgtgagagcttgtttgtgtatgtgagagcagactaaatattaatagtgtagtactacctctgttttttaatagataacgccgttgactttttctcatatcttttattcgtcttatttaaaaaatttaggaattataatttattttgttatgagttattttatcactcataatactttaagtgtgatttatatcttatacatttgcataaaatttttgaataagacgaatggccaaacatgtgagaaaaagttaacggcgtcatttattaaaaacggagggagtatatatttataggtaactaagggtattagcttactagattaattatagataatttgaagctaatagtagattgtattattaaacttgttcctagtccatatttgttctggagtactctattagtcctgaaaaaaacattctagaggatgaatctggataaaggtagtctaaattcatccttataaagggtcaggttggttttttttactagggagtaaagtttaatcttccactttgaccatgacagttacgcgcgggtgacggttacttttgcgagtggggcccaggtgtcatacaccgggggcagaggcagcggtggcccacgtgggccccaccggcgggcgtgcgggcagcagacgagccgtgcgggtgcactcgtgccgtctcgggagccgcgccggccgtcccatgacgatggcgtgcgtggctgcgcccccaccaactctttactctctctccctctctctgtggacttttctcacctcggttttttaccacccatcggtaaaaaaaaaaggaaaaaaaactgtgctccgaccgatgcttcataatttgcgatttcgcggttagagcaaaatatcccactactagctcttcaaatcacctataactaatataatagttaatttatataataattacttgctatactattatagctggtcctacctatcatacacacattacgtcttgaaatccgtactacagttggctatagatttatagctcactgctcttatcttttttttatctttttaaaatatgtttatactggctattgtatatgctcttaggttgagaaaattttacggtggccgaagaagaggcaggcagtttgatcggcgaatccaaggtgtgtggggggtggtaaaaagttaacgcgaggaacggtgaaataaaaaccaactgtagtgctgttttgcattgcgttgcgcctcgaccatggaagacgagctagcgtgtgcatcgtgcttggtaaatttatgttagctttggaagcaacgatcacgcctttacggtttgcgaaacacacgcccggggtcctcgatctacctcacccgctcctcaaactgtttctagcaacaatcatccaaatcaactgtttcttaacaagccggagtatgtcaattcgagtgcgggcataaaaaaggggtaaattaaatagtattagaaagttggcttagaaattctgatgatgttcgtttttaatcgcatcatttaattataggtttgaaaaacatgcctgtgataatccggtggtcattaccagggttcaccgaaccgttttgggtggggttatcgccaccccacggtttggtggttattgtagtaaaccgcacgaaaactatgagggattgtagtccagtttcatttaaaatttgtgacataaatatattaattttagaagttatacaaccaatcagactaaggtatatgtatttattggaccctacgatgtagaaatgacaatattaatgaggggcaccatattcatttcttttcactactaatttatttaagaattggtagaaataaagtgtttgttagatgaagtgagtaaaatagaagcaacttttatatttgaattttgtgccaaatacaagcatttcattttgtacctatcccatcaatcatcgttcattcaatttgtttctcatattatccctaaccatacttccaacttcaaacgtctcttatttatgtttttttttccggaacacaatatggacctaggtgttggataatgactcaaatatattattagtcctaggcactagtttaatatgtgcctatatataagggtcacccttatacatgtaatcctaaaccattatagttgattttgtcttccgtggtttttcctctttacattagaggggttttccgcgtaaaaattcgtctctttcgtatttttttcctaacactaatatttatatgtgtatacatactaccctctattagcatctccgaacatcatatgtgttccgttatcagtggatacgtctctattaaaaaataattaaccgctgatacgagcattcctgtccttatcttttgtaaccaaccttaattagaacttctacaggtgtttatgatttgccatgaagggagtagatacttggtcagtcagtacccgtgaaaccattaaactcgcttttctgctgcactatcggagtacccgtagtcctagtccagtaccagtaactgctcctgttttggacagatagctgttaatattctttaccccgcctgatgtgaatcagcttgtacttgctgtactggcagcaagtacgctgtcccattttcttaatgtgcatcaggggagtaaataaaaataattaaggacgagtctggtcatgactacagtgcatactctctcagtaaaaaaagaaaaaaaaagtaagtctagaactcgatgtgacacattataatagagtgaatttacgatgtgtcatatttaatagtgctagattggtttttagggacggagggagtatatattaccatgcaaaacttttgcattactaagtttcgatagctttcttttttcaacaaagcaaactcatcctaactctactttgtaacttgtaattgaaacaagccgagctcgaggcaactcgcaaacaactcatttggcttggtggcttgtgtggcctacgtgtatttgctcaacaattatggttttcgagattgctaggtgtgaattaatgataataggcaatatatgtactaatataccttttgaggcagaatataccttttgaagcagctgggcaagtgttctagtatttggaaatggtcggtttataccgttataaaaaaaattgcagatgtatgacatatatgcgtcaatcagtccttctgccataaagtttctgagacttattattgcttcatatttgactttttagcggctttatgttaaaaaaaatagtttataataagtggttatagtttctttaaaatactagtagatacgtcgagcccattttgtgaggcctatatgtcagtgggtggtaccaccacaagaaacattcaaatgagtaaagaaaatttatgtgttatttcattatcatttttttttaaaaaaatgcgtgagctgactcgagaaagagaattgagccaagacaacggccgagccggccagccagaacaacgcaacaaaggatctgtttatatctcatctcaaaattttacaccatatataaagtattaaatataggctaaaaaataactaattgcacagattgtgagtaatttgtgagacgaatcaatcttaaacctaattgctatatgatttaacaatatgatgctacagtaaacatttactaataacggattaattaggcttaataattcatctcgtggtttactgacggatttagtaattagtttttttaatagtgttcaaacaccctataaaatatccgatgtgacacgctaaaactttaccctagatctagacaccccccaagacagattctggtcctatactgggctttgaacatatccaaactatcaggcccacggcccatatatccttcaagcccacagcccattccacacacatgtctcgcccggctgacacgtggcatcaatcaggcttccacaatttgcactaatcgcagattagaacaggaaaaagcaaacaaaaataagtccattttaccctgaacccctaaactattttttaagttcaatttacctctaatactactaaaatggtttacttaacattatgtctcttctttgtttttctttatacgagtagtattttaaactaaaatttttgtagtgacatagatgtcaaccactatcaaagttctaaactattttttaaaattcatttattactatttacttgaaatttaaaactcggtatttaatttagtctcattgcttccgatctatgtaaacaataataataaaatttgagaggtaagttataacacatttatcaattctaccaaattttatggcaaaatataacttatacatggggaaaggaaaaggagaaataccatcagaggtgtaaaataagaaaaaaccaatacattactactttatccatttcatattataagttatttgactttattaattagtcaagattctttaggtttcgaccaagtttatagagaaaattagcaatatccatgacaccaaactagttttaataaatttagcattaa

SEQ ID NO: 13855 - DNA, 3372 bp, Oryza sativa
ctccatttgaaacgatggattgacgaaataacgagagaagccaagccaagccatctccttcctcttggcctccgacccctcgctcgcctcgcctcgacgtctccttccctcccgcctccaagcaacccctctcgccggaggaggaaaccctcctccgcttccaatccccaaatccccatccgctatatcaacccgatcccctccccgatcgttcgatcgttcgatcgatctcgccctcgactccaagccgacgagaggagttgaggagttgaggccatttcggtgcgtgcgcggcgggcggaggtgatcggtggcgtttcgttccgttggcggcgggcggaggtgattgctcgcgcggcgtggagcggtggggggaggatccgagcgggagggagagcgcgcgcggatggggtggcggagtcgcgcttcggcggtggcggtgctgtggatgctcgccgctgtggtggcggcggctgcgctggatcctgatcaggacgagctcgaacgcgcgtaagtgcgattcaccagaggcagcttctgattgtttgttttttttttcaatcgtatagcatcagactctgcttttggttgcattctgttgttgcctagcttaatggggttgagattacatggagattccggtgtgcatttttcgtgttcatctgtcgcacgcgatgctgtcatgctgcgaaattcaagttagtacggccgaattgcggctgttttttttcctatctcttaacgccacattggaaatgggcacttgagatgattgtgtgggaagtgggatattggaggggagcaggtagctgctgatgcatggttgaaatgagaaaccaagtggattattcatgtgagatgtggagtaggtagccggtgtgttgctacttgcatcaaccggactaattgagcgtggtgggtagatactttgttggttaatggatgtcaacttgctaagtttcacctacatatgtggataattaagaaagggaagacacatcttgaagatggaaaattttgaagtaattagagcaatagcaaacaaaatgatgacacattcccattattttcctaaaaaaaaaactgaagccgctttcgtgtcagcatagtgtgccccagttgaaccggctttggaactctcagatgatctaaccatatgaaaggcaccttcttaattgttttgatgaaagattgtagacttggttacttaacagaatcatcgtaggtctgcttcttcgacttaatgctgagtgaatgagagtacaacatgtatatggctggtactactagcatcatgcagtagttgtgtttcatttacttgttcatatggaaaacatcatttgctacaacgctcatatttatcaaatcagtggactgcaaagaaaaattattgtggttttggaagttcttttttttttaacaaagatagttgtgcaggtttccaatcgtcgaaccagatcatggtcacactaaactccgtcttgcaaaagaaggtttggaggcaattaaaagaatcgaaacaccaatagctgctgtcgctgtatgtttaaatgggctgtagctcacataaatacctgatagtttgcttttcccaactaatgccaaggcactatatttatttctttgtcgtggtgcatgctgagttatatgtctctgactctcaaatcaggttattgggccatatcgatctggaaaatcttttcttctcaatcagcttctctccctaacatgcaataaaggtacaatgagttcctgccttacatacataccatgctccaggaaagaggatacttggaatgatggattgataaattggctctgcaggttttggagttggacatatgcgagataccaaaacaaaaggtttggtggtgccaatgacaactttgtaatgttatcctaaatgattccatatcctaattgaaggattctaacactctgctccacatattgaaggtatatgggtctggggtactcccattgagttagatgtgaatggctccaaagtttctgtcctttacctggacactgagggatttgagagcatcggaaaatcaaatgtatatgatgataggtttgttgcttatagatgaaatgcatattaagtttgaattggaattttaaatggtgaaaaatggactgttagttcttttgtttttgttgcaggatatttgctctggccactgttttaagttctatccttatctacaatcttccagagacggtgtgtttctctggctcatgacatgctcacctccattctctcatttgatagctattaacttgacttatcttgatcatagattcgtgaagctgatatatctagactctcatttgctgttgaaattgctgaagaattctatggaaggtttgctttctgccattcctatttggagcttacaatttactaagtgcctccttaatgttctaacaaaatttccacttttctgtcggcatttgttgactccagagtgaaggtaatacttaaccttaagtgttagaattatttaaactagaaccactatgtcaaagttacagtgcttgtctctgtaggggcaagatgttgcttttgagccagcaaaactactgtggcttatccagagggatttcctccgtaagtttctgtttgcgttacatatgaacaattttattttgataatcaagtattcctttcagcatgttctgaatactagatgagaattagattttcataacaagaatagacaataaatcacaagtcggaccataaaaagttctaattgccttgtattaatgtttgtacattgtgaggtcggacttatgttgcggtacagactacagagggactagttaataacttgatatgtgctgtatattagcaatagtggaaatatacaggtctcgtgctttattttggtcaaatgtctattgttttgcatttcaccgtttgttgttgctgttttgtttttaggatattaaacttcttttaacattgttaactttcatgaggcagaaggaaaatctgtccagcaaatggttgatgaagctctccaacgggtgcctaacaacaatggttagttcaagttaccgtattaatggtttttatcatgatgatatttatttcctttctttcttcatgaaacaattgaagtggggatcttgaattaacctacttttgtgtattgctgcaggagacaaatatattgatgaggtacaattagttcgagctatatgctaataactggaagatatggcatactaatttgtttgaagaaacatggttttcatgttattttaggtcaaccgaatcagagactctttggcatttatgggcgataacagcactgcttttagcttaccccaggtttgtgaaaacatgatcatggtgggggg

SEQ ID NO: 13856 - DNA, 118 bp, Oryza sativa
accgggagtatcatggccagaggcttgaggcagacgcaatcgcccacgtggcctggcaccttcggggacgtcgggcccgagggtgaggtgtccgccctcctcctgatttcccccgagg

SEQ ID NO: 13857 - DNA, 870 bp, Oryza sativa
  unsure (1)..(870): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggatggatcgggtagtatgatgtttaccaaaatgctgcttgtcaaagagctttctagcttcatcttctgccaaattgtgaatcagctgaagtttatccactgatactggtagacccactctttccattctttcattatacaactttaagcagcgctcaagaattgccttattgaatacttctacaagtgatcctgttgatggaatttcacctttattcaacgcctcaagtatctaaaataaaggtaagcaacttcagataacagctcacaagagtttcaagattacctgcctaagatgcataaaaaaaaacaagccaagaggtattacctgccttaggaaagatacaaactcctttccatttagagttctaccctgcaaaagttttggttttatcatggaagtaacaatttgcttcaactcatctctcctttctatatataatgggtccagttcttgatcgtccatgtcacatagctttgttctttgaagcccaggctggcaaaaaagttcataatgtaataacttagt

SEQ ID NO: 13858 - DNA, 552 bp, Oryza sativa
atcttctgagaggatttgctcatggagggtatgcagatctgcagagagtcacccagtggaatcttgacttcttgagggacagcacgcaaggggacaggtagttgttagcttagctcaagtgctagacattttgcaattagttttattcaaaactctttacgcatattagtggttgtttcatatgaatgcaaatgtttattttccaaacaacagacataggaattgcattatttagtacagatggcatgtacgcatcagacccttaatataatcatggtgacgtggcaaatagtagctagggatttctagtaagtatcattgataataatcctttatacaatggaaaccaagatcatgtcctcttttgtttttttctgtgagcaggtatatggagctgtccgagagggttcacgatgccatcggatttatggttgctgctggtctgactcctcagcatcccatcatgacgacggctgaattctggacatctcatgagtgccttcatttgccatatgagcaagcattgactagggtggactccatttctgggct

SEQ ID NO: 13859 - DNA, 3143 bp, Oryza sativa
  unsure (1)..(3143): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggagtcattgggttataactttaagtaagaaaggatgtggtgtcacaccccaatctggcaccgccgtacaacggcacctgacaggagcgtgtcgtagggaaaacggcgagaaccgcttcctacgaaaccacgatctcggtaccagtcccaggacatagtgctggtacccacagtgacaaatatgaatcatagcaatccttaaaataaatagaggacttatttaccttaacttaggttgcaactcagaacaacccgagaatgcaaccgacgacacggacgaggaaacaccaacaacagcagcagcagcggaaccaacgaactaacacccaacaccacaggcggcggctaggaaccaggacgaaaccctaatcttcacttcactttatcttctcttcagggcggaggaactatatatatatatatatttatatagagcaagggtgagtactttcgtactcagcaagtcacgggaatttaggtgtttaatgcaagcttggaagagaggcaaggttgttttgcaaatcttttatttgaagacctttttttgaaatcactaagtgatttatttctttttaagtttgggcgaaaagagacttgcgtctcgattcgactttaagagatgcttttcaacagctcatttagtaatgtaccgacctcccaggtcagatcattacttctcggctcccagagccattccacttgattaatcggctcccagagcctttttcattttctcggactcccagagtccagctgcccagcagcacaacaatccgcttccactcggaaagcctagtctatgatgcccgcagacatcccgaatcacacagattcgtttctgaccactcaggtcatccatctgccacataggctgattctggttacaattcccacaccacaacaacttttcacaaagcacaggcaaacaaatctatgcaacgggaaccacctcacatccgcccatgaccgtgggcacggctgttcgaacagttagttaacctctgcagaggggtacactttacccacaagacacaaacttactccagacactggccggtgtcagaggttcgcgacaaagcctttcccaagccgacccagggatacctcatgccacatagaaggatcaaatcctcacataaacataggccattttaggcgttcacaaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtcccattccaccttgtggttgtactttgattatgttcgatgagtttcccacaggaatcggtccttatatgcgaatacgggacagtgccacataggcacaaccccccgcatcgcgagttttcacaattcattttattttcaaacacaccgacaccacatgtcgggttttgaaggcttcacaaacccatttcccaagttttcgacaaacaacggtgtatgtgggatatttggtatacgtgctcagagagcacgaataccgaggtaccacaagggtggagcgacaaggattcagggtagtacgacctacgaaaattagtacgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaactgaaaacctaagcaaaagaccaaaagaaagatcctatttagactaattagtagtgccactaaatagatctcaattttacggaattactggaagtggaacggagttaatcggagttacggagtgggtgatatgaattttggaagtttaattggaatttctggaataagaggaatggtttatggaatttatagaaataatattctcaagaatattattgacagtcactgtcatgtgggaccaaagaaaatggtttatggaattttgtaacaaggaattgatttatgggacaaaggaaaaaggatttattaaatccctgaaaaagaaaaggatggagggatgtatattagactttttcgggcggcaagggcgcggcccaagggtcgaaggaggctcggccaagccatttgggccggcgcgggcgcgggaaaggcggcccattagggcgcgcggaagggggagggagcggtccggtggaccgggtgcacctcgcggggtcctgggtggggcccacatgtcggcggcaaggctcacggtggggagagcgcacgcgggtgcggtgctagggtttggtgggtgcggtgtgcgggcggtgcgccgggtggatcggatggcagcgggcccacatgcagccggttggcgcaccgtggaccgcgcgcacgggaggggggggaggaaggaggcggcaccggctcggctcggtcaaagccgaggtggcgccgacgtggcgcctacgtggcagccacgcgggccggcgggaggaggaagaaggggcggccgagatggacggcggacgacggccgagttcaccggagctcgtcgcgacgattcgagagagagggagtacaccggaacgatgggacggacgataggaagtgagccaccggatcggattcgccggagggaggccaacgttgacgaatcgcgggggcg

SEQ ID NO: 13860 - DNA, 28190 bp, Oryza sativa
cggaggagcaccgagggcagccggcgacgagaggcggcctccgggggtgggcggcaatggcggcggggccatgccgggtggcggcggtccttggggcggcatctacgcgtgttcggcagggctaccgagctaccacacaagctagaggggacaagggtgagcggggaaggggaacgggagggaggcactaccgagccgggacggcgtggtgacgagcagccaacggcgcggaagcgagttccccgtcgtcgggccggggaaggggaagaagaagggtggccggagccctcttcggctccgcgcgcacgccggcttcccggcacacgcgagggcggaggaaggcgaggacggcggcagcaaggcggcgatggcactgcagcggtggggactgaagtgggagggatttgagaggagggactcggctttatagtggaggcgaggtcagttcgcgcgggaggtcggttcaaaccgaccttagggcgatcaaggcggcagctggcggtcgtgctcggagctagcggccaagtggcggcagaggcggtcacgggcgtgacgccgatcggggaaaaagcaaaaaggggagggagaaaggagctcggctccttgccgattttggacgagctgagggaggagagagcgcatgggagagagaggcgctgcctccgcgtcttggacacgcgcgcgctgcggcgcagaggtgggggcagcggcagagtgggcgcgggcggctgcgcggcgcaggcgggaatggtgccggtcggggaaaaagcaaaaggggagggaggaaaagggggctctgcccacgtcattcagggagaaaggaggagggagagagggctcagcctccgggagttggacgcactcggcttggagtggccgggcacgcgcgcggggccgtgcagctgtagcgcggcagggcagcggggccgggaggcgtaggcgcggcagggccgacgcggcggcgaccgggcggtcggccacgcacgagcgcgcgcgcggatgcgagggcgcggccggatttcgaacggcggcggcgggaaatcggcgccggtgggggagcctttacgggagagagaaacggagagagagagaaacggagagagagagagagcgaggatgggaagagagtgggcgctctctctctcgagcgcggcgcacgcgcaacgcacgtgcgagggggaggaggaggagcggctgagaggagatgggccgaggagaaaacggcccacaaaaatccgaggaaggcaaaatagactttttcggaggagattgattcgaagagaatttgaacttggaatttgacttagattttggaattgggatctcgatgagaggaaggagtagacggaggattcaagacggggttttggatattttggatctggggaagtatttggcgatgattcaaagagagggatagaatttcagagtttgatttggagacttgagtcggaagaggaatttcgatggggcaatttctgatggtgacgagagggatcaaggacggatttgaattgagatcttggcacaacttagactcacacacaaggaacgaaaattttcgcaattaggattttgccgaattagtttttaacgcctcacgaaaagcggagcgttacatgtggacacaaatacatatttaccgaactgagtgatattatacgtctgatccttgagaggtattaagagatatccctttattcattataaaattcggtaattcatacaacttttttatataatggaattaaaccaatctttacttcaaaggagctacaaccacttattacataatcctctcaaagagagcaaacatttaagtaacccataaagaacaactaacaaacaccaacacttaagaataaaacaattagtaataagtcaatttgtaaatctctagcccaaattgagatacaagaggtatcaaatcgatcttatgctaaaataccttacgtcttagtacctttggctgtttatatcttacaaaattcattccattgagtggtgtaaacaaaagaatgtgcaagttttatttaacatttaacatgttttgagaactaggtaaggaaacatgtcattgtctcatggatagatatgcaactaaggcgatgtcggctcggcaaatagccaatacactgaagctggcatagcgtggccacagtggcccatgtatgacaagtataaggaagagaaggagtagtgaagtaagagagattatacggttcctaagaaaatacctggagatactacaatttacactaaaaattttggtacctcgaggtacctagtacctagagataccacattttacactagaaaatatagtaccttgcttccggtagcttttcaaggatggtaaaaatttacccgtgaagtaatgattgtagaactctataatacaggtatgaatataagactgataacatgcaacctctgtaccaaaatgtaagaattcgtcacggccgaaagatcgatgcgccgatttggctcctagagacatagttgcaccactagttgtcgtcaacaatctcgtctaaccactgtgaagtgtgatgtctttttgtgctatggtctagccaactgttagtttcttccatgttaaattgctggtatgcatcccattggggaggcggcattccaagtgtgcgcaatcgcaaccacagccgatctaatagatattttaaaaaataataaaaaaggcaatatatttacatataacatatattgttttctcttgagaaatactcctatatagattcttgtgggggcaatgatgataaggaaatgcgagaacaatgtaagttgaaaccaaaatatattgtacatatataatgaaatatccactgcatatttggtatgtagctacatgtgtatacctagtatctgattagtgaagtacactatatagcaatgattttaatcagaaactatagagaaatgatttctgagaaagaaagacattgggtgtaattaagaaatcatattattgattgggaccttgtggggagccaaggcacagctgctagttcccctccatctgccactgtctgcaagctgatctagtatatatgtgcaacaaaccattggtcaaaaaaaaaagaaaaaaaagcgaaagcgattaattaaagttgaaacctaaatcgtcgtataacgaatggttgatatgatgtgtagtacatttgataaatctagtacaactatatgtatatcaatttatgtgatagtaactagctagctagtactgtaactgtaattaacaagagtgacacgaaaagatctatatatctcagatcgtacagttagctagatcaatgacgtcaattaactatatatataactagctgggttgtaactatagatagtagaagaactttcagctatatatccagacagtacggccactgcataatgagtagtgataaaatgccataatcttctccagcaggtgacaaaaaacgcatggctggcaccgatcgagagatcatgtcaaggctaaaaagctttagctcaacttggttcatggaatattcaggttcagacaaggcgagtcattgtcgcgtatcaaaaaccggagccctacacgatcaaaaccagcatcacggtggtcaccaccacgaagaatatgcatcagaacacaacagtacagtacagaagaagggagatagctagctaggttggaatggtcgaattagctagcaaagcaaattaacaagcaaatggcctgattaatcaagctcgtatccgatctcttttgccacccgtgaacccagataatccgcggctgatttgtcgcatgttatagctcgcttcctcgaactcgcttgatccgtgtggattactcggctcgatctgatcagctgtagtagtagcttaatttgttgactccatgctccatccatgcatgttcagacttgagaaattcttttctttttttcagtaaagttgttcagaagcaacaaaatgtgtgagaccgtccgtgtggctgtcaggctgtgctagctgctagctgatggtaggcagatcacggtatttctgaaatcaaatggtaattaaacatttaaacatatacgtgcacattgattgattgattgaacgtagattaattactaagcaggttcacatgcgtgcatgcttggccggcatgggtacccacgacgaacttaaaattatattatacaaacaatatgcaccgatcgatcgatgtcacctcctgtaatgcacatcatatcatcccgttgatctcacatgcatgctccttgattttttttttttgaggacagatcaaattgcattgcattgatccggcttttgggagaaagccaaaatgctccttgagatcatttcagcgatgcaattgagtgagtacttgaaagtctttaagtctgaaatcaagtggctaatgcaagttgacgatgaacacggcatggcaagccatggcagtactcgaattcgtcgtcgtcgctttgctctgtgatatgatatgtcgatatgatcgaccaaacgatgctcgtggtagtgttgccagccgagccctgctgctgaccagcaatgcatgcagttcttgacagcgaaaaaggagacttcttcttttgagttttgacgccttgcgccgacgggtgagccgccgccgccgccgccgccggagaagacaaggcgtccagcctcggggcccacgagggatagtacacgggaatcggattaaacgggccgaatccgccagtttgggccagagtaaagtgcgccaccgcgactccgcgagcgcgaggcctcgtttggacaatggcccaaatgctggcgcgtttgcttgtgtgggctgggaaatttcgagcaaaatctggcccatatactatgatgggctggggcttagacttttacctatcccgacgagaccagagttaggccgggcggaatatatgggccgtgttgcgtgggccgttgccagatttcacgggccgtgcagccatccggtatgctttgaacctggctgaactttttccaatttatagacccatagtttcgcttatgcttagacttgtaagctaaaatttaaattttagagttgaaatttttagttttcccatcttagtttgttttacagcattttaaaaaaaatcgctaagaatgtttatataaaacttttgcacgcaaattattttttatcggtaataagcggtatacataagcataaacataagcaaaacaagtactccagtaaaattgaaggtgaaggagcgcagcacaaaggattagacaaaatcaaagcattttctttctgcattctgtgagttgtgcagtttccgaactggctatactgtcatagtgatagctaagaaatttacaggaaataatggcacatatatatatatatatatgccaccaatacagttcgtaattaaaggttacatcaggaaaatgaatactgattcctccttgcatgatcttggatgacagaacggagagaaaggtttggaattagctgctggtgcacaatcggctgtcctgtaatgggagataccctccgtcctccatcaagccaggatctgatcgcatcggtttcgtaggtgaatccgtctgatgcaatgcaaggctccctcataacctcctgccattacaatgcaaatgatcaaatttctatttcaattcatcacaagtgacaagtatttgtgttaatctacacaaggagcagtgctaagttatgtgcagaacttttcattgaatacctgaaggattgggcagatgaagtatgaagggatgcagcagtcttcatcgaaaggcgactgcatcactgatgatggagaaaatgatgcagctagcttcctttgtatgagcaacgtctccggttctctgacacagttctcatcatgatcaagatactcttgcagcggcttaattatttgcccggaggcctctaagatcaaattgtctgaaatcacttctttctgttcctccatggttgtgttctgatcattcttgggtagatctctttcttgttttaactgtgcaatttcttcgcttgctctcagaagtgcttcttccagttctttcctctttttaacctcctccaagtacagctcctcgtattctttggcctgtaaggttcagagttctgatcaaaattctgaagaatatattcatatgaaatctggatgtttttttttctaagtggtctcgtttctgaataaaatagtcaaaggacaacgaattactttctgaagagatgaaactacttcttcgtctgctttctgccgtctgtaagattctcttaaagctctcatcattaagttgtcagctgctttgcatgcttctttgatctcatcgtaaaaacccagttccgattcattgttgtcatcctaaataattggaaaaggaaatcaccatattatgtcatcactcttacaagacaaaatattcgaaaccataagatggcattgcaagatcagaagaacctgttcctggtgaagtgtcaactgcagagcatcgtgaccagtatcaggaatgaaaggcgtatgtccaggtgcaatttctacttccacgccactatcatggaaaatgaatcagagatttttgagcttcactattcagtaatcatcataaatcgcaaaattactactaaaaggtttttaccttgtacagattaaccgttctttgcagacaaaccaaatcttgcatgatgggtcagctctctgcataatttctgttgctgtcctggatgcaggtttgtccatttttctgaaacagaaaacaacaattattggtcagctctctgcataatttattttgtcttcaattacaaaataaagctttgcatttcaagtgttatattttcttagaagaaatatttaccttgagtaattcctgtctggggcagctgaaattactagcttggtcactccatgcaagttgattagttcaacaagaccgtctacaacattttcgttctcaatgactagcttctcacatttcatctgaaatatacagacaatgaaaaaaaaactgtcaataagctgtagttctaaataaaaaacggctgtcaataacaagccaaagccatcttgagataatgaattcacaggaattaacagaacccgtcacaccttcatcctcaggcattgattgacgtagtgatctaattgcttgtccaccttgtcacgctcagccattctgaacaagctcacttgctccggattcagtttactggcatggaacttgactcccactgcgaccaaaacagaatcaatacaacactagacagattatagccaaatttctcagtcttctgaattgaaagggctaagaggagtcacaaacccatgaactaatccatggtttccatgaatttttggccggacaaccatacatataaccatgaaatctttcagaaaaaaaagaagaagagaagaaaaacaatcggatgatgcagttacgtactgacggggatcatctgcggcggcacatgaacatgcgtgacgacgatggccgtggcccggaaatggccgagagcccacgacagcgtcgacctgccggacttcgcctccgccggcagcgccacgaacaccttctccggcgccgccatcgaccgaccttctcgtcaagcttagctccagttaatttaatgttcagttagcataagtacaaagctagcaagaacacgcggctttgggcgtacagaccggagactttggatggtgacaggcaccatatgcgaccgggaggaagaagaagaaggcaaaattaacagtgacacattaatttggacgacacggaaccgcatggagatttccaattttccaccaaaattaagtgatgattaattaactagcgccaatatcagcgtcatcgatagccttgtcattgaaaagaaaacttgcacatctcacagtcgcatcgttatataatttgtcttgtgccttgaccgtctccactgatcggttacatatactactaactccatattttaatgtatgacgccgttgactttttatctaacgtttaactattcgtcttattcaaaaaatttatgtaattattatttattttattgtgatttgattcatcatcaaatgttctttaagtatgacataaatatttttatatttgcacgaaatttttgaataaaacaaatggtcaaacgttgatcgaaaagtcaatgacgtcatacattaaaatgcggagggtgtacaaaattaatctgctgcttcggtttcaactaactgtttgaactcggaagggccgaagcacacggcaaggaaaggaaagggatttggcgggtggcaccgtgcacatcctgaacccccacagttcgttcaggtgtcttttcccggcaaattaattattaggattattactcatctgaataagtcccattgaataaactcctaatactttggtaatgacgttttgaaactttaatgaaatgatatcctccggcatcgtgaacatcgtgataacttcgctgattttttttttctttctttcttttcgctttttttttttaaaaaaaaagattatttgcacatgtgatgtgagaaaagatcagcggcccagatggcaagatgtgctaggcccataggaaacaaagtggcccatatagaacgtgtcacgtagcccaacattttcacggcccaaatttatatgggcctaattaggccgtcaggtttgtgcactatccggccgaaattgagtgggccaataccacagttccgtcatggttcgccggatgctccagcgtccaatcgccgccgccttcttccaggtcactattgcatatggagatacgaattttaatacgagtagttcagaaataaacatctaaacatcactgacttaaatttgtacattttatactgtaatcgagctgaaatacggatagaacgtacgtaatgcatggtgcgaataaactgtggaatgatgacgattcgacaggctagcattaataattaacttaatccatatatggttaaagaaatcagcatgcttatcacattaaatcatggagcctaaatcatgaatgtaagcatgttacgtcgctaccttaacttatctggtgcggactttgcagtttgcagtactctcttccagccattttgttcacacaacgatcgatctgtgtgtgttcatcatctctaatcgtattcacataaatggtagtctgatctgattaatattctgatggtgtgattaattaatataatcctgtaacgtgatcctggggatcagatctcagctcccgatgcaagcagctagctcaattaagcccataatttcttgtcttcttgtttctagctagaggcagtacgtggtatcgatcatcaagaacgtactcacagctggtgtactttcttcggaatcagaactcagtttttgttcgttagcgacctacttatatagagccaaaaggaaaatcggttgccacatgcatgtaagtgtgcaatccagctaggctacaattcatagatgtcagaccatctaagaactagttttaacagcagagtcaactattaagtataagctaatattacagataacgtttataatagatgaataataaggttatctctattttttctcctctctttctctcacctatgtatttaatttagttatcttaaattatgaatagttaactattacattagagctaacacaacttatttttccactatcctcccctccctgtaagttttatagttgacttatagcctactattaaactatttaaactagatcttgagcttatacttgctagttttacaattcttgttatttaaacaataacacaatcttcaaaatatatatttaactatatttttaatattatatataataaataaatatatttgtacttattttagcgccccacatccaacgttggcccactgcccctccatccccatggtatcggcaccgttttaattaggtgcctatttgcttgtctaggttcaccgtccaccgtcaaaccgtcatctctcacggccatccctctaaacccacccgatgatctgcctcctcctcccacccccaaccaatcctaacttgggaccctaaaccattactccactgccattcgtcgaggttatcggagatgtaggagaagggttgccagatctagtgaaggagttgtagtcattggagcacaaatcgtgtaggaaatataatcctgtggtaaaaaaaattgaaagattttgattgaagcaattccaattaaaattacaacatcaggcaagcaatataagaattttttttacaaatatacttattttttcaataatttacatttatatatatgcatacaaattttttgtaaaaatatacccatcccgcagaacgaaaatgcgggatcgcgacggtcccgcagcttcaaaacacgggaccgtcggtcccgcggacggccgcgcggcactgcaacggtcccgcagctccataacacgggactgtcgcggtcccgcagctccaatacgcggcaccgtgttgccagcgatttttatactgtgcgcactgttgaaacactgtttgggtactgttttgaaccgtgcgtggagcgcttccgcacattcaaactgcgggatcgcccatgaatattgccaaacagtacgaaaacagtactaaacagtgccgcgcagtataaattttctggtatatagcaggcgcgtggtagaggatgggaacgcgcggtcccgctcaacgactacgcgcgaccggtgcggttccgtgcatcggcgacgcgccgcgcaacggcgatgcgggaccgtctcgggaccacgcgttcccgcgctgcttctctccgagccacgagagcgagccggtgccgcgcttccgcgccgcgggagggagacggtgccgcacggccgtactgcgcaaccaccggtcccatggaatggcaaggcggcactgtctcggtcccgcatccttgtcatgcggtggaggtatatttatgcaaatattttttatgtagatatataaacgtaaaatatttttaaaagaggtatattttcagttttgtttcagcaatataatgtatcactttagagactcagaagaaatttttatcggcagatcaaacatttccacatatttcaacaaatgcaactggtcaactcgcttcaattccccgtgatgagtcggcgatcgatttccacgaatatctgttctctcctggcaaaatcttgtcctatctctcgcgaacacctggcccatgcacctacaacaaccaagcaatcattcatcatgcatgcaactagcaaccgcaaatacatccattctagccataatccggctataaataccagacgcccaaatcaaacgatgcaaagcaacacaagccgaccgaagcaaacatagctatagctagcacacaccactagctaattaagctcgctcgatcacttcatcagttagcaatggctatcaccaaggtcgctcccctcctcgccctcagcctcctcctcttcgccgtcgccgccgtgcacggctgcgagccctactgcggccacggtggcccggtcatcccgacgccgccggtggtggtgccgacgccgccgtcgtaccaccgccatggccgctgcccgatcgacgccctgaagctgagggtgtgcaccaacgtgctcaacgggctcgtcggcgtcaagatcggagccggccccgacgactgctgcccgctgctctccgggctcgccgacctcgacgccgccgtctgcctctgcaccgccgtcaaggccaacgtgctcggcatgaaactcaacctcgccgtcgatctaagcctcatcctcaacaagtgcggcaagatctgcccctccgacttcacctgctaattgagctcaaaccgtgcgtgcagcatgttggatatcatgattcatgagtttgatctttcatcccgattcccgacgcagcgttaaacattaatcttgaaataattctcttgtttactcgattcgccatttgcagctcgttctatattataatgtaaaattcttgaatcacttggttgttgtatattgtaacgcccattatatatagtagtattttttgttctcacaaagataactgccatatagcttacacgttcaccttaagttctttcttttctatccgtgcataaaaacactcgcacgatatgtgataatcatgggcgatgcggcaattcttgacctaactgttcctatttcctcaagccggtccacacatgttcctagccatgtgggtcctgcatcatggtagtctcttttggcccaacatgtcgcgtgcatctcgttttgtttgggatgttggcgggctgcttcctgttttggctgattagaagggttactaagttttgaatcctaataagggtaaagaagagatttgtacgtgacattgatgtgacatgtcatgctggcatagtcatgactgataaataggacccacttaaaatttttcatttttatttttttctttctcttttctctttttcctttttcttctcttgtttctctttttttccctttctcctccttcctctcaagaccatcgccgcatggggtgcttaggtcacaaagaaaggagaagaaaagaagaaaaaagagaagcagaagaaaaagagaagaaaagaaaaaaagaaaagaaaatgttttaagtggatcccgtttgtcagtcagatgactgccaatcacgtccatgtggcatgtcacatgagtgacatataggattttagatgggttgtgacgatctgggacttagatgacacacttcaataagttttgagatttatatttatattttaagagtttaggaatctgaatgacacaaaccatacaagtttaagaaccaggtgtggcaagatgtgcctacctaggtccacttcaaatagagcagctagcccatataacaatgtgtcataacccaaccaatatttccaaaacatatgaaaagagaaaaaaaacataaaagtagaatataatactcattcaattcctatgagattgaaacactggaaagtttcaaattgtttttgatgggcacacaggaaaaacacagaaaacatataggaaattgtaacatcccggcctaggacttaataggattaatagaatactcatatcaacaagttgcaacttcttttccggaagccaatctccaaaaaactccagggttaagcgtgcttggcctaaaattcttcccgggtgcacacgagtgaggacaaagtgtgcagaaaagacatgtgttggtctgtgagggcagtctatgacctatgaaagctatcagatataagcgggcctacctaggaaagctatcagatgtaagcgggcctggcctgggagaggcgggtcgttacagaaatagaaagaatgaattgagacttcaggctatttaatttcctccaaaatgtttctagaatagcacatttcatatgaattctgaaggaattattagtagaaatcaatccgttgttttaaaaggctttataggatttttatcatagaatacaaatcctgtaaaattcataagtttttctctcttttttttgaaagggccttcatgtctataccgtgggagagcaaaaaaaaatttgagttaattgcactttggactaggaaaatttaacaaagttttactttggacaaggggtgaagttatattcactttggactagataaatttacaaaagttttaaattggaccacccttcttctccatctcctttctttcccttcttttctctattaagcagctgcgccatggatctgagggatgatcaagcaaagcaccaggattccttctctatgtgctctgttccccagcttgaagaaccatcaaaatcaagactggttttagctggttgctgtacctgtctcccgcaagctcgatgcaatgatttgttctaagctcagatgaacttttacggggaaaaaaggttgaagtcaagcagctaaatcaatgagtaaataaatcaagatcagatggaatattaattggtttgttgtgttgcgggtaagcccgccaatgaaatcaagaagtggcaaacaaaatagtggcccaatgtgcagtagaaggtaagaaaacctgaaccaaagtgaaaatgttagatataacctagtccaaaataaaacacaggcaataataatcggcccaaagtgcaattcactcaaaaaaaaaaatttatagctagcttagctcgatttgcagagcacttgacatactgactgagtgactgatgacgtaatggctcgaacaaactgtacacacgcatgtggaatgacgacgatgattcgacctgatgctagtattaattatttaattaaacccatactgttaaacaaattagcatgcttagcacattaatcatggagctagcctaataatgcatgttgccacctttctctgatgctggctagccattttgttcacatcgagtcagcctgttcatgtgatcgagtattcataatctgatccataatagtactattttgacggtgtgattaactaatataatcttgttcgtgatcctcgggatcagctccacaaagaaatatcagagtctaaactaaccagacaaagttataacgaccctcactttgcatgcatgtatgaaaaaaaaattagtgggaattcctcgcatggaattaagctcctatgatcatattgtcagtagcgaaggctaagacttagctgttctcaagctagatccatctttaggtacatccagctagccaatacaattcacggaggccatcccggctatgcgtgtacaaatggagcatattgactctgccagctcaagtacctaaaataatgcaggagagaggaatggatggatggttacgtatgacacgatgtatgcaaaattacaagtccatagcaagcatttcagaaagcattatattcagaacaagtattattcggcagatatataaagcacacatccatatattaatgtcaacaaatgcaactggtcaacttgcttcttccccatgaataatcgaattaattaaacgagaatatatgttctctctcctggcaaaatcttgtcctatctctcgtaaatacctggcccatgcagtacacaaccaagcaaataaatcatcacgtacatgcactacacaaccaaacaattaatcataacggatgcaaatattctactccctccttcaaaaaaaaaaacaaactctgggtttccatgtccaacgttgactatctattttatataaaaaattttataattaatatttttattgttgttagatgataaaacatgattaatattttatgcgtgacttgtctttttaatttttttaacaatttttttaaataagacggacggttaaacgttgaacacggaatcctaagatttgttttttttttgaacggagggagtaagcttcagctagttcagtacgtgtatagttccaaacagcaagctcgactcgatcggctataaatacctgacgccccaagcaaacgatgcaaagcaaacacaagctgaattgaagcagcctagctagctaattaacaccactagctaattaagctcgctcgatcacttcatcacttagcaatggcttccaccaaggtcgtcgctcccctcctcgccctcaccctcctgctcttcgccgtcgcggcgcacggctgtgagcccaactgctccggcggtggtccggtgatcccgacgccgacaacgccgtcgtacgaccgccatggccactgccccatcgacgccctgaagctgagggtgtgcgccaacgtgctcaatgggctcgtcggcgtcaagatcggagccggccccaacgagtgctgctcgctgctgcaggggatcgccgacctcgacgccgccgtctgcctctgcaccgccgtcaaggccaacgtgctgggcatcaacctgaatctccccgtcgatctgagcctcatcctcaacaagtgcagcaagatctacccatccggcttcacctgctaattgagctcgatcgtgcataattaatcttcatgcgatgacgaggattgatctgagttgcatgataaattaaagattaatcttgaaataattatattgttattcacttctacatttttgcagcccattctacattgtaccttactttatcattcttgaattacttaattgttgtaagttgtaacgcattatagcaatgttgttctccacatgataattgttatatagcttgtcctccttaatttctttctttttcatgtatgcaaaaaacgtgttcgtctcacagcgtttatctataccatctgtataattgacccacaaagtattaatactcaacaaagtaattattactactcttaaaacctaacatgcaagtatatcatatcaatccactaaataactaaagctcaagatgcaagcaagcatagcaattacatctataattttttacattctaaatcttaacattcaagcatgctaaatcatcatcccacatcactttcacaatatatcaacatataaatttatctatcatttatacaatgtttaacatatattcctctacatattccgtagcaaaacatgggacgtcatcgtatatttagtgataatggcgagtgaaaatgattgatctgtatctaacgatttcctcaaacaggcacacacatgtaagccatggggctaggcatgaatgcaggccttgcacgtaccatgctcgttttcggcctagtacctgtgtgcctcgtttcaacacaaagcacattcgacgtattggtgaacttctggttccgtcctattaaaatagtaactaagcttggtctgtctaaaaagggttagaaaagatgaatgacccaaatgacaagatgtgtctaactaggtccacttcaaatagagcaacccacagaacaatgtgtcataacccagtctttgcacaaaaaaaaaaacaattttatgtctgaagttaattgcttctaagccaactacaagaactagattataagctattaccgtccccagattctagggttaggggatcgtggctgggagagtggccttactctgtgttcccaacacagctgctgcgcacgaaaacgttaacggagcggtacattagaacgtgattaattaagtattagctaatttttgttcaaaaatagatcaatatgatctttttaagcaactttcgtataaaaactttttacaaaaaacacaccgttgagtagtttgaaaaatgtgcgcgcggaaaacaagaggagggagttgggaactcatggaaatgaacgcagccctgatcggctttacaagcatctgaccctaggaacaaattgtctttaattttctaaatgtttttcttcaattatatcgaaaataaaaaaaataatggttacattgtcgcacagctaattttcaatttttcagggtacgcaacatatgtcctacgggaaaaattataaactttagatgtcatgccgcaaatcttgcctacatgtttatagtggtaattgagcaaaattcctttgtatatgttcgtagactgcagaacacttgcatatgggatatgctgaaatactgacagagaacgtaatggttcgaataaacagtgtggaatgataacacgatcggagacctgctagcattaattaactaaaccgatatggctaaagaaacaagcatgcttagcacattaaatcatggagcccaaatcatgcatgtaagcatgttacgttgctagctacttaatttgtctggctcggacttactctcttccagcgattttgttcgatcaccgatctgtacgtgtgttcatctgtaaacatggataagcatggtagactgatctgataaattaatataatcctttaacgtggtcatggagatcacagctccgattccagtagccaaattaattaagcccataatttcttgtccaccatgtttctggaggcatagaggtcaagaattcacagctggtgtacttaatttgttcagaatcagaactccgttttaatttgttcattaaagacctaagagctaataaacggaagttaaaatcggtcgctacgtgcaggtaagtgcgcgtgcatggtcagctgggctacaaattttcatggaggtcactatgcgtgtatatatagagtatacattatagtgactctgcttaagctagctccgatccggccagtagtagattaatggtggaagaaattaaggaggctatgacactacgatatcgatgcacatttaggcaaaaataaaaactctccaaggcatgcaactatgtcagaaatgctcgatcagaacaagtattagtcagcagatacaaacacttccggccatatatttcaacaaatgcaattcgtcaacttgcttgcttggccatgaatcgatcgacgatcgaactgaaagaatatcatttttccctccaggcaaaatcttttgtccaacctctcgcgaagtacaccagctggtccatgcagtacacaaccaagcaatcatatatatgtccatcatgcatgcctaacaacttagacagaacaaatatgtctttttacttgagagttaacggtcaacacacggttaaactgacggtagtggcatgaaagagtgcgcaaatttggaccaatggcatataagaaaagagccaatttccaatgatatataagagatccgaccaattttcagtggcatataaggatccgaccttattctagtcctctagctactactagttcagtacgcatagtttcccaacagagctagctcgatcggctcggctataaataccagatgccccaagcaaacgatacaaagcaaacacaatctgaaacagcctagctagctagctaacacaccactagctaattaagctcgctcgatcacttcatcagttagcattagcaatggcttccaccaccaaagtcgtagctcccctcctcgccttcaccctcctcatcctcgccgtcgcggcgcgcggctgtgagcccaactgctccggtggtccggtgatcccgacgccgacaacgccgtcgtacgaccgccatggccactgccccatcgacgccctgaagctgagggtgtgcgccaacgtgctcaatgggctcgttggcgtcaagatcggagccggccccaacgagtgctgctcgctgctgcaggggatcgccgacctcgacgccgccgtctgcctctgcaccgccgtcaaggccaatgtgctgggcatcaacctcaacctccccgtcgatctgagcctcatcctcaacaagtgcaacaagatctacccatccggcttcacctgctaattgagctcaaccatgcatgcataattagtcctcatgcaatgactggctctgaaggcttgagttgcatgattaaagattaattaatcttgaaataattatcttgtttactcgcttctgcatttgtggctagctcgttctatattgtattgtaccttactgtaccattaattctttaataatgattacttcattgttgtgagctaccttaatactccctctgtttcttataaggtgttttaactttgatcaaagtcaaactgtttgaccaaatttattaaaaaaagtaatatttttaacccatgataaatttattataaaaatatattttattattttttttataaaactaatttgttaatgtaaatattactatacttgtctataaacttagttaaatttgaagtagtttaactttgaccaaagtcaaaatatcttgtaacctaaaatggagggagtattgtttttcacgagatagctttcatatggcttgaaaaacgctctcacgacctatatatatttgatgttgatttattcacacatgtttaacacatataaagcggatcggaattttttgtattttttggaaaattcactggggggagagctttcccacctgaattcattaaaagggagcaaagggcagttttacaaagtccagagcattacatattgagagagcggagggaggaagaaaagagatctttccaggtcgaaattacatgtctgtcttctactttgatttccccccccccccaagagggaggcgtcctcgatacattgctgcagcaaacggcgcaaagagggagcctcgtgtctcaagacaaccccgtggtggtgattccacatgttccaaaagcatactccctccgtttcacaatgtaagtcattctaacatttcccatattcatattgatgttaatgaatctagatagatatatatgtatgtgggaaatactagaatgacttacattgtgaaacggaggaagtagcaagtagaacaccctaaagtgcttcaagggaacttgaggcggggtggggagagaagcaatctcagcaagcgtcgcaacattgaccggtatattcatcgcgccccagaaggccacagcgaaggggcactggaagcatatataggtggagggctgtttcatcagcaaagttgcaaagatcacaggttggagccggcactatggttttcttatgcaagctgcgttttgttgggagacgatctttagtcaagagccaggcaaaaaaactgaactttccagttggggcacttctccatctcgtcgtattctgcaacaagataaagatgccttgtttttaagatcccaggggcgcctttcttggtgcgaacatcttgctgatcagtcactgagcactgcatcaagaagctgctaagatggttgaagtgccctggagcactgcggatcggaaatttggaatcgacctggagcatagctagtcgtaataacaaaaaagattttttttctcggtccgtattatgctcggactagctagctgtatgcgtttatccgcgtaacaaaaaaaataataatctgagatttccactagaacacaacgaatagagatcacgaaaataaacattatatatatatatatatatatatatatatatatatatatatatatatatatattctttttgtcaaatttataatagcatgaatcaaattaatctctctgttttgaacaaccaactgatagagacaatcagatacaccatttcatacaaagtctgaaattaattaatcacaattcacaggtactgtacggattcggggtcgtcgtagtcccagtccccgaagatgacacggctcatgtcgatcttggtccactcctcctccatcgccgcctggatcgccgccgtctcagcgaagtagctctcgccgaccatgtagcagccgtcgttctcgacggcgcggcgaacctcctcctggaacgcctcgaactcgtcgcccagctcggcgtcctccacttccccctcgcgctcctccggcgagaggctctccatgtactcggggctccgccgtgggttcctcttcagtgtcaggatggaagcgacgtagttgtcaggcatccgcaccttcttcttcttcgcagcagcagcgcatggcttcttctgctagtcggcgacgacatacttggctgctccggcgatgacctgagcagcagcaggaggaggcgccgccgccgtcgctgccgagccggtgatcgccttcttctcctcctcttctgccatggtgtggatgtcgcgctcttgatccagcttactcgcgcgctccaccgccggcggtgctcgtcgtcgttaccctcgccggccgccgcgatgcgctcggtgattggcggcggcggtgggcggcgtcccgagctttatggggacaaatcccaattgatgagagatccgactcggattctgatctgatcttgctccggcctcaaaactaattgggccgggcctgcaggcctaacatattcccaaacgcagcatttttggtgggcttccctttcctgccggcccatgcttgaaatgattaatcagattaggcccgtttagaagaagacagcccaccttgctgcgttgccaccgtacgtagttcgacgccgtctccgtcgccggacgtccgccgcctgccagtgtacgatcctttgtcaatgcatgcacgtggttttcatacttaattcgattagatggccttaatttcatctaaaactgattcgagctactgaattattttaccgatcgattagctagctaaactggtaatataacaaacctagaaaatgagcatatatagcacagctcattatatcatggggataaaggtcgtagctctagctagttatacgttcgtcgtctggtgcagagacagcagacgacttccagctataagctagtttgttttcagttctcacttcagacttcagagttgtacagagttcagactttcagaccagtcggcaattagtcccacgcatccctgcattattcatcaaattgtccagccagtcgtacgtatttatttatatatatatatatatatatcttgcgtggatatacaatataatcctgtaaagctgttatgtaatctcctcgggataccagcttcaattcccatctttcaattaataatgccttagatatgcccatgcataatgcttctctgtacatttcttcagaattaactctgtttttcttttttctgtagagacctatacgtacaggctacagctaaagagaaaatcaaatcaacaggaaattatgcaaagttgcttaattggaaatgagtaatactttgccagaatacatccactgccacatgcatgcatgcatgaaaatgagcgacaaactggggtattaatcagagagctgaatatactatgtgcgtgtggagtatagcgtataccgtgcgcgcgcatatcctccagtgggctaagctccaaactcatcatcaagctgcagataataatctactccctccgtttcaggttacaagacattttaactttggttaatgtcaaactgttttaaatttaactaagtttataaataaatataataatatttataacactaaaatagtttcatcaaattaataattaaatatattttttctagaaacttggttaaatttaaagcagtttgattttgaccaaagtcaaaacgtcttataccctaaaactgaggaagtatcagttaactatacgcctatacctgctaatgaaccattatatgtgatattctgaatatatgtatatgtactgatatatgtgtgatttcagatattgtagttagttatcagcaagttcggcgcttgatctgagatatttactcgtatatatataaggtatataaacaacgtgacaggccacttagctgaaatatataaaactgtaagaaaaacaatagtcgatagatcgatcgtgaagttgtgtgatatatatatattgcgcaaatatattaggcttagatactggacatgattgataaattgctgctctgcacgtacgcctatgcatggctgaaataattaatcaacaaccaatctagctagccatttccttcacggaaaaatccttgtcgcatctgatctctagcaaaacaagcggcccatgcccatgcatgcaaatccatccatggacacaaacccagtgcacatgcatcgtgcatgcaactagctgcagtgttcatctataaataccagacgcctcagccccaatccaaaacacaagctaattaaagcagccttagctagctaattaactctactagctaagctcgatcacttcatcacacttgagcaatggcttattccaagatcgctcccctcctcgccctgaccatcctcctcttcgccgccgctgcgcacggctgcgcgccatactgccccggaggggcgccgccggtcatcccgacgccgccggtggtggtgccgacgccgccgtcgcaccaccaccacggcggccacggccatgggcgctgcccgatcgacgccttgaagctgagggtgtgtgccaacgtgctcaacgggctcgtcggcgtcaagatcggagctggccccgacgactgctgcccgctgctgtccggcctagccgacctcgacgccgccgtctgcctctgcaccgccatcaaggccaacgttcttgggatcatcaacctcaacatccccgtcgatctcagcctcatcctcaacaactgcggcaagatctgtccctccgatttcacctgctaattaagctcagctgctcaagcttgcatacatggacaaatgcgcagaaacaatattcgtaattaagcttatctatttcattcgatgatggctagctagctagctgcatgcatgccgtggctatgtcatccagaataagatgtgttgttgttttactctgttcccttatatcaattttgtattgtgttgtattgtattcgaattgaatgagttaacgagttttgtaaaaccgatttgtgcttcatcaatgaaatatctgtggtgtaagattgttgtgacaacgattattaccagcaagatagtatagtagtactaatcatcattaacacattcgctttgtgcttcatgacaccatgaagcacaaaggcccatcctatacaaaataaatgcgattaggcggcccatggggccaaatccggctaacccaagcgatcgaaatttggatgggcctaacttctctccgcgcacatccgcgttaatgggccggggcgcgacgggatggcccatggctggctcgatccatcagcagccacgcgcgcatggtgatttctcgccggaacgccgccgccgtcgagcttgcgttcgtcgtccgtccaccgctgcagcctccgtccgattcttgcatgaatccgtacgacgtcttcttgtccagcaaaagatggagaatcactgcgccattgcgaccaacatgctagcagcgcgcacgcatatgcatgcaaaggagctttgaattaactaggagtagcattttctttcctccccaccgccatgaacatgaatgcttcttaggcactgttattttctctaacaaaaactggataaaagtggcgcgctttttaaactgctaaacggtgtgttttgtgtgaaaactttctatattaaagttgttctaaaatataagattgattcatttttcaagtttgtaataattaaaaactcaattaatcacatgttattaccacctcattttgcgtgaagcacttaatttttatcttcatctacatcttcaggagattcaaacactgtcttggtgtgactagataacggtataccattcaatcaatggaatattttacatgctgatgtcaccatgatattagcatgataccgtaggtaccaatactcacatgtattaggttatggcacctaagtagcattttaatgttagcagataccttaggtacgggtccgtccggtatcaagagtacccgacgtgatacccatataccagatctggtatctaggtaacatgatgacattaggatggtgtttacaaatgtaaactatatcggatagcattttatagtatttccgtagcatagtactctctctttcggaatgttagatattttggtgaaatttgactaaatttatagaaaaatataataacatccacaatagcaaattaattttattaaacctactattaaatatatttttataatatatttggttggtctaaaccatgttaattactacttttcttatataaatttgacttcagattaaaagctaaacatcttacgttctaaaacagagggattagataacactaaattatcatgattattacaacactgtggctgattttatccggtctatatatcctttaattttcagcctgtcggtgcgtgagaaccattttcgcatgcttgtattcgtgtttgtcttttggccgggcctcataatgttgactatatatgtatcgtgcatatgatacgtgtatataaattaaagaaaaaaaaaccctgaaaggctgcaatgcgtgtaaccgtatcgaaaagcttcaggcccggttgtcatgcccatgatttctgctttgtcgtccttctcacgtcgttgcagtttgcagattgtagagttagtatctacaagtcatctactcacacaagatgactctttaaagaactgttcattgttcaacactgtcacaataataatatatcatggacagtgtactccttttcagaactctcttttgttgtttagcaatcactggggcgaaaaaatagctggaataataatcaaactgtgcatatgtatatatattaattagtttgcttgcaatggagaacaaatgccttgtgtcaatgcgttgtacacaacacatcacgacatgcagaaaaagtgtgctgcaaaccagctgggtactggggctacacacacctatctattattcatcctgcaagctcacatatgctgcatgtactcgtcgatcgacatagatggtccggcacaaccaatggcagtgggtgttttcaacacctctcgatctgcagctgatctcaacagtttattttatatgatggtgtaaccatctaatataccatgttgctgataatttttaaccagagcaattaatcggagcatggccctagtgttgaacaatttgcactttcacagtcaggtgtaacattttgtacattcagcataatggtatgctctttgcgctttttcagcccttgtgtaacacagcaggatttcaaaaacacaaggataaaaaaacgtataaatagaatagcatgccacaacaaatcatacaggatttttttaaagaaatgttacaggaaatgaatccactgaatttttttttttaaaaaaaagtttggtaacaccataggagaagtaaaggaattaggagtcacgactcatgatgaagagaaaacatgagatttaggctcatgttaattttcctccaaaatttgttgaaatgagccattccatatgaatttcaaaggattttatatgagtcattcatttgttcgtaaggacaatataggaacatttttcaatgaattgtaatcctctataatttctacagttctcctttatcccaaaggaatctttacgtacgcacaggtaaaattgggactcccatgatcccatctttaccagaaggggcgagctagaggattgccgtgcgtaaatttgcacggtgctagctagctagattttgaaagtagatgaaccgatatataacactttgggtttcatactttcattagtccacatgaacatcgaaccctagcttagacacggcataaatcgatcgaggcatggacgcatgtatcagtatttgcatgattgctcgatcgagattatattaccctcttacacatgcatgcatgggggaataattcaacaacgtctgaatgtctgattcctcatggaaaattccttgtcacatctctttctctgagtactctaacgaacaactggccatgtatgcacatgcaccccagagacaacctagctacgtaccctgcatctgacacccccacatgcacgtaccattgcatctgcttacttcggattgataatacttacagtgaacaacacggtctcttaaaaaatagctttgattactatttctattataatatatatagaaatattaacaaatatataattttattagatcttaacaagcatttctccatattcatccctgaaagttggtttttataggacgagaggagtacatattttttaagaaaattattttataaattatttataatcaaatattttaaaattcgatcttaattttgtccgaaacaacgagtattataagagcttatttggtagagctccaactcctaaatttagcttcaagagttagatctgaagtagagttatatgaagctgcttaaacccaactttgcatgtctagttcattttggagatagctctacacagctcagctgaaattgtttggtgaagctagagctgtgccaaacagggcctccgtctggagagaaagtagcaacgcatccatgcaaaccactcttgctataggctcgatcggctataaatacaagacgccatgacaccccaagcaaaccaacccaaagcaacacaagccatagcagcagagccgagtagctgagctcactgttcgatcgatcactagctcgctagctgcatccatggctgcttccaaggtcgctcccgtcctggccctgagcctcctcctcctcgccgtcgcggcgcacggctgcgagccccactgctccggcggcggcgcgccggcggtcgtcataccgacgccgacggtggtggtgccactgccgtcgttcggcggcgcccatggcggctacggcggctacggccatggccgctgcccgatcgacgcgctgaagctgcgggtgtgcgccaacgtgctcaacggcgcgctcggcgtgaacgtcggccatggcccctacgactgctgcccgctgctcgccg

SEQ ID NO: 13861 - DNA, 1701 bp, Oryza sativa
attcctgcagccctaattgagcatggaaagtgctcaaaccatttgcgcaaaattaatgcatatttatattatatttaattgagtttgttttcatgcaatggccattggtaagttgcatgatgcatgagtaagccggcctgaataagctattatccccccttgtgttagtttaattaatttgttgcatccgcattaatttgttgtaccattggaatcactcacttgtaatttgttgttgtataaccaatgcattgtgatcatcatcaattaatatattttcatttttaatatgatcgttctttctgatctatgaacacgtaagatcgatcgatcgatcaagctaatgaatctgacgaccatatcatggcgaagcatcaattctgaatttctgtttgtgaccacaaccgaatcgatccggagcgcaacaacagaagccgcgcgcagtgctcaaactggggctgtgggctgtggcccacatatgcagacatcgcgactaaagggcccggcccattcgttgcacggcccaaacacacatgaatctgctgcggggtcatcctcctttatctgaaccacacgatttcaatctaacggtgcaggacatgacggcacagaacggccccatctcacgtccttcctggaatccgccgccgtccgccggagctccgccgccatccgttcaccggcattgttacacagaccccttatcctactccaacttcttctcgatggcattccacccagcttgtgactcgcgactttgtgagtacatgataaaaaaaacttaaaattcagatagatattctgacatgaaaattgaatgatctcatcttttcgcttatgcttatacttgttagctaaaatttgaatttttaaccttaaatttgaagttgattttgaggtttttttcatcgaagtttatttttcaatcgactccactgctccagaagtgtgaagcacatgaaggtaaggttcagtcagtcatgggtgcatcacaactcacaagttcacacctcttacatcttgagatgcatcgatcacacggggcacagcaaaaatcagctagctagctcattggttcgggattaattgcatctcaagagttcagacttcagtcttcagaggcaatgaccgtccttccctctttggatcaatttcagatgaatattgagtgtggtccacaaattttggaccaaattaattaaaacgatcatttgggacttgggagcgcctttacaaaccaccgctagatcagaagcgaagaccacagattgaagatgaattaattcatttatttgtgtacaattaggttctacattgatcgagctgcataggtgcccgcaccaatcggacaaagccacacacatatatagtgatcccattaatttgcccatcgaatgatgacgcgacggcgccgaatctaataatgccctgaccctatggtctccggcacatacatgcctcgtcatatgagcttacttaattaagcaccgcaaacttgaaggtgaaggtgtacttcacatgaacattacagatcgatcgatgccacttcattcgtgcacggatatactgtatgcaccaatattgtcgaccacaagatcgtttaagagtacaggtagaatacccagatatatagcttagttaattattaagtccgtccaaaaatatactctctctgtttttctctctgttttaggttataag

SEQ ID NO: 13862 - DNA, 5444 bp, Oryza sativa
gccggaacaacaaatgccgggccgactcaagcaaatgcatgcctagctcactcactcagctcagctcaatcccctgctataaattcactagctagcttgtgcactgcacacaacacacacactgaactctcacataaacacttcaactcatcccttagctagagctatagctagtgtgtcaattagcaatggcggtggcgcacaagaacagtagtagaaacaagcttgcagtcgccgccattgtggcgctgatgagcctcctcgtgttcgccgcggcgccgtcggaggcatgcggcggccgctgcaacggcggcgcctgcagatcgcggtgcgccaaaccgacgccggcgccggcgcgccgcgccgccggcgccaagtgcccgttcgacgcgctgaagctggcggcgtgcgccgacgtgctgggcggcggcggcggaggaggagggctgctgaacctgggccatctgctggggaactcgtcgccgtcgtcctccggcgagcagtgctgcgggctcctcgccggcctcgccgacgtggacgccgccgtgtgcctctgcacggcgctgcgcgccaacgtgctcggcctcgtcggcgtcgagccgcacgtccagctcagcgtcctcgtcaaccgctgcagcaggaagctccccaatggcttccagtgctccagcaactagctaattaagctagctaatttgattatatctgaattaattagtgcttgatgagcagctcatgcagctattgttattgttcgcttatttgatttgttgttaattgctttcggtgtcgtgtgtgatcgtgtagcgcatgcttactactttgatgaccgatgttgagttaattaattcctgtgcttgagtgagtgacattacatctacatgtacctcggagttgatttgtgcttttgcgtgctaaagttcgttataaaaatcttgtgttgaatatatgttgctcgagtaatataccgtatatgtgattctgaatctgagctgaatatggaatagtcagtgtttaatctgcatgcatggagcaagattccgagaaacaaccggtgagtaaactagcgagaatctgaaaaggaatgagtttgccaacttttgaaattctgcaactacaaattatcagaatgcaagtcaaaatatggaatgtttagagcaaccggggattattctcaaagttaaagctgctataggcacccccaaaacagggccaagagctggtttggaaacaatgccagaatccataactcgtctcatttctacagcttaaagccaggttgcacctatagaacattgcccaacagatgaatggcgcaaaccgtggttcagactccagggcattctgtaagaagttacagggcaaatataggcacttgaaaattctaactttaaatcgtcaagagtcaattccttagcatgtgcaatagttgctcaaagacactcatcgcattattatagaacaaagccatgcttggcaggattcagcaaatcacaagattgtaacttataaaaatacagcgacaacaaagacaaccatcaggaacattggaattgtcctgtttttttctctgattaaagaaggcaagagaattcagtccatcacatcacttgaggaagtggggtcttcttctatggtctatcaccaagttcctctctcaaattgtcaaatgggtagacttttggagtctgcatgaagaaatataaaaaatcctcagtcaagttgttcataaaagcaaatcaaaagcagacaggcatcatttgtcgtgattaggatgaaccattatcttaacttgatccggtctatgctcagaaatagtatgcatatttctttgcccattggcgacaaaatatgcaacaggcttgctactgtaacaagtgttactttaatgactgatcgcacaatctaatagcattctggcaaatataaggagataaattgaaaatacagtattgccccctctcttttgtgaaccttcattcttcaattaagttacagacctggaacactgaagaggcaagttgcttaacatgtatagtaactctgctatctgctgacacttttaaggagcaaatcaactcttggggggatttcatctatggcagagaagcaacttagagaaagtaagagactgtgtagcctgtacggagtatcgaacacggataatatgtacaaataaaatcctacatgcttcaaagttcgcaacagtttagcctaccacaccatgtcaccatgatatctctatgaactatgaagctagaccaaacacctccctttttcccctaaaaaaaactcccttttcagaatcgaaattggataggtgctgagaaaggagactaataggtcagaaaattgaagggttaaagagttctacaaagaccacacaaagttattatcacagccccactccatgattcaactcaaactagtgcctagtatgatcacattgaggtaatatttagtgttacatatagaccaacagaacatgataatcaatactactacctccatttcacaatgtaagactttctaacattgtccatattcatatagatgttaatgaatttagacgcatatttgtgtttatattcattaacatctatatgaatatgggtaatgctagaaagtcttacattgtgaaacggagggagtacaattcaagtaatataaatcaaggcttttacatatgaggaaacacaatgaagttatatttacagaagatgctaaaatatagagtgcatggcctgatcaagaagtaaatttaggcatagtgagtaaaatgttccctaagaatatcacagattctataaaataacacctcatacaatatcctctcatccaaaaacatttgaaggcagctaataagggtgactaaattcagcttgctaacagagagtggcaatacgccatatatatttgtaactgtttgatacaagaggataagagcacatgactgattgcatttaggatttaaaatatacatccttcaaaaatgccatctattcatcatattttcttacagtacaactaggtctatgattgtttagtctagtgatgatttctttttatgaaaatggacaacaatgatctcaattccattaaatcattttcaaactcttttttttccctcttttgctgattctataaattggagggtaggaacaatataaaattactctttgctatatgactatatagctaggagcaatatagaattacttgtcagtatatactatatagtagcaaggaacagatcgaacccaaggagctattgttcaacagaaaacttcaatgtgcattgttaattcaataatataattaatgcagatgatcagcatactcccttagtggcctaatcctcatagaagttatctggaggcaaaatcttctaacttgagaatgactagatataacatttagacatattaactgtgccacctagagaatcatgtgagcaaaatggaaggaaaggaatttgcagaaacaacggcaggtcctaatgggcgaaataaaggtttaactatgacacagggattgaatcacagtggccatttcccatcttaatgttttccccattcctgcaatgttttcttggctatttggtctaaccttacagtattactttgttcactcctactgttgttgaaatgctagcaattctactgtttgtccatccaacagaaagtaaaatatcacaatgaagtatttggcactcacataggggatcttggaggccttgtcgttcaaggtggcagccaagccaagagtagcgaagaatccgagcccaccgcaaagccaggccagcgcctcgtactgaccaaatagcatcacatcaaatcaaaccagatgagacccccacgaatccatgtgattcagtgcatgagggttgggaatcagaccttgccgatgtgcggcgcgaggcggtcgatgcagggctccgggaagggcgtgccgttgtcccacaccagctcgtcgttcgtcggcagctgcaaattccccaaatccccccgcaaatcgaatcgattagatggagaaatcgcatcggcggagagagaaatcggaggagcacaaggtcgatgagagggggggggagaggtgtggcgagagacggcttacgggcttgtcggggacgatgtgcctgccgacggggaggcccatgccggcgcggtggcggagcgcggacaccgcggcgcgggcagcggcgccctggccgcccaggacgcgggatcccgccgcggtcagcctccctgccattcccacctcgctctcgctctcgcctctcggatctgcgcgtgcggttgtgggtgacgtcgtctcgtgtgcggttgtgctcgtcggcggcggcggcggagaggaggaagacgcaggagtgtaggtgggcttcagttcagccttcgcattgtgggcccgtgggccgagtggagaaggcaagtattgggtcaaccaaacggcctagtcgctgcatggcccaaacgcctcttttgggggttcggagaataaaaccacagcaatcatcacacgcgcatcagcgatatatattttttattttttttgttttttgttgccgttttggtttgatcggttgatccgaaaactggatatgagaaattgtcggacgaaatttgcactttctggctaggtgactgctgatggagtcacacgtacatattcagttcagttgttaaggctgtgtttagttcctaaaattgagaagaagtttaagaaaagttaatagttttaaaaaaaagttgagagtttatgtgagtagaaaaattttgtatttaatgcgatgtgatggaaagttggaagtttaggaaaagtttaatgtgaattaaacagggtctaaggtgatgagctgctagctactactcctaccttgcaaatgttgccaaaatgaactagctagggcatgaattatgggatcagcgatcagtataggtttcagaaagcgcacaaacatttccactcaacagtacagtacgcgcggttggacgagccataattaattcagatatacagtatgctgctccgtttggttaattccaggtcgccattattaaagtaggtcatgagataacagtccctccatctctgtcactaagagcacccacaatctatctaataaaacatgtacatctcagcaatagactagattaatagtaaaccacctcaatagtatgtctacatgggtatctatagctctctaatccattgtctcgtttttctctatagactatctctaggttagtagataattttgctctctctctttatttaatctctttcaagtaggaaaatatgctgacatggatctcttatagatagcctataaataaccattgtgggtgccctaacagctactccctccgtcccaaaaaaaaggcaaactctgggtttccgtgccaacgtttgactgtccgtcttatatgaaatttttttataat

SEQ ID NO: 13863 - DNA, 3975 bp, Oryza sativa
acgtgctccactggtagaatctagtccaatagtcccatatactcttgacaagtactgttgcttattgtgatatcataatgcaattagtactttattacttattagtgagtactcctacgttcagaagcaacttattagttaactgactaactgcatatttaattaagcggctaagttgcgcgcggttctttacccatcaaattgcataatctgtaatgcggttccaagaacagcttgagtaaaatgagacagagatccagtctcactcgctcaccgaaaacatgaaaattcagaacgtacagtctgcaagaaatctcctcgcactcgccgacgtccgtgctatccgtacgtctccggcggcgacccctcctaggattgacacacagtgagaggggccgcgtggacccagtctctttttagcccaaatgtctccttggggattccacctccgacgaaccactgggcacttgcatttgttcggggtttagccttcatccgaaatctgaaaacgagtaattcggagatctcctctgacatccgagaattgatgcagatcatgcatcaccgtgtgtgtttagttcacgtcaaaattaaaaatttggttaaaatttgaacgatgtgatgaaaaagttagaagtttatgtgtgtagaaaagtttggatgtgatgaaaaagttaaaagtttgaagaaaaatgtcaggataagcaaggaagctgacgttaccaataggaggcgcgataaggactctgacgaaggcggaggagcagaagacggaggagcagaaggcgtctttgaaagagagaagcgccagagtattactaatcctagatatgttgggccggaatgggccgtgtaatagggtagagtgggctgagaccttgtggcacagctggagagagagagagagagattaaaaactactgtgtactgtctgaaacggcatcgatctggaactcggcggtcaaggcagcggcggcggctccgatcctgttggatcgtgagagaaatacaaagttccagctacctatcgtgttcttgagttcgtggtgaaatcgagtgctagggttctaacaatctggtatcagagccatctccaaccatatcctcttgactcggccgtagaatcacgaagcgcggattggaatctgctctcgagcagaatccgcaaaaagggaactcgcttcccttgctgcgtttgggttggctgagttcggagcggttgcgagtctttgatcctggagaaaccacggtacgttacgaagtaggctgcgcaaatcatggcgtaggaagggatgttggatttgctgcttaaaaccctggaggatattgagaagatgcggactgaggcggaagaaagaaacagagcagatctgaatgagttcatggcggcggtggaagcgaggttgcctcaagtagagaaacgagttggggatttgcattcgtcgctgggggatttgagtgctaaggtggaacaactggagagcgccatgcttcgtcaggccaaggcggagaaggcggtgggagacatcaaggaggaaccaacagctgcatcgccatcaccaactccatcgtttatccatggtatgagagatcctatgttgaattctatttcgccttttgtggtagaatcagcaggagtaccagaagggggtagtggaagtactggaattattgttggaagtgttccacccatgacatgtcctcagttcaatggggataatccacagatgtggaaggctaattgtgaagtgtatttcaatgtttacggcattcctcctgggcagtgggttaaggtggctacgctgaattttgttggcaacgcagcattttggttgcaatctgtgcgaaaccagttgattggcattacttggtttgatttatgtgaaagagtctgtgctcgatttactcgagataggcatgaagctatggtgagacaatatatacacatcaggcaaaccaattcagtttcagaatatgtagagcgattcgactgtctaatgcatcggctgttggcatatgaccagactgtgcctgcattgtactttgtcacaaaatttgttgatggccttaaggatgaggtgaggagatctgttatgatgatgaggccccaagatatggatgtggcctgttctctggctttgttacaggaagaagctatggaaggaagtagacccacaccttataagaggactgaaggcagcaattatgtcaagacatccagcaagctcacagccccaactctgtctatgacaagagaaccaaaccaaatcaacactgaagaaaggagaactgctgattctaacagaccaaaggaagataggctggcagcattaaaggcgtataggaggtcgaaaggcttatgtttcacttgtggggagagatgggggagagaccataagtgtgcaactgcagtacaattgcatgttgttcaagagttgttggaagttttacagggggattcaggggaggactcacctactgaaagttcaccagaaagggaagatatcattgttatggccatatctcagcaagcgttaaatggaactgagtcacgcaactccatcagacttagggggtggatacaagggactgaactattgatgttaattgattcgggaagctcccactcttttattgatgagaaaattgggaaatctatgtctggggtaaaattgttgactaaacccttgaaagtccaaattgctgatggaggagagttagtgtgctctcaggtaattcctaactgtagttggtggacacaggggcacaactttagtaatgatttcaagcttatcccactgggaggttatgacataattcttggaatggattggttagagcagtatagccccatgaaaatttattgggttaacaaatgggtggagtttcagtaccaaaatcagtggctcagagtattgggaatcagcagtagcactactagctatgcagaaatatctgtggaacaattgatgagtttggccaagatgggctctattatgtacatggtgaaaatcactgaccaccaaaacacagaagagcagtcctatccagatagcattaagcagattctcttggaatatcatgatgtctttgatgaaccatctgaactaccaccagaaaggtactgtgatcatcagattcccttgatagaaggtgccaaaccagtaagtcttaggccctacaagtataaccccgaactcaaagatgaaattgaacgtcaggtgaaggagatgttagactcaggggtaattcaaccaagtcagagtgcttggtcttcccctgctcttttggtgaggaagaaggatggtacctggcgcctttgtgtagattacagacacctgaatgccttaactgtcaagagcaagtacccagtgcctataatagaagaacttcttgatgaattgtcagggtccaaatggttcactaaactggaccttcgagcaggatatcatcaaattaggatgaaacctggagaggaacataagactgcattccagacacacttaggtcattatgaatacaaggtcatgtcctttggattaattggggcacctgctagttttcaaggggccatgaatgacacattgtcttcagtgctcaggaagtgtgctttggtattttttgacgacatcctgatatacagtcctgaccttcagtcacactgccagcacttaacacaagttttacaactccttagaagagatcactggcaagtcaaaatcagtaagtgtagttttgctcagcaacaagtatcatatttgggacatgtaattggggttcatggtgtgtctacagaacctagaaaaattttggatgttcagaattgggcagtacccactactgtcaagaagctcaggggatttctggggctggctggttattaccggaagtttgttaaggattttggtttgatctgtaaacctcttactcagttgccaaggaagggagtccctttcaaatgggactgctgcaaca

SEQ ID NO: 13864 - DNA, 2171 bp, Oryza sativa
atcttatctacagcaccaagaattcatgattctcactgatcaccacagtttgactcatctgtctgatcaacggcttcatacaccttggcagcaaaaggcatttactaagctcctggggctccagtacaaattgtctatagaaagggcagtgctaattcagctgctgatgccctgtctagaaaagaccttggtgacagtgctcagattctggctgtatcttcttgttctccctcttggctccaagaggtaatacagggctatgagcaggacaagttctcttcccagctcttagctgaattgtctttgaatccgaaggctagggagcattatactctgcagcaaggcctcattaggtacaagggtcgaatatgggtgggtaataacacagatctgcagctgaaattgatcaaggaattacatgataatcctgctgggggccactctggttttcctgtcacttataggaggattaaacatctgtttgcttggttgggaatgaagcagcaaattcagcaacaactgaagcaatgtcagatctgtcaacaggccaaacctgagagggttaaatacccaggtctattgcaacctcttcctgttccaaagggtgcttggcaagtgatcagcatggatttcatagaaggattacccacttctgacaagtataactgcattctagtggtggtagacaaattctctaaatatgcccatttcttaccattgacccatccatttactgcattctctgtggccactgtctttatgaagaatgtttacaagctccatggtatgcctcaagtcattatctctgacagagatagggtattcacaagtcaactctgggaacatttattcaccaagtctggtactaagcttcacatgagctcttcttaccaccctcaaacagacggtcaaactgagcgggtgaatcggtgcttggaaatttttctgaggtgctttatacatgtaactccaactaagtgggccaattggttatatctcgctgagttttggtacaacacttcctatcactcttctgtgcataaaacaccttttgaggtcatttataggtaccagccgactcactttggcatctctatgcatgactgtgaaataccagatttggatttgtggttgaaggatagggatctcatcaatcagctaattcaacaacatttacatcaagctgagcaacaaatgaaagcttatgccgacaagaatcgtactttcagggagttccaggagggagactgggtttacttgaaactccaaccatatgtgcagtcttcagtagcacgcagagcaaaccataaactatctttcaagtactttggaccttttcaagtgttgcagcgggtgggattagttgcttataaactggctttacctccctcttgccacattcacctagttatccatgtctctcagctcaaggttgctcgtggctataatcctcatgttctgtctaccgaaccatttcagtggaaccattggcagagtccgcagcagttcctagacaggcgcattactaagaaaggcactggcttgggggcaagccggtttccaaggaagggagaatgtcaggataagcaaggaagctgacgttaccaagaggaggcgcgacaaggactctgacgaagtacaggatgaaggcggaggagcagaaggcgtctttgaaagagagaagcaccagcgtattactaatcctagatatgttgggccggaaggggccatgtaataggctagagtgggctgagaccttgtggtatggctgaagagagagagagagagagagagagagagagagagagagagagagagagagagagagagagattaaaaactactgtgtactgtctgaaacggcatcgatctggaactcggcggtgaaggcagcggcggctccgatcctgttggatcgtgagagaaatacaaagttccagctacctatcgtgttcttgagttcgtggtgaaatcgagtgctagggttctaacaaaaaagtttggaactaaagccactatttggttgattcgaggccgccattatccaagtcggtcacataataacaagagcaccctgagtcattgatgtctatatatatcagcatcagagtcatttaccgttgaatatctcccaaaatgtgatatcattcatcagatactgcgatatcgtc

SEQ ID NO: 13865 - DNA, 3212 bp, Oryza sativa
aactacagtctaaaccttttttttacatatttatactagatttttaataagacgaatagtcaagtgttatgcaaaaagtcaacggtgtcatacatattgaaatgaaaattctacttaaccgaactatcactgcataattaagaaagccaggttgcagtgtaatgcagtccaacaacaagcctgaaatcattctgctctctagtctgtaatgcagtcgaagaacaagccgtgaacattcagctaggagaagtggaaaacctgacagataatcagtcttactgaacagggaagctgctgattctgataatatctgaacaacctttgcgcgaaatcggcgctgcctcgtcgcagctaccggcgactccccgcgctccataatccgtcgctcgtcgtcgccatcgccggcggcaacttttcttaggattgatggagagagacgggccagcgattggcccaaactcctcttgggattggcccctccgccactggtattatctgcaaaaaaaaaattcatgaatgacttatgtgcaaatcaataaatcatgccgaatattaggagaaaaaaagtttaatctgcatcagatccgtacaatccaatcacaagtactgctctttgttgaaattgaaattaaatccctagtaaacattgaaacccaagtttaaagcttcagaagaacacgacgtttaatttcaactaaggccttgtttagtttcaaactttttctttaaactttcaattctttcatcacatcaaaacttttctacacgtataaactttcaacttttccgccacgtcgttccaatttcaaccaaactttcaattttagcgtaaactaaacacaccttaaccacacctgctaatcgactggttccatgtcggaagagacagaattaatgcagaccatgcagcactgttttgtttaattccaggtcgctattttcgaagtcggtgagattacaacactgacgtctctttcagcatcagccctactgccataagtcaaccctatcagtacatactctccactgtagattcgagccagctaccattgaatttctccatacactgtcgttgcttactgtggtatcatcacgcaatttttcagtgcattcgaagcgagcagttaactgaactatcgctgcgtaattatgcagccaagtttgagcgttactgcagtaaaaaaaaaaacaaaaacaaggtttggagggagagttgtcccttgaaacattttttaagaagagattgtaaacctattgagaatcaaacatggaattataaattgaaatcacacacttcttatcaccgtattatcaaggacatcttataaccgcagtcgaagaacaagcctatctcgttctcccctgtaatgcatgctgtgcagatcaagaacaactgaacaagtcgtcaacttttagctaggaaaacgaaacacagattaagtcttattaaatctgattctgatttctcgttctcccctgtaaattaaatctgattctgatttctgaacagtctttgcatcaaatcggtgctggcttcgtcgcagctaccgcgtgtggtgggccagtgactgggccatttactgacgaaacggcccattctccttttggcccaaacgcctcttgacaggttcggaccccccgctcgcgcggcaaccggaaatcatgaacgacttgtgtgcaaatcataccgaaagattagggaaataatttaatttgcatcatggggtagtgtaattctcgttctcctcaaaaaattcgtaatcagaagtactgctcttaatttgtagaaattgagattagtcgctaatcacttgtcagcattgagattaaagcctttttctgaagaacacgatttctccctccacttaataaccacacctgctaatcgattggtttcatgtcgctattgtctaagtcggcgagataacaattctcccatctccatcaccgtcatctctagtctctaccacctatatcaacagtatctactctctctctctctctctctctctctctctctctctctggacaccgtaatcggcaccatgttcatgccaaatctagccaaaaatctcttgacagatacgtctgctgcttaattactccgataccatatcatcacgcaatttgtttgtttagtaccttgcaagcgagctttacttaactgaacatgaacatatataaactaaccccagctgaatgataatcaaataatttaatcgctcccaagttgcagttgttaacccatccatcgcacgagattaaacatagtaccgacatcagatgcagatgtttccacaagcatccacatcaaatatcatggtgccggagggtcctacatacgattggcacaaatcgagactgcaaaaatcataaaatttgtctcctgttgagggtcgccttctctgctgctgtcccaatttgcagcccagatccaatcagtttttagttttggtttccgagcaattagctcatgccatggaggtgtgaactctcgatggtgattagactaattgcagttctcaaagaagaaaaaaagattagactaaattaatttaattgctgctgcaatcagactactggcagctgcaccgacagggccatgtacgattaatcgagcggttagctaactgccccatggggggaagaacagggattaatcaatcgataatccgttttcttttttcggtctctgttaatcaatcatcagtctgtgtttgggattgcgaaataaagtattcaggggctcacatggcattcattgttcgatgtgtcatgtctcctctagctcctccaatctctgcaaaaaaaaatatagtatacttcaaacaaagcatccgtttttaaatcagctgaacaatcagtttcagtgctgcaaattaaaattcagaatgagcaacaatctcctactacagaattcagattgctcaagcgagaacgacatgtctgaatcctcgtttggtttatctgtcgcagctaaaatctaaattcttaaagttaattttaaagctgattttcctttcattattgtagtttaaacaacgctttttaaatcactaataacatacatatataaaagttttactcgtaagttatttttaagttggttcgtggctgttactgagattaacacggcctgtcaggctgtcagcatggtaatctaggtatgatagaagtaagttgagttcatcgatctgcagttggatatctgc

SEQ ID NO: 13866 - DNA, 15372 bp, Oryza sativa
acaagattgcaagaagaaaagttgttgttggtcgaggcgaggaggaggaggaggaagaaggagtttgtgtgttggtgttatgaggtgttggattagatgagaggaatgccctttggtgggagcgcgcgagaggggcacgcggggacactgctgcaacaccacctcatacacggcgttggcctcgccgcggccggcaagctcgtctcctcctcctccgccgccgccgccgccgccggagcaggtgggttctgggagccaaggtcggtgctcgaccaccgccacagcccgagccccagcccgcctacctcggcttccacgctgtcgtcgcctctcgccgacgtggcggccctcgccggcgccaacgccaagaacgtctccgtctccccgccgccgccgggatggggaacgggaggaggaggtggtgggggggaggaggtggcggcggccaacgaggagtgggtgcaccacctcacgccgcttgatatggggctcggcgccggcgaagggtgggatgccgccgggaacgtgctgtccgacgcggcggcggcggcgacgtcggggatggcgccggacaacacgttcctccgctggatcattggcggcggcgaggacgcgtccgccgcgatggcaggggtcatggacccgccggtgctcgagctcgaccatggcggcggcggcggcggcgccgcgcccgccgcgttcgggccgttcgcgccgccgccggccatggaggacacgaagcccgtggtgccgttcgcggcggggcaccccccgccgaacttcctcctccaacaccaccaccaccacccgcagccgcacgcggcgttcttcggcgcccaccacccgtcgttcgacgcggcgccgccgccttccaagcggcaccacccgatggccgccgcgcctgcgccgaagctgcctccgttcccggcgggcgggttcgtccccgccctgaagccgaaggcggaggcggcgaacgacgaggccgccgctgcggtcgaacagctagccgaggcggcgaagctggccgaggccggcgacgccttcggcgcccgcgagatattggcgcggctcaattaccggctccccgccgcccccacggccgggacgccactgctccgctcagccttctacttcaaggaggctctgcgcctaacgctctcccccaccggcgacgccccagcgccatcggcgtcgacgccgtacgacgtggtcgtcaagctcggcgcctacaaggccttctcggaggtgtccccggtgctccagttcgcgcacctcacctgcgtccaggcggtgctcgacgagctcggcggcgccggatgcatccacgtgctggacttcgacatcggcatgggcgagcagtgggcgtcgctgatgcaggagctcgcgcagctccgcccggccgccgcgctcaaggtgaccgcattggtgtccccggcgtcgcaccacccgctcgagctgcagctcatccacgagaacctctccggcttcgccgccgagctcggcgtcttcttccacttcaccgtcttcaacatcgacaccctggaccccgccgagctcctcgccaacgccaccgcgggcgacgccgtggccgtgcacctccccgtcggccccgcccacgccgccgcgacgccggccgtgctccgcctcgtgaagcgcctcggcgccaaggtggtggtctccgtcgaccgcggctgcgaccgctccgacctccccttcgcggcgcacctcttccactccttccactccgccgtctacctcctcgagtccatcgacgccgtgggcacggacccggacaccgcgtccaagatcgagcggtacctcatccaccccgccatcgagcagtgcgtcgtggccagccaccgcgccgcctccgccatggacaaggcgccgccgccgccgtggcgcgcggcgttcgcggcggcggggttcgcgccggtgcaggcgacgacgttcgcggagtcgcaggcggagtcgctgctgagcaaggtgcacgtcagggggttccgcgtcgagaagcgcgccggctcgctctgcctctactggcagcgcggcgagctcgtgtccgtctcggcgtggaggtgctagaaagccctcgccgccgtcgccgtctccggcgagcggcgcagccgtggagccgacgtatcaaggagccgcggattttagttagggactaatgatcctgctacttcttcctctccaagtgaaagtcaagtgtttttttaccctttttgtgtaacttttttttactccttttttcttcttcttctttgtgttgctgtaatgatctcagctgagctgatcagtgagctgagtgtcctaagattgtcgtgtcaccttgcagcttggctctgcttctgcttctgcttgtgcagatgcagagtgccatgtcgcaatggtgttgtactggtacagtagctggcgcattctacttcaccatcatccatccatccatccccctgtgttactactcgattccccgtgaaaatcaatggctatggcatttgaaaatttgttcttccattttgatcaccagctttgacatgttttttgtgtcgtattctgaattcctgtttgtacaatttgtgcagccctcttatcaaagaaagagagagaaaacgatggaatgtacacctggttattgtattagttgtaaggactcctttgaaacataagaattttacgaaaaaatatgtagaaattatagttcagttcctacgattcttatacgaaaaaatatgtagaaattatagttcagttcctacgaaatcctcgcgaattcctctgtttataaaagagtgcaaaaggtattaaaaaacgaccgatttgtggccaattgacttacacttgatttagaaattccacgaggaatttcgcggaagtttcgtaaaatccattacattcccgtaaaaccgagagagaaaaaaatttcacgcaaaaatggaatacacgtttatgcttcactctccaagagtaataagacaactggaaaggtaactagatagatactagcaggcaggattagacaagaatttgcgtgtggttaggacgtaggagcacacgagaaacgttcaggttttccgaatagctctacaaggtggttttattcgaaaccacacttcttctatttatttgatattatgtttttctctaatattcgtgtctttttaagatatagcagcacacacagttgcaaacagcagcctccggaggtagcaatcgcgaggtagaactagaagaaacaaggattgggaataaagcggccatgggcgacccaagcaagcataaaggcgtcagacaatttcttttagctcctcttctacgagtgggattctgaactgcactcgcccagcaacaaacaagccccctatatttgacagacttggctaatcaaagctcaacactagattaggttagttgccttgcctccttagctgttaatcataattcatgctacatcatgggctcatggcttcttcagcaatgcatcttccatctactcataattctattataccctgtctgcctatgtagtgtagtagtagtagtagtatcgtttatctatcaatatgttttggtatctgtcacttcttgttctgcataatagtatatattgtccatacttcagagatgtgtacagtttgttactgtaatgtattggtactatactagtattaatacatttattggattactgaaaatgattaccaataagactatagatattaattaaatattttaataaataaacttaacaaatactagtttaggacaagagatctaaacaatactacatccgtcccaaattagtggtcgctttgacttttttttattataacgtttgactattcatcttatttgaaaaattagtgcaaatatataaaatgataagttatacttaaaatgcttttgataataaagcaagtcacaaacaaaataaataataatttcataatttttttaataagacgaatgattaaaagttacaaataaaaactcaaagcaataagtattttgggacggaggtattacagcgtaagaaattatgttttaagaaaacgtatcatttatctattaatatgttttggtatctgtcacttcttgttctgcatagtatactgtccatgcttcagacatgtgtactgtttatacagtaatactatggtaacaagcctatgtaaaaaaaaatacagagattagccatgcaggcaatgtgtactgttgccattgtctgggcctcatggtggcttccttgttactcaaacgacataattaaaagcatacttaaacattggctcctttactgttaatcaatgcagctgaagcacaccaccatcctgttactgttattgctttatgctcctgccttgcacctctaattctgtttgcactggaccacaggggagtgatgatttgtcaatccgaactcaactgtttggacacatgacagcctaactaattaagctctctaatctgctccttccaaactggaaggccacatttaatttagattattgaacatattattgtgaaggactatcaatttaattatgaggataaattaaacattttcagagacaaaattaacaataacatgaaacaaacaaaaaaaatctaagcaatgtaatagataaagtttttcctttcaaaaactcatattttccgaaacatggaaaaataatccggtgaaccaaggccgtgtttagtttccccctattcccaacttttcatcacatcatatcacatcaaaaactttcctacacacataaactcccaacttttttttcaaactcccaactttcttcaaacttctaaatttttttaggaactaaacacaccccaagctgaaaagaaccaaagggaagtaggaggatatgggggagagaaatataaaatcctgtcagaatataatgtcagtctaaaagcttcagataagggcattgcatttggcaagcactgttgcacattgaagaacatatggtgatggggtgccaacgcgttttgtcttggttttttccccatctatcatgacagaattcttcactgcaacatgaaccgaatccttgcttgttctccagctgctgcctctgcctgtgctggagatgcaaaggaaggggggcaatcatggtgtaaagcgtccatgctttactgaaatggcggcaaagcatcttagggtaaggtgattagggtaccgaattcgtccacgttttgtgcaccctggttaacgatggggaataaaacatcctctccaattagcctgaggttgagaataatattgtaacttgtaagatatagatggcatcatcactgagcgagtgagactggaaatcacctcattgggtttacaagagggcaatgtatgctcaaacttatggatgcaagtccttgttataccatatatacattttttgtggttttgaggacttgctataccatatataaattccatcgatgacatttacatcaacaaaaacatttataacacgagtttaaacaagcaaatatcattgtcatttcaagtaaaatcactatgaacagtgttatttgttcgatttcgaaaattaaggatgaaaatgtggtctttttagtttagagtgaaaatatactttgagcaaattttaaagaacaaatgaaaactttctctatctcctagcatatctcattgtctacttgttggcctaaatttggacccaaagttatttttagttactttcttttacggcttaagttaatgttctttttcatctcctgttctattaagtgaaaaggtactcctgtgctgtttttcgttcaaaaaaaaagttctctttcatgctactcaccgaattactgaaacggattatttactgcacactttgaaaagtacattttcttataaatctgtcacctaaccattgtttacaccacttatttcaatcatacacaataatccatccaatgatctaaatcacactactctattaggacaaaggaaaaaaaaacaatagcaccacaagaagcataacagagtggaagtcaggcagaagatctgtccaaactccaaagcttgcaatgcatttgcagccaggattggagttcaccaagagagcatggggctggaagacgaacatgtggggccattcccaaaaattttcatagaatccctgcattgtctctcgcagtcactgctgctcatcagcctctcacagacctgtttgcctgctgctgctctcttttcatgcagtgaacctgttgaccacacacacacacacactgactgggccccgggccccacccacgcctgcccagcatcggtcagtgaggacttgtcgatccgatgatccaatccgtgtcgggcggtgtggcgccaccaaactggcgtgtgggccccacctgccccaaccctttgccaccatggttttagggcacggatcctatgccgtaacgggcccacgtgtaagtggctgtcataaactgtgtgtggacagtcgtattgtagagaatccttattaccggtagtttcaaaatgcgaccataaccgcttggtaaagttgtgaacttgtcatgttcaaaataggctttgttcggcagcgattgctaaggcgcaagtccacgacaactaaatcaatatactcacccgtcttaaaatataaagattttagttggatgtgatatgtcctaattctacgaatttattaatgctttacgttcagattcataatactagaatatattatatccaatcaaaatcccttatattttagaacggatggagtaataaaagtactcctcagagctgtttgaagtctatttgtaattggatttcaaacatggctaatattgaaagtaaaattcaaatcgaaaaaaatgtttagtttcatctttttatctttcattattgaataatgaatggtaaccggggtttatgaacggagccgataggaagtggtaaacgtactccttccttctgtccaaattcataataattgaaacattatatcctgtattagatagttatattttaagatggacataatactttgtaaaacagtaacaagtcgcatttataaaccctgcttgccgctctactttttttttttaagtatacattgcttgctcatgctcggttgctaaggcatgtgctccataatttggcgtttgccatggctagatctggtttgatttcccctagtttgtttaacatccgaataaaaaacttaccagtctaaacaaatagcagtagtgttttgttttgtttaaaggctaaacaaatactttggttggcagaagtggccgatgcatgccatcgatgaactacgcataaacaaatctttctactactaacttagcttgtagccaccaacaagcagcctcagattacacaatacccacacatgccttcccccaaagtcccaaaccctaaggtacaggcacagccacaccgaactcccatgtgtagcgtgccaatgtgtcgacttgttgccaaacagctacacaagaatgcatgtggcttgcatcactcactcatggcatgttgcttcttggcctcgccgttttttgtcctctcctaatcctcactcaattaccttacctagttttagttactccatccgttccaaaatataaatatttttagctataaatctgaacaattgattcatagaaaaaaaatgttatattatgggacgggggagttactaccttacccccaactgctgcaacgatgaacagcaatcttttgtatcatgcaaaacaaaaccaaaatcctcaccgtgatacaatgaagtagtaggagctaaaatgctttgcctgcttccatcggttgagatggagcttttgcttgggatgagctcccagtttgagccacaccgtttgtcatctctcttctcgcaatgcaacgccagctcgtctcgtgaagatagggggacactgaacagaacttgactggacttcacttgtgatgtttcaggacaggcacatcaagaacagcagcagcaacattggatgggtacaccactttaacctgggactcagctccagaatggccatggcaccgcatgcacaaaccggataggttgagatgggctcactggagagtcactggagagccacagtgtgcagcaggagcagtagcaataggtcaggttaacatcatagccagcaacaaccagcctcactgttctcttgccaacactcttccagcttcccactgtaacaagaacaaccccaccgtgtgccgctgacgggtgggccagtgacggcgacggccggcgacgtacgagtgcccgtgacacacgggacggcgatggtgcaggccggccggcagtgtgcatccaatccaacaaaactatctgtcccggccatgctcacagtcccattctgggcacaaaccgcagcagggaccgcgtgcttgtcatcactcttaaaccggccgagcttgttgctgcactgcatgccttaacactgtttcctcttcatcgccactggcaggcaagtggccacactggagtacgggacactgcaggagcaaactggcaagagacctgcatagtagttacagagatggatgttaagcttgctgataaattcagaaaaaagtggtaccacagttcaaaacttcaaagtaagtgaggccaagatccagtctcagacacggtgcatctttcccaaggcgtatctgtactgccaaaatgtaccatttctgacgaggtatttcgtgaatcattattcctcagccatccaaattgctcgcaatacaaaaacaggctaaaatgtggtttgtgccggcgactcgcaaagcgcccagggacaagagttcgctttattcccccctccaacatctgcacattttagtcgtagcttggtttcacacctccaaccgttaaagtaccacgaatcaatcgcagaaagaaggtgcactgttggtttaattaagcaggacttgaaagttcaaaaccagggaggggaatcagaagccagtagacacaaaggcctccagatctcattcagacaggttcagatttcattgcggaagccaaataggaaatgcaagcatagtggccagtgagtagtagtagcacattgtgggctcgaagtaccccctcccttggaaagagctaaagatacgcaacttttaagagccaaaaggaaaagaaaaggcagtgagagatgaagcaaagagatggatgtgtcatggtgaagctgccttggagagtgggattcggtgccaactacaaggttgatgcatggggtcgcaccatgcattggccagcctttgtatcctcttttctctaaaatagagtttccgatgaggaaaagatagtatagggctgttaagccctcactgtagctagtaatagcctagcaatatccgtacgtgcaatgcctatgaattgagcttgcagaaaagaaaaggcagtaaaggagctaagcagtaaagaacgatagatttttatctacttttgatcaaaaggaaggaaagaatgaccagaatgatgcattttttttccctacggctgtttcctgggctctctacgatgaaaatcaacagctcgagtccctactcgctactccctaccacgtgaaatgatttcaggactgcaaagttgatcaatgagaattgctattacctctccactaaaataaacaacttaatgatttcaggactgtaaagttgatcaatgagaattgctattacctctccactaaaagaaacaacttaaagataaaagaggtaatagaaatctataatcaatattgggggggggggggggggttaatctgatacaacatatttgcaattcccctcgcccacctcctcctacagtttaaattcactaatgcaggcagttactatatttaagttttgtcgatgtggtgaaaacatggaaaatggttcatttgtcagaaagttcaagataggttttacagaacttcactaagacacataacttaagccaagctaagagtagcataacattgttagccaattgcctggctcctaaatggaagtcaagtcacagtattatacaagacatcacgaatcagttctttgatggtgatggaattgtgctcacaagcaatgtcattcatctgaagtaatagtcatggacagggcataaataatggcaacatggttcaatggttgtctggttgatattacaggtcaactacatatgctatatttatgctgaagaattgcatccactcaaagtcatgttcagaaatacacaagcaaagatatgccaaatagatgtccaaaaatcctagctcaagttggtgacaggattattgatccaccatgcaatagatgttttaaacagtcagttaccttggttatcttcattccaaaattcaatccaaactgtgcagataacttatgttttccccctgagccgacaagtattatatgtatgatctgcataaacactaactttatcacaagctgattaaacttgaatataccttagaaagctccgttgagggaaaacaggcagaaccttcactaatgtcacaaaaccaatgcagagaaacttgtatatgcaaaaaaggaactaggaaacaacatgacaaaatcatcaacgcagaagggaatcaaaggtattgctctcaaatccttcattgctaagagacttccgtgccagcaaagctcatgaagtaagcttttctccagaatataatgtccgtatcaaacatgcaaattttgtttctaatactaaatgcgcaacgccacttgcctatcactaaattgacaaatgaattgacattacaataatatccaataaaaaaaattctgcaaagcaggaatgtatcacaagaaattcgctaatgcgtcaataccgaaccacatgtctgccgtaaggcatctgatcaatgaaaaagaagatgaaagcagatgctctttcatcttcctgaagaaggttcttttgcgaaatataatttatagagaacctttgacacatactttccatgatggctaaagtatgataaatgtacctggaatgtttatcatgttgatgaaccggtcatgcagaatgaggctacatctagactgtgagtattggttatcccatagtttactgcaggatgacatgcatatccttcaggagtagatcatgaactttccagaccagatacaagtgtaaaaacagatgaatgacaaaaataatcatagtcattattttgtacccacgatagtaaatacatgtaacagtaaaggatatagtcaattgctacctgataaaaaatataagcaaatcgataaagctgttcaagagttgcagtgtagcataaacaataaagtaataaacaaggcaaaccaaaaattttaatcccattgaagtaaaatacatgaattatttaattctctctccctcacaacgaatgcatccaagcaagcagagacctgcataaactagtactatatattatagcgaactaaacagattacacttaaggtagcattgcaataagaaaaagtaggtgtaggtatgtacgtgtgcaactatatattgaaaaccttttgaaatatttgagctacaagatacagaaagagaaaatagcttatccttgtttacaattgcagaagagcaaaactaactaattcaatagcaacatatcgatttccctggaaattttaagtgtcttattacttgaaatagggtggtatgccatacaggctacttaataacacgaatactatatcatatttaagttcattgcataaagataatttaagtagtaaacatcggtaggtatgcatgacacacactgtgaaatatgtagctgctccagtaatgtaccatcaaatgcaaacagcttctgaccaaaacctgatgagaggacccttaagaatctcatcagcttgtttgtcaacacttatctccaggtgttcagagataacatatttgatctttttagggtttatcatgctctactaatgtatttgcctgggattataagcttggtctgttatctagaagttcatgttgtttagtcatctttggtttctacaaaacccttgcaaaaatttctttgtcgacttttattcttcatactatatatatttcaatagaactactgttctcctaaaaagtacaaacatgtagcaaaagctgatatttgacaaaactataaaacctgtgcggcttaagagtaacaatctgcatagatatacaaacaatgacataatcacaagggacaggtgctttttactttttgagtaagcccgatcactacagaatacaaccatcttcataggttaagtaatgctacagttaatctgataaagaagaaagagagaaaatccacattggacatggagatgatgaggtcacgagatctccaaagatttcaaaagcagacttatggggagaatatatatggccatatgggagtgcacgaaattacattcactttaaaaagggcccaggtatgacaacaagcttcctaaggtcagtgcaggactagacataaccaacaaacatcgctggagcttcagtatgtattcgatagaaagtgcagctaaaacatggatcagcatttaggttggcatcaatatctgcagaggccatgtaaaataaaaaacctactacattatgaaaataccgaccatgtaatcgattgtatcgaacttggaaagcgtgatatcatacattggtctaacatcagagaagtggacgattctgctaatttctaaaatagttcaaaacagtcagtactgaaaaactaaattccctaagatcacacatggcatgtcattcagctttacaataaatagatacatgcaatactattctaaggaaaaggttttgctgtatgatgctgtttgctgaaggtggttgtgcatttatcagtttggtgattaaagttcgctgtgctaacaaagcctcctacaatagtaagccaacactttcgaataaatcaatgcgtattcattttacacaacatagttccataattgcacttacctgaacatggcccaacaagtgtacagattggaaaagtgacttatcttgcttacaagttaaattcataggctctgaagttaaatcaataataagtacacaaggaacatggtatgctataatctaatacttttgttgcttatacagaagtgtgtaaagatcatcattaaacctactaaattgattgtaaactattagccctatttaaggtataaggtttacatggaacgaactgtaaaatgttacctatgaaacactgaggagagccaatcatccttctagcttgagagaggtttcggcttccctcgccttctacatcctactcttcctcgatatccctgatcgcgcaaccacatcctcacccatgaagctccatccattgttgtctgcaacaacctctatcgacccatccccttccctcaccagcggaatcgagaaatgcagcttctgttgcagtgcatcaacccaataaccaattcccaaaccctgtttttcttcagtctcctgcaccctcaccttggagaaatccctgagcattgtcctgcccctccaagccaccattttaacattacacaggtagcgccccctgatcggaatcgtccttcctcgccctagaatcttcataccaccacccttcttcccattggggatggacggcgcgagccgcgaggccacgctcgatccccattgacctcctcgtccccatcagcgggcgcctcgactcgagattggagctgcccaaacccctctcaccacaccggcgcactcatcggcgcatcctcgtagtcgtagatccacgcgaactcccggctctcgccgcggcgaagatgaggtcgtcgtcctggaccggcgccgccgatggatctcccgctcgcgaagaccagcagcgcctccgacatcgccgccggcgccaatccatccatctgatggagaaaaaaaaaaccaaaaatccaaaccaaaccgatcaaaattcaccttcgcaaatcgaacacggatgcctcgcacgaacgaaattgagatactgggtggcgaattcgatcggagactcgctacttttttgggtggtggattgggtttcgtcagccccgaaacgcgaatccgaaggaatcatcggaaaaattctggggtttttgttcgtagaatattcatatgcttgactggctcactgcctaaaatggaagaaaccaaactggctataggccgaattccaaacagaacatgaaagaaatttgggccttgaagcccaataaattgaggcccaataatacaagtacacctaattagcccagtagcctcggcctgacaaattgtccacagctctcaactagcccgtgatctcaaggcccataataaaaggataattcaaaattctggcatcctcatccacaaaaggaaaaagtacgccgaaggtccctcaacttgtcatcgagttacaaaatcgtcccccaaccacaaaaccagatatatcatatccctcaatttacaaaaccattcactttaggtccctaggtggttttcacccggttttatctgacgtggcagctgagtcagcgtgggacccatgtgacaggtgtccacgtcacctctctctctctcccccctcttctctccttcctctctcatttttcgctccgatgtggatggcggcagagtcttcgacgcgacggggaggagggccggcgtggccggcggctggcaggggaggagcgctgcggagagtagggccgatgcgacgggcgccgccaccgatggctgctgtcgtgcagatggccgcggcggtcgtccccctcaaccgtcggcctcgatgcggcccagcaatccgctcacgtccacgatcctctccgtgcacctccgcgccggggacgcgtcgttcgtggaggtcgtcgtcgcgcaagcgcggccgcgcgggtgttcgacttccggtcgccgctcgtcgacctcctcgccgtcttcgccgcgcgcttctgatactctgctgaggcgcggcgtacctgtgggtggtggcgatgagcgcagcggggtcggtccgtggtcgcgcgcgccgcccatccgcctcacgccgccaggtagctgatggcgaacccgccgccgccgaacgccatgccgtacgagtgcatcacgtcctactccacgctctccgacggcgccccgacgtagtacatctccgcgtggtcgtacttgttcagcacagccaccaggttgtccgggaagaacaccgtgtcgttgtcacctatcactcccagtgcatcgtatcacgtggcacaaccatcggaagagcaccccggaacggaatcatggcagcggcggcgacgacgaataagctccagacgatgcggtggagcgacctcgacgaggacgacgactacggtggcggcggcgacctcagcaccctgctcccaccgcgcgtggtcatcgggccggacgagaacgg

SEQ ID NO: 13867 - DNA, 9010 bp, Oryza sativa
tctccccggggcaccaccgcagctccgcatacccgcgccgcttgtccccggcgcggaggtgcacggagaggagcgtggacgggagtggattgctgggccgcgtataggccgacggttgagggggacgaccgccgcggccatccgcgcgacagcagccatcggcggcggcgcccgtcgcatcggccctcctctccgcagcgctcctcccctgccagccgccggccacaccggccctcctccccatcgcgtcgaagacgctgccgccatccacatccaagcgaaaaatgagagaggaaagagagaagagggagagagagaggggtgacgtggacaccctgtcacgtgggtcccacgctgactgaaccgccacgtccgataaaaccggggtgaaaaccacctaggaacctaaagtgaacggttttataagttgagggatatgatatatctgattttgcggttgggggacgattttgtaactcgatgacaagttgagggaccttcggcgtactttttcctccacaaaatggtttcaaaatgctttgctatgcataagcttatttgaacagttgtttttttttataaaaaaaaaacgaaactgtgccttcctctctcccctacttagagcaagtttaatagtataaccaactactagcttcaaatcatttatagctaatataatagttaattcatacaatagttgcttactatactattaatacctggtcctacctgtcatacacacattacgtttttgagtctgtgctgtagctggctatagatctgtagcccgctgctcttctatctctttaaaatatgtttatagctggcttatagcctgctattgtacctgctcttatgacaactaggctgtgttcgctggattgtgttcccaaccggaacagtacacatggaaaacagaacggtctattagcacatgattaattaaatatttgctattttttttaaaaaatagatcaatatggttttttaaaagcaactttcgcatagaaaacaagaaagataagttaggaaatctgcgtaggaacacagcctaaacgtgtacggagtaatcagatagctcccttgatacttgaacgtgccctgcatgccgtacacgagcagaacctgcatagatcttgaacttgttgcgctcatcaaagaggtcagaatgccacgcatctctgatcaaaacacacatgttcgatcggcttccacgcatagtgcaggtgtcacctgttgttcagcatcgtcagcccaattgcagccgacaggagtattctccagaaaccgcacgtggtggacagattttgtgatgacagaatgaaccctgcctgagctgcacgatggtctgttcgaacgctgaatttgcaggatagccttcgaaaacgtgtgaagattttacttcaaattcccgggtcatccacgaagcgcgcatctggaatacgtaaaacggtggtgttttgtgacgataagtcgtccgtgcaaacgaacttgctggaatttgaaacgcgtttacggaacggaagcctctcgattcaagataagatcagtgcagcacgagcacatcatttcgttgatgattcagtttattcagagatcactatcgattgatacaccaatgtctgttcttttttcagaatgataggagtatttacaagtttacgacttctactcatgactcgatcgcttcactcccaagtcccagtagcaacacaaacagataaggcagcctcagtcttctgccacctcactttcactcacgtcccagcattgcagccttgaacctcctcacaagctccttcctgaaatcaacaacaaatcacccaaattaatctcatcaattcatataattataaaatctgtcgcaaagatttgaatctttttggtataaaaaaacgatgggagattttgatttgtggattgcaattaccggagcagctgtctgtcgaaggaggaagacgagagcaatcccctgttctcctctgctcgtctgatgaggtacgggatgatctgctccactggaccgtacggcaggtacttgctcacctggaacccggcgttgcggaggccgagcgagaggccatccgccatgcccatcagctgcgcgaactgcaggccgcggtcgccgccgccgccgatgccgagctccagcgccctcgccgcggcgagctgcccggactcgacgttgtgcgtggcgagcgtcacggcggcggcgccgcggcggacgcggtcgaggaggaacgcggcgcagccgttgtagcagtcgtgggtgtcctggatgctgcggtggaccggcgacggcacgccgagggaggccgcgaggcgggcctcgcgcgccaggtacgcgccgcggaccagcttgagcgcgaggcacacgcgctcgccctgcgccgctcgcgccatggcctccagccggtcgcgcgcgtcgcggaggtaggcctggacggtgccgtgcacgatgggcctcccgccgccgttgaacgccagcgcgccggcgaacgtgaagtagtcgatcgccggctgcacggtggcgtactcggcgtccaccagcagcgggatgtcgtactccgcgcaccgctcgccgatcgccagcagccgcccgtgcgccatctcgagctccctctcctcctccgcctccagcgccggcggctccgccgccgtcaggtacagcgggctggagacgcacagcaccgggaacccgtgcactttccatggcagcttcgtcgccgggtgcttctgctgccaccgcagcagatcactcgccttctccagcaacgcgaccgggcacagcgccgtgatcttgatgcacacgctcgcctgcaacgaacacgcaaaaatcccaaagcaattcagcaaccacacaaatactgtcttagcttaatcactatgctaattatggtgtagtaatctcgttctgtagtgttgttgagtgtaattaagagtgattagagatgtctaaaaaaaggattagttgatggtattaggagggttttgatgagaaagcgggtggaatggaaacgagcggcggagagagcatgtcggaatcatgtggctagttttcagggcccacgaggcagtggcatccgtgcgattcactggcagtttactaccggaagattcccaaggaatccgcgggtccgctcgcgcaagattccgtcctacgtggcagcctcctggtcccacagccacgcacgccgacagcgaggagagagaaacaccggcgagggttaagcggcggcggcggcgactcaccgagccaggaggcagcgcggcggcgacgtcgatggcggcgaggaatccggcggcgttgcggtcgcaggcggggccgtcctcggcgtcctcgatgccgtagtcgaggatcccgcccatgccgccgcgccagaggcgggcaccgccgcggcggcctcctcggcggtctccccggcgcagaagtgctggtacgcggtggccctcgccgcggcgcgccccgccgcgctcccggccaccgccggcgacctcagcgccgccgtcgccacgtccacgagcgggcccaccgacagcgcctgcagcacggcgagcgtgcgcaccagcgacgtcgacctctccccggcgaacagcctctcggtatccccaaactccaacacctgcgctccctgcgcctgcacctgctcctgcacggaagacgcgacctcctccaccgcctctgcggcgcctccggcggccgcgacggccgcctccgggagcttggctgcggcggcggcggcgaaggaggcaagcacgcgcttctggatgcgggaggcgatggccatggaaggtcggacttgtgcctgacacacccaagaaaacacaaaccaaagcaagaaatgctctcctcggaggaagaagagattcagaagaaggcaatgaatttttctccggtgcaaaactagcaagacgaggaggaagacgagcaccaggtcggggcttataaaggagaaggaggaggaagtaaattgatcaaaaggctgtaaattcgcgagctggttgaggttgaggtgaatccaagaatggaggagatattgcggggtttttttgtttctatatataaaaaaacgaaaaaaaaaaggagaagactcgcgacaattgacagggagaggatgaacgagaaatgggatggaaaacaaacggaaacacgaccagagtgaaggcgaggttaacgcgcgcgtgaggcaaaaaatatatatatatccatgcaacggcgtgtgagaagggacatgatgatgaaagcgagcggcgagcgagatcgccggaggatgctgctgactcggccctcccttggaatgcgttgactgactcggatcctgcgtgcctggatggattaatctttttgtttaatccctttccttccacgcctcgatctctttccttgcaagcatgtactccagtagacaaggttgtcaggatcgggataccagacagtatcgttttgcttaaagtaatatcatattatagaatcgtatcatagtatcgggatactatgatattttcttttttaagtttaattaatatttatattaattatatatagacattctatataaaaaaaatatagtaacgatatatgtcatgcaaatagagacctttatcaagagaaaccacattggttttgatatatttaactgatttttatataaatttgagcatatttatttacattattttcaaaccaagatattttaaataatattttgtagtatcgtagagatcgtagaatcgggataccacctaagatttcgtaggatcgtgtagtaatgaatagtaagatcgagatattatgaaaattaggatattaggtgggatcggtatcgtttcggcttggtaggatcgtagtatcgtaagatactaggatacaaatcgggatactgacaaccttggtagtaggagtagcactttccagtttccaggtctcttttaggtgtttctcaaaaggaaaaaaaaagtcatttaggaactgaaaaaacgtgctggaatccgtttctcttaaaaaaatgtgctgattttgaaaagaaaagatagaggataatttacaatatatagacggggtctacagaaagaatataaatatgtttatgataaagacatttgagactatgccctttttttttagtattgtgctctaatttaccccctttttgtttactctctggttttacgactttaatttttaccacttaaatctctctggttcatttgagatttttggttgtgctaaatagctctgctgcaaaatgggatagtttatcacgacatgattaattaaatattaatcattataaattttgaaaatggtttattttattttaaaacaaacctgtatatataaaaagttttttttaaaaggtaatacgaaaaataagtggtcaagacagtaagttttattaatccatgagacatttttttttaagaattacacaatacaacacagacacccataaagcacacgcactcacctctgtgaacacacgcatgtaaaccctacccctataagtatcttcgaagactgggccggtaaattctagagagattgacgaagtcaccacagacgtctcgctgtcgacgggtacgtcatctaccactgaaatcacaacgccgttaaaatcctgaaaagtttgctcccatggggagtcgaacctaggacctcaggtgatactgaggctcttgtaaccactagcttgtaggccctttcgcgagacgttttaaaattctaatgacagcactagcaatctgtaccattcttcttgatgccgacggttcctttttcttaaggtgatagttatggtttttactcacctatagttgttgccttgctgatggctggataatcagcaaatttcaaaagtcattttctgacttgacagcatgaaaatatataaccttgctatccctttatagtttgaatttggattagtcattactagaaaatagaaatgttactctgacttactttttttttctcacgcgatttaacttgtaacacatatatccgactattttaaatctaaacatgtgttttgtttggagagcttaaaattctgagaaccagctagttggtagccagcttcgaatgtggaaaagctgggttttccagtttctggcttctagttcattttctgtattatacaactacagcttcttaaaatctgaatcggaagctaactgtttgggtgagcttctaattttggatgttacataggattgggaattcaggatcctctgctttgccaactgcagagtcatcagtatcctccttgccttccaggttaatttcagctctcacgaaatgccagatcaagctgggaatctgggatacgacgagcaggatatgaatccctacagcaaattaaaaattctcataactattaaagaaaatataagctttggtaaaaatgtaaaatgcctgacctgagttctctgtcgtattgtgtctcctcggagggcgaccggtgcagccagccaacggcggcagccggccgggaccgcggccagtgcagcgcgcgccccacgcgcacgcactcgataccgacggctgtgccgacagcgacgcggacggccgtggctcgccggcggtcgacgtcgccggagacagccgctgcaaattatgacggcgcgcccacacacccacacacacgtgaggctgcctgcctgcccagcctgggctttgctcatcagcatcagacaggatcagatcacagtcttaattagctgctgctgctgctgtactaattaatggagtaggagtacttaccatagatgcataagctgacactcgcctgagctggacctgcatcagcgtctactgtaccatgatcttgatgacttgatgaatcatcgatgcgtcgacctcccggttagctggcgcgccgacttatcgatccgtgcgtgttaattaatggcaagggctcccacataaccgtgaaacttctgctctaaaccctgcgattataatacgttatcatctctgatggttcagccatgtgagctattgctaataaagaattgaattgcaagttgctgctgtgtgtatcgtcgtcatggcgattttgacagttctgctccctccatgtccaaatatatttttcaaacacgtcaaacgattgcacattagtatattagaataaaaattcattcttaatatatttggatggaatcattcagtctactcggcgaaaaaaaagtatattacaagaaaataaagttttacttacacaacgcgataggtcgtaccggccatttctgaattacaaggaaagaactgcagggagagaaataaggaaaaaaataaaaactaaaagctgccgctcctaaaaagagggagagaggaggtgaaggaatcacatatcgggccccaagctccgcgcccaaatactttttactattggctgtcactgtttcaatttttatcggttaatggttttcttaaactcttttcttctaatatattgacgtgcaatctttttgcgtgtttatttttttttctttttctttaagatggttagactatgatgagtgggatattgaattattgatacttatgtttaggacgtaactactttgataataccaaactatttcttaagatttttttttgttgtaaaaaaaagacgtacaatcaaaattgaaatttgagtagttcagtcttcacccgataagtattccatggaaacggagggatcggagtaccatatttttgttagctacacggctctttgtgtgtgacggtcggcatgtatatatggtggtagatgccagcaacctacgcggcctttgccgcgccgttgcttagctacttcatctctaattatcttccttttggctagtggttgaggcagcggttgttatctgtctccgttatcatgtcgccttcctgttcttactcttgattttgctgtcgatttcctcagctcacaagggtcacagtcgcatgcatctctgaattgaattttgctgtcgattcttgcagttcagttggatgccgtgatcaaccactgtactcagccgcggttaattctctgaatctcttttgtcccacacggcgagagagagaaattatcaaatgaaaatgaatctgacgaagcttcgtaagccgctttcatcttacgacgataaaatcaagtcaaatcaggccaaattacccgtcggcctagctttgcgtgggatgcgtttggtctcgtctgcatcatcatcgctgccggtgaagtggtaagcccgccgccgccgccgaccaccgccttgaggcttccttgggccaggctctatgcgttctgggcttcacctatgcactgggccgtcgtgacttgggccgttctcagctttgacttgggccggcctcagctactttacggggcctggttgcttcttctggacttggttttccagtggaataagttcatctaaggtcccttaacttgtcaacgaatccgatttccgtccttcaaccgcaaaaccagatacaacgagtccctcaactatcaaaacctatgcagattagatccctcggcggtttttatggcggttttgactgacgtggcgcctatgtggctaatttgactcggtctcgatctgatgtggcactgacgtggcaatttgatccggaaaaataataaaaccagtgggacccacatgtcagtttcacacacaaaataataaaaaaattgtgggacccacgtgggccccatatgtcatcctctttctcccctctcatctctatcctctctctgtctcaccggtgggagaggaccacgtgaggtccaccgtgccgaggctcgggaaggccgatggcgtgcaggaggcggacctcgccgtcgacgccgccgcctgctccgtgcactgccacacctacgtcgccaaggacacatccaagttaagcagagcaccaccgttgccacgaacaccatttgatgacaacacttcttgaagaaatcgattggatcaagcaggtgctgcggatgtgcggcttccaatgaaacctcgtctacacgcgcgcgtgcatgta

SEQ ID NO: 13868 - DNA, 7495 bp, Oryza sativa
cttccatagaatattggaatggaagtataattaatcgagtcggatcaacggcggcacgcggctgcagcggcaaccggctaggggaaaaggaaggggcctcccgacagcgcctccttcttcgcaaggagggcgacgatggcggcctccatctcccccgtcgtcatctccataggcaggccgtgcagccccggcgtgccgcccggagatcctcggtgtcgaggtggctgcggcggagacggtctcccgctcctgctgccgcccgccacggcctcccacggcggagacgaccgttgagaggcaagaggggagctaggaggcgaagcggcggcgagggatgtggcggtggcaggagcggcggcggagtcggtggtggtgttgctggacagagaagagagaggaaaggggatagagatgaagagaaggagacgagagagaggaggaagaagggaggggtgagaatgacatgtgggttccaccatttttttatttttttctgtgaaactgacatgtgagtccccgtattttattatttttcggatcaaattgccacgtaagcaccacgtcagtgccacatcagatcgagactgagtcaaattagccacgtaggcgtcacgtgagccaaaactgccatcgaaaccgccgagggacctagtctgcacctgttttgatagttgagggacccgttgtatctagttttgcagttgaaggacgaaaatcggattcgttgacaagttaagtgaccttagatgaacttattccttttccagtagagagaactatagggccataaggtccaaggaccaccggcccggaccaaggcacgatcatttggccaggcccaagcacgacatggcccgactagtgtcgggcccgtgctgacacggcccgacagttgccttggcacgatgggctggcccgtcacagtacggtcgaagaaaaatagtagagggatacaaaatatacttaatcaaccatataaggcaaggcccaaagaaagaggaatacaaaatagattatttccagccatataagacacatcccaaagagttgagggggaaaaatagacttattctatggagaagcacaatggactgtcgtgccttcgggccaacccagcatgacccgagtcttattgggccatgtctgggccatgtgtgtagcccatgggctagcacggcatgccccgacgtgtaggtcgggccatgctggcctgactgaccttggcccagcccggccgtgccaggcagcccatttggccattatagagagaacagtatctgtagaaaatataaataattgagaatctgacaggaaaaaaaacattcagaaacctgttctttcagaatctgatagtaggaaaaatcatccaggaacatgttcattcagaaatctggtagggagaaaaaaccattcagaaaacatgtacattcagaatctgatagaaaccctgttcattctgattccagtaggcagccaagtagccaacgcagtgacgcacggacagccaccgtatggaaatggagtcaattcatgaagctagcaattgagtactgtagtaccatctggaaatggagtcaattcatttcatggagctatcaatcactgttgtacgagtataccatatgaaaatggagtcattcatttcatagtagtagtaattactgtactacagtagaaacaggtagctccatgttggttggaaaggaagtataaatggagatgcagccttgcaactgcagggagcagcaaaggcaaaggcaggagtgcaggaggacacagtggcatggggctcaatatcatcatcagagtcaggccaaacctgggtcaaggctcaagatggtccaacctgttgtttgtcagctgatacccatctctacctgcttgtcttccctcgcgtattctcgtgggtgggatcaccaaacaaaccaaactagtggtagcagctcattttgcagatccaacctcaccagatccacaaattacctggcccaattatgttcttcaggatcaggatcaggctcagggctactaaagtcagaagcagatgaaccaagccaacaacaaccagtgcagtaattgaagcagacactgcaccaaatggcgcggtttcttgccaaattccaactcccgcctctggttcaaaacttctggagcaaagcagtgcatattcaggtacagtacaaagcagaacaaagcaaatttgtgttcaacatattggtgctagcagaatagcagctagaaccttcttcaagccgaatgaaaaatgcaaccactggggctaaaaaaaatcttacagaactctcacaaacaaagccatttgatttaactaatgggagttacaggaaatctagattgactcacagcatgcacatctgcgtttgtaagagttccgtaagaaaaaaaaaattggtacgcagggccagttcaatttgccaggctccaaaaagaacttgaagcaatggagagcaaaagagtgatgtcctgtacaaaaaaaaagggcaatggccatattctgtctcttgtaattggttctactaagaaccgtgtttgcttcaggactcatacagatttataaacctggcaaaaatctaatggctactgctataaactgaagaaggttacctccatccttatgaacaggtcaaaaggatatttttcccttttatcgcacatccaaatgatcatgatcatagtcagatcatgaccgacaatgttgtacataatgacacaattctgacttgtatttttgttccaccggggttactggtccgttgattatactcttcccatgggtgaaaacggtgggtcaaggacgatggatggaggtgttttttcttttcgcctctttgttttcttcttcttgttctcttttgtggttaccgattcaattagctgcttgacttcatccttcaggagcatcttcagtgagctggagtacagcttatgcttgaatttctcaataccaatggcagaagaaacttcagaacagtgaagcaaacaaatgcagactgaaaatgcctgcaatgctgacaaccgtgcgtggaaatccaccgaaaaatgtccattcccaactgccttcatcgaaatggcagggagagcctctttgttaccctgtttcaatgtttggagagcactaatcagtaacgtttgttactaaagcatgtaaactgccgtgtctataagtaaagatgtagtatatttctccagtacttttaagggaggatttaacaacatgatcttcaactacatctataaaaaatattatggcactgctaattcatgaatattcagacatactaaggtcatgatctgaatgcaggaacttaccgccttaattgtgtttgcagtaaaagtataacaaggagaaaaattataaggcgtacctgaaaaggtagttccataggatgcttgctttcagtcatcactgaatcaacccaatgactatcatatgcattgtcaaggacaacaattgggcaagacatatcccatccaccacaatcgcaacctccaccagtcttcaggcggtcaagtagaggtgatgggctgctttcatcatccctcggtaaaccatgtgccccgcctgctgcagccactttaatggtaccggatgatgagccgtctttcaattctttggattgggttttgtggaacggcacttggattacaatagcagcaacctccaaatgaggatggagatcttctcgggaccaaagactagatgttgatgcatccgagttattccttgtattattttgccgctccatcagattattcctctctagagaacccctagatatcgaattatttacagcactgcagaattttggtttgctggaatctgtacattgaattctttcaacagcagaacttcgtctcgcatgagcaatatcgtacaagacaaactcactgatggctgagttattcagaacaccattttgtccaacttcagagtacaaataggaagacacatgcatttggcctacaattggaggcaaacatccccgtctatcctttggggtctttccaacagtacttgttcgcttccctgtgctatggaaagtgtaaatccaattcaattcgtttccggctttccaaatgttagcataaatggattcttctgggcccttggtacagaactcaaaaccaaaagaatcattagtgggatccagtttaagaaccgcatgaagatgagttggtgatgaagtaaccgtcaaaacttgagcttccttactttgctggcaattaggtgtgaggctttgttcagtccttgagataccgctcaacaaagatttccgcaatacacggccttttccttcaaccagcaggctactatgtttggcatcttccttttccataagagacggattcctaagagacttggacttcatgataggatccagaattttcttgaatggactagatcgagcttttgtggtgctgttagcaccatgagtactctctggtggacatgtagcatcaaaaacaccaacctttgttgacaaggacttgggcagtttatttactaggtcaccttcaccatgcttactcccatcagaataaacatcaaccgaatgttggcaattcgatcttgcatctttgctacaggttccttctatctgtctcgtgtggacacttttgctggtgtcttcatcaagagatatctccaggaaatcatctcctgcacaatctttcagcagattgcagtccttgcgtggcctcccaagtcttgaatgttcatcaggaagctcacgcaatgaaagactaaggaactccctggtagcctgttgaactttactacttgcatctatggaagaactcggtttgcacgaacggctctgttgccgcgataagtaaggtccacttgtgctaggctgagaggatgagtccacaatctcaaaggacataaatgaatctctactgagtgcagaatctattttcctccttccttcttggagtttcctcagtctgctaacatcactagaactctggtacatagagccgcgcttgtgcatgatgctatcatcttggtatgcctcacgtcggcttgaaggcaaacttttgcaatggaaatttggaatctgctcgaggtgcagttctggttttccatctgggcatttcaacatgtggtgtctgcccggttgcacttccctgctaggactgtctgcctcctcattgatagattgcattgcttccttagctactcgttgtcgagaacgatttcccatagataaaacctgcatgtcatcaaaccattatacattattagatgtttaggtccgtagcactattcaaagaatcattttttttttttgctgcaggaaaggattaccgccttcttttgttttgccaccaagcaaataatttctactagtacactgcaatgaaaaaggtggatcaatcttaagatccacccacccttctgtatcttataaaggtagaaatctacagtcatacacaagcatacaagcagtttgagcagggaatgatactaaaataactaaccaagagaaattggggtaacaaactggatgctgggatgcaaaacgagatagacaatagaagaaatgttgaaatgatgccctcatcagtaaaggaaaaggtgggcgcagtggcgtcatccctaatcttagaaccataaaaggcaactactataaactccatattagtagcctagtaggcaagacaagtttaagaggaagaacacaatatgcctaactaaaaaaaagatctacttaatctactgaatatccaccctatattatcaggaaggattaaaaaaactgttcttttttttttccttttttaagcgcaaactgtttcttttctcatataaatacagtgcaatgcatttcttgcatccaaggaaacctcgaatctgttaaacaaaatctgagagaaagatgaacatgtccacatgaatgccagtcaaatccctccaccaaacagccaaaactcttcctgtccaaaaactccacagcactctcgcatctgcagcaaatccagccaatacaagtcccactgggagctcttgaggaaacacataaacagcttcctccaaagaagagttgtccctctccagactccacccgcaaaaccaatccaatctcaatcaccccaacccaaatccccaaccaaccacctcaagaacacagccagccaagaacaacatctcccatgaactgaaaaaccttctgaagaatgaatcaagaaacgcccattacctttgcaaggcgaaaaccagatcaacgctgaagaagagctaagattcctcgagctcctctctcactcactctccctcttgagcgagtggagtgaggatgcaagaggcattgggggcagtcgccagcacactcttcttggtttcgcctctcctcttcctgagctgagcttgctgctggcggctggcgaaatattctgaaatctctttgcgcgtttactagctatactagccagatacggagatgaaatatcgtcctgacacgaaggactaaagtgcaagattgtgtaggaagtgaagtgagtggcctcggatatcacgagctcgagggggtgtcctcctccagctgttgattaggccacctaatgattaattagtgctcaattagtagcaaagggtattttaattggctctctgggagaacgtgtcattgctggggagtagtcactgctcacagtggagttctttcttgtttctgaactgcgttacgttgcagtttagcagtactgctgtaaaatacgcgtgaatattagagaataacctaatatcaaatataattagaaaatgtgaggcttctaatttagatcgtctagtctatcatcttatagagatagccgaaaattcctgggcgtttctctaccagtaccactatgatctgcattgccttcaaaatggtcttgtaaagcttcctttttttgtcgttaattcattaatctttgctggaacaatattcatattaatatatagagtaaataaaaaagcactgaccttggagtgatggaccagtgcggcgttgagaaaattttcagctcaagacacgagaagaaataatcgccatcctggtggttgcttgcaacctggacgatctgaaattctgaatgctgttcgtctacctcgagccggaagaaatcataacgccgctccacccactatagattgcgtgcacttgactggatcatatcagaagctctcctgcttctttctgcttacggccatggccccccacatcaccgtagtagcatatagcacggctgcacgacgagcaaggccatggatgtcgcgcaggagtgcggacgacgtcactgacacgtggcgagatctttgaggcagggagggtgtggggaccactttctgatcaccgtgggctccactcgccagtcgccactggtttctcttcttctgccccctatcatcatccacctccagaatctcctatccacctttgcctctctctccctttcagcttttgatgatgcgatcacctggtaacatatgaac

SEQ ID NO: 13869 - DNA, 2785 bp, Oryza sativa
actccaaactcaacttcgtttaagagatttggtgagaatatatttcatatctacacttatctttagtatttttatcatgaatttacgaaacttagctcgtttcgaacacttagctcgttttcaccggatatatcatcgttatataaatgttcagttgcaagaactactagctatagcagcataccttgattactgcccctgtgatcgatcttgagcttacattaggctgaacaacctaatgtatgtagctggacaaatatttctgatgcgttggtcgcattatacttagcttaggttaattagccatagcggctacacatctaaagatgcagtcacgttgtgttgccttccaaaagcatcaacagcaagcatgcaatgcatgatgcgtggcgcgtcccccacaaaaaaacacaatccgacgactaaacaaacaaaagcatcgtcatcaacatggggtgagaacctgtcgtcaaagattcttggcctgatccacaaaccaccagcttaattagttagcttgtctcctagcaattactactgctaattagtcagtcacacacttgctgctggtcctgagaggctgagatgccctgtgccttttacccacatcttttactaaagtcatcctagtgctaattgactatatatacttgctaagtattctcttttttaatccaacaattgaagaaaaaaacattggaattggtctatttgcaaggtgcaaaatagcagaaaaaagagagagaagaaattactcagggtgctgatgagtcatgacagagatgcatgtgctaacctgcagaaacctcaaccctgtagcctgtaactctctgcaataaccaaacaagcgcttggttcccttgctgacgagcaaaaaactggcctgaatgcgactatgaacagtgtggtatcctatgtggctaatgcagccgtgcttgcatttcagagtaatcaagtaattggtcagaactactagttacagaagcagaagcgatatatagtatttatcatgcaaaatcgaacctgctaatattcagagtttcagaggagggatgatcctgtttcagtagctacctgtgaactaacccgtgccgaatttgtacccccgaaaaatcacatcctgtcacagtgtcatatgttcgtagccggtcgcagcgatcaaggtgacaccaatccgaaagcctgaagctcttaactgtgtgagtgccgtagtagcagacagagggaaagacaaggtgactgtagaatgattaattggctcgctccatcatccactgttcatgcacacggccatgaaatcagacaaggcaaacattagagtacactagcgtatttaataatgtactgtgtagattggaaaaggctggagaagctagttttaccagagcatttcagaagttaccttgatcacgagaccgatttactgacgagcaaaacaatgtgccaacaattcgatgttttctacagggtttggcatggcctttgttgtgcttcttgatttgatctacagttctgtgcacttgatccatggatgcatagatgccaagtacaagaactggacacgggagggtactagcacttgattaagatcatagttaattagtaactaagaatatcgatgcatggacgattgctgctggatcccgtactgttgtctgcccaaggaacccctaaaattaatcgagtcaatggccctcttaacttcaggtcttcaaccctcgttagaactaattaagcatcgtggagaaattagggttggatgcatacctccatccatgaatctaggagtcacgcgctcgcaccggcgacggtggtcacggccaccggcgatcgccggcttcgccgcctcgccggatctcgtagccttgcctcattctgttcggccatcggcctgcatgctaagtgggctggcccataacatgggccaaccttttggtcctatgtgggccgtatccgttggcgaattgggtctacattttggtggacctttcatgggcctcctcgacagcccgaggaccagactgggacggcccaggatttagtgggcctgtttagcgatccaaacaagtatggactttaaagtcagataatcagaattgggaaaagtacatcagaggtccctcaacttgtcatcgagttacagaatcgtcccccaaccacaaaacagatatatgacaccccttaatttacaaaaccgttcaatttaggtcctcaggtggttttgaccctggtttatccgacgtggcggctgagtcagcgtgggaccacgtgtgccccacttgtcaggtgtacacgtcagcacctaatctttttcctctcctctctctgttctctctccttccttcctccctctcgctctttgctctcgctagggataagcacggcggcgcgcgcggcctgagggtggtgcggccggcgacgagcggcggggtggcgtggcgatgcggcggcggcgggccgggcgcaggcgggcgacgcgactgcgggcgcggaggtggaagcagatggatgcgacgccggcgagctcagggcagagagagagagagaggggggcgagtggaggggaacagcggtgccgcctgatgttccgctcgagctgcgccttctcgatctgatcccgctccatctcttcttcctcgctggcgtcgtcctcctcctcctcgtccgggctacaccgccgtcgtgctttccgtccggcatcgtgcatcacggtcacctcatcgtcttcgctctgcttcttggccatcgctgccgccgccgccgcggggcaccctccctatgcggc

SEQ ID NO: 13870 - DNA, 7387 bp, Oryza sativa
ggatcccccgttttttacagatggccgacgtcgaccgccgcttgccggtgcggcctgacttcccgcgcccctgccgccgtagccccttcctctcccgcagcgcgcttgcccaccgtcggccggccgctccggccctcgccgtcacccgcttcgcccaccggccaccgcttgcccggtcctccggtaggccggtgcggctgccacatcgccggtcgccggccaccggccactgaacctcttcctctcctgcctcgcctcgttggcttcctccccaacccgccggtcggcctgtccacctagacgaggagaaaactgagagagaagaggcgacgggcagagtggcggcctcgctggcgcgtgcctccactctcgcccacgccttcttcttcggcttccacttttgggtcggtgccggcctctcatcccgcgtggcggccatcggtgcctctccgccactgtcgcctccgccctctccgccacacggctcgctcgcccgccaccacctctctgccacgacgctggcccgctaccttccccttctctcgtgtctcagccaccgccgcatcgttggccggccgtcaaacctctcgccctggcgaccccctccccaccgccggccagcatgccgacgacgtggcatcctaacatgttgagaggaaaggtagggagaggctggcttgccaacgtggcatcctgacatgtgggtcccacgctgactcagccgccacgtcagataaaaccggggtcaaaatcgccgagggacctagtttgcactggttttgtaagttgggggatgcgttgtattcggttttgtgattggggggcgattttttaacctgatgagggaccttcggtgtactttttcctaagttgggcgggggaagaaatccaaacggtccaattaaaagagcgaagtaaaattccaaattaattcgaagaatcggcgtcaccaaatcaatctcgcccttggttaatcttgtacgattgttgtgaaaatcttaacatcaaattaagagattgatttaatcaaacattacaccaaattaaccgatacacgtttcagcatgtacgtaggagttaggataggagaaaatcaccagcaattaagccattaattaacaatgaccggaaaagggagcgcgtgatctacctaccaataattccaattcctaagccaagaaactaactaactaacgtacgtgctcactgccattgtcgtcatcgataatcgtcggttgcaatatcctcttttccgttgccatttcgctttccaagcctccaacttttatgctgttcatgagcatgacagcgtgcatacatggcattacagaatctacagatgcacaggctagctgctctgctgagataggcgcaggcgcagcgcaatccaaagcagctgacgccttttgcatcctgccttctttgtaggcttcgtcctcctacctctgccatggctcagcgacactggccatggcggctcgccgtgttcgtcgccgccgtcgtgacgccggtggctgccgaggagaggctggtggtgggcatgactctcctccaagctgccacatcgacaggagcaggcgaggaattcttcttgttcttcttcttcttgttgttcttcttcttcttcttctctgtgtgcgatttcttagtgttcgatcgattgcattgcaccgccgcgaatcgctggcgaggtcaacgagaaaggaaatggagattcatttaccaatttaccatgcaattggaaaattccttaattagttgaccttgctaggcacacacgtacacatcgtttgcattcttgatcgtgcgcgttgtttcaatcgatctttgcagtgtgcctcgacgggagcccgccggcgtaccacctccaccggggctctggcggcggcgccggcggctgggtgctccagttcgagggcggcgggtggtgcaacgacgcgccgtcgtgcgcggaaagggccggcacgcggcgaggctccacgcgctccatggacagcctcgaggtgttctccggcctcctcagcaacgatccggacatgaatccaggtgcgaagtgtacggccaatataaatttccaagttaagtcactgtgtttctttctcaaacaacaacaagtagcattgcgcaaaagaagaaaaaaaccattgatttatactcccttcagattagtaatcttaaaaacaaattttatcacacattttatatgataatatctatgctatttaaaatgatattagtggttgtgtccgagtctgcctccaatatcatctgatatgtggggtcataagtataaaatcatcaactcgtgaatggtattggaattgctaattgtaggaattttaaagggttacatacacaaccttcaaatttacctttcaccctctttatctaaaaaaatttacctttcacccatagatgagttataagcgttcaattttgtatatccgaccaaatggcttgtgaaaatagacgaagaggataaaaaaaaaagaagatcatctagcaacatattttagttttgactttggatatgacattatatgtctaatcgagtgactatgctataaccttataatttttttctttgcttttatcacttataatatccactataacacacgggtctttagctagtatacagaaatatcaagaaatatatgattttatcgaagtatttcttttttaaaactggtctatacatattatgatctccatatttcaaaataatattttagaaattatttctagttaaatattttaaagattaatagcggtctttttttaaaagattaatagcggtaacaataaatattatgaatgcggaggtagtagctcgtaatgagatgcctttttcttcaaataacttcgtacatttaccagttcatacggcaagttgttagcaacaacagacgtttccgttcttggtggtacgtgagtttgcttttgcaaaaggtgacagcgagcaagtacagtcacaatcgggtaggtaccatgaagggatgaacagctcatggtcaagaatagttagtgccgggatggaatgatagattcactatgcaaaatgtggaatcgtgcagtagtacatttactagtctagactctagagtcggcacatcgacatcaggctagtgtaaattcaggttcatcaacctacaacacaacttattaggtttctcgagttttagcctttcaggttgttgttttagaggattcataatgtatatttgcttgtttggtgatgattcaatcgttcgactagtaatttcagactatctaagtgactaattaagttggcgttcctaatctgctatatcacttttttattctaactttgattactttgatgcagacatgcagattttatacagtacttttgttttctactttctccatttcatatcataagactttctaacattgcccacattcatatagatattaatgaatctaggcacacatatatatccacatattcatgaatgtgagtaatgctagaaagtcttataacctaaaatgaagatgatatttgttcttcttttaccgttcaattattctatttatcatttaaacaaaaatgtagggattttaacatagtgtttgtcgtcaatttggcagatttttacaactggaatcgtgtcaagctgaggtactgcgatggtggctccttcgccggtgattcagaactcagaaatggcgtacgcttccctgtttccctgactgaaacaaaacatgtcttcaattgaattgcttgtgtttttttttcttctgcattgttcagtactcaactcactgttttgtgttttaccactttgcagtcttcagtcctctacttcagaggtcagaggatatgggacgctatcatcagtgatctccttccaaaaggccttgcaaaagcccaaaaggttcattggttctcctgaaaacagtttgttccatttcagtattttctgcacaaactcattttacaattttcatcgcgattaacttaagctggaatccaattctttgatgccaatgtaagcttttcaacactaacaataacttactagctactccgagaatcctaaacggcatcataattcataactcactcattcttcaggcttcagagcttgccctgttgcctttgttcttaacaagttctgaatttttcaggtattgctctcaggctgttcagcaggaggcctagctacattcttccactgcgacgacctcaaaggacgtctcggagatgctgtcactgtgaaatgcttgagtgacgcaggatttttccttgatgtgtaacagtggagtctaatcaagcaaaaaaaaattactttggttgactgattcttgaactcattgggttgaaacacaaaaatttactttggttggtgtcctgcagggatgacattactggcaacaacactgttgagcctttctttaggagcctagtagctttgcaggtaaccgactagttaagcgtgtttctgcacattggatttcacattatttggtagtgttttaatttttaaagccatgagtttttcacgcagggagctgagaagaatttgaacaaagactgtttaagttcaacagactatccataccaggtagtatcaattaagatttttttttatcttccctttcaaagtactgaatttcattgttcaaaagttacaactttttataatcttcttgtctcacttctctgcgcagtgcttctttccgcaatatatacttccatacatcagaaccccttacttcattttgaattcagcttacgacgtatatcaggtaaaaaaatgacatggcgcaacttgatgttttttagcatatggttatacaactcgcaagcaaaaacgcatgatttttaccttttttgaacagttccatcacaattttgtgcatccttcatgtgatcctaaaggccaatggagccactgtaagtcggatcctggtgcatgcagtacatcccaaattgcgactctccaaggttacctttttttttctctttcttggtagagctaaatactaatctgtgcaattttcatataaacaataggtgcaagtctattgctcttacgaaattcacactaaagattattcagatttagattccattgaacaggcatatgtgagatttctggattcaagttgttgtcttcgtgacattcttcagagttctgaatctgtctgcaggactcaggaatgcaatgttgacggctctgaagccgttccaaaatgaacagggtgtagggatgttcataaattcttgttttgcacattgccagagtgagctgcaggaaacatggttagcaccaaattcgcccaggttgcataacaaggtactggcaatctacatgaaaatgttgtgtatatgcggtgtatttgcaggcagacatagatgatatctggtttgtttcagacaattgcagagctggttggtgaatggtactttgagagagggcctggcatagaaatcgattgcgcatatccttgcgactcaacttgtcacaatattataccttctaatcaggtttgttccattctagaggagtttttttttttaacacaaaaatacagcattgtatcatgtaccatatccaaataactgtttgcttgcaattcaaacaaaatgaatgaaactgacaaaaaatgcttggtgactaggaattggggatttaggagtttggcaggggagcatccatgcccaactgtgatcaaaataacaaagatttcatttagtttggtgaataaactgaaggatgaacactgttacaatgtaagtacacttctctgcagaacaaaaagacatcttaattggataggatcatcggacagaaggttagcattaatacaattcatatctactgatccattaaagtaaatgcaagaaaaaatccaaaacaaaaataaagtaaaatgtatggactacttgatcttagcctgatagaaattgggtgttcagttgagattgctgtacgttgctgtggatgttgctgcagctgcaaccacaataactactagtttatatcaagctatactaggctactgcagccctgtgactgtgcagcactgcagccacagccacagccacagggaaccgaacatcccaaatgaatatgcagacacagttaatcctgattcctgaatgaaccaaatttcagtccaaacaattcgacatcttgcactctgcatttctgcaactaaagactgcacccatgttttatgagttccaacatcacttgattcatgttactaaatatgcatctgtttatgcagaatggagactcaggcatccacaatggaggtccctgcatgaacattcctcccaaattctacagcatcagcctacagatgattctttacctgtctatattgcacattgcagaacaattcataatttcatacgacatttgattgaacagtaaaacagagccaatgctcttgtaaccactgatgttctgacacttctgttttcctctcactgatacatgaagaaactattaagtctataacctcagcagagttaacaaaaaaagcgagagaatatgcattgcagaagcagattaacatgctacaacagtatcaaaagctctacacaattgattagcacttgagatcacaattgcagaagcaggactcatatatgacactgaactgtaaactctgtaagaggctaaagagctaaaccatgcacatctgagtcatgatgctatcactatctttaccctgatttgcttgagctgcttgacaatacatgaagagaaaaaatcgaagcttttcaccttgcgtcctcatccggatcaactgctgggaagaaccagaacgagtcgccgtcggcggggaactcgccatggcggtgcggcaccgtcttcttcagcaccagcagatcacccggcgccgcgcccaccctcgactccgaccagaaccacgcctggccacgggcggcgacgtccacgtcgggcagcgtcgacggctggtgcgcgaacaggacggtccccggggcgcggccggccgcggaggaaggcgggacggccgccgagcacccgcggccgagcagcagcacgcgctcgccggggcaggcggcgatcggcagccacgccctcgcgtcccagttgagcttgtagagcgcgacgcggttgtggcgctcgtccgagagcacgaggaggacgtggccgagcgactccacgaggtagtgccgcctcagctcgagcgacgggagcgcgaaccccgtgtccctgcgctgcaccttggggttctcgtccgcgagatcggcgcgccacagccgcctccgctcgtcgacgaggtacaccgtggcgccgacggcgacgacgtcgctgagggccgcgtggtggcggaaccccggcgcgcgcagcgtctcccacccctggaagtcggcgcc

SEQ ID NO: 13871 - DNA, 2261 bp, Oryza sativa
gcatgtcctcgagggcacccggtacccgtacgaccgcccgccgggcacgtcgtagaacacgcggcgcgccaccgcccccgcccccggcggcgactcccgctcggggagcatcagccaggggaagggcggcggggcgtggccgacgcggcggcagtagaggcgccacgcgcggtcgacgaggcggagcctgaggtagtcggcgaaggcgaggaagggggcgaccgcggcgaggatggccccgcggcgcctagggtttcgtgggttgcgcgccgccgccatcgccgcctccgccgcgcgccgccgcggcgcgagcgaccgacgcatgcagcccacgcgacgcgacccgacccgacccgaccgaacgggttcgactcagccgcgtgctctctctctctctctctctctccgcgtctcctcgtgcgcagcgcacgcacacggccacacgcctagcctttgtatgatcccgcgacgccacgcccctctcctatatacccccctccgtcccgtattattgtcattttagattgtttagcacgtattaaagttaaaaaaaatataatagtaccctttattatttaataaaatatattgttgtatatggaatgatggttgagggtagaaaagagacaaatttaaattagaagtgattgatgggataagtagtactctattgtgaaaactattttaaatcccaaaaagacaactaatttggaacggatggagtatatttatatgaataaaaatgtgaaatggggaatttccagaaaagcaaacttgaaatctaaaattggatacaaatgaaatggtttttatttcagtatagtgaataatattgagggagtctataaataaataaataattaaagagctttcaagagaagtggattaattatttaatgttagtctatatggttattcaacaggtggtgatcaattagtcattcccacattcttcatgtttttcttcaatcacaggaacatgttgagcttgaataccaatgcataaaaaacacgggtaaatttatcatgaaaaaaatcattgtacaatattattttttttaaagaaaaatcgtgctacgagagaaagccatagtccaggatgtaccatatctctaagaccgcgtcactactcactacccaaaacaacatattttctttatataaaagaaatatgtcttatgtgcttgcgtaagctctattgtttgctctttggcttagcagcggcaaccaaaaaatattttttaaaagttgattttgatgtttttatcgtatttatttgtcagcattggtttttaagcaagtaaaaatacatataggaaattttatgtatattttttcgctaataaccgttatgattagatgtaggcaaaacgatgggactgccaatcgcttgatcaagtatcttgtaacgaggtggaggtcgaacaaataatttatattttcttttgaagattttgatgctgttttaatgtagtataattttgcatgatctccaaataaatgcagggtcttgtctatattggtatagcaaatctgctgctttgatttgcagcaataactcgagttggccttttcacatccattccaaaaccaaattcaatgtatgcagtatggcacagctaagcatcctgcagccatccagccaaagggcgtttcagttctcgtttgcatgcaaacaaaaggtcaatacttgtagtgcactggcatgcatacacggtgctagtccaaaaacaaaattcaaatctcccccaattcggggagaaatcaatttgattagcccaattcggcctggattcggagcgttcagagcctggttctcggactgacgtggcggctcatgaaggcccacccaaattggatcactgctaatcgaaatccatattgggccggaggagaattttggaggaacagcccacgttaattgggtcttagcaaaaaggcccaggacaggtggcatcgttgtcgggcccattttagcccatccaaatcgagacacatagattggcccagacatgtaggcccacataagattgatcggcggactggtacggcccatataaaattgcattgtggcccattttggaaatccacgtggcccaataaggtttggcccaccagtggacagcccgccgttactggtgctcgtcgccacaaaactctgcacttctctgacaaatcaagtggtaatcaagtcagcgagatgattctatcagttctcaaaataattttacaagcatttttaggcgcagctacacctacgt

SEQ ID NO: 13872 - DNA, 9056 bp, Oryza sativa
  unsure (1)..(9056): unsure at all n locations
tagtaacatgcattaagcaaaaaaaaacaaagaacaaaatatcaaaattaaaagggcgattaatctatacctaaggtaggcatcgtgacgggcacgtagtgcccacgactccagaatcctgattagtaccctccagatacaattctttaagtatgataagaggatgtgattagttggttaaactaattaaggagattaattagcaaacgtttggacgcctgagctaagcatctgctgctaatattgtattcaggcatgctccccttgatgatggctgtggctgccgtttcatggagctcatgtctctcatgctctgggcaatggctgtctctagccattggagtcattctgacgacgtttttaccccggatttagcatgtcttttctgagttttggctgcacttcttccacatttcaagtttctagatactaatttcatgttgaatctgcttttttttttaaaaaaaaagggggaacaccagtgacattatttctaacgaaaaagggggatacagtataattacatggaatagtgtaattcagattgtagcaactagcaacaagcttgctgcttaaactgaaaactatcacttcaaataggtgcagttaatagcaaactgtaaatgatgctctcagattacgtgtaggtaagaaaatggaagtgtcattaggcttggaaatttatttatttttttaaaaaaaggcttggaaatgactaatgagcatgcagttagtacaatattgtcaagctatcagcatagctaaacatgcttgcacgctggggcctaattaaactaaaattaattaaaagcagaggcacaccggccatgcaaccacgctgctgcgatcccaacaacaattttcgagagcttctatgctgctcgtgcgcagctgcaactttctcccctcaaaagaggcaaccggcctgaacattctgaacgtgcgagagagaagaattccattgcagtgccaatttgtcatttgtttaatctcctaatccaaaagaaaccatcctctgtttagccgtccgtaatctctgcaccgtccattcaaatctcctaatgctaaaaaaaagagttattttgcacgtcacacttctatcctactctgaatctctgaagaatttcaactctgaatttgtaaagttcagagctgcgtgaggttgcacgaaacagtgtattaatggccgtttgtgccgtgcaagatggaaaggtcgatcagagttcttggccattctgcacgcaaagttaaactgtagttagttgctcgtacctaattactgaatgcatcgatgattagtcatgagtgtactgtgacacgctgcactggcaaacaacctggcctgatgagttcatcgtctaatctcaatcatcatctctgctgggactgttagttctgaacctgaacctcgcacgaatgcctgaataatttgagttgcgttgcgtcagcgtcatacattacactaatcctgtcaaatctatcacaattcacaactcatcaggccatgatttgttgctcatcaattaatattgtaaccaacttatcatccaatcattagaatctctgtggtctgattagttcatttcaactggtttggttgaacgtgatgtgaagatgctgtcaaatccctttgtttttaactgaacttccatgtgtactttgtatagtttcagagcaggaatatcagtaaggatcaaatccattaatatcatggttgactctcccctaacatcaagcaattactactactttccaaggtcattaagcaaacataatcttgccatgatttttatacccatgcacttcctttccacgcctaataaaaaataaacaaaaatcagcaatgtctcccaatggcatgatcacttgccatggaccagaaaacacaaaaccatatgcaaaacagcacatcctttgcttaccattgactcctttttccatccaagcctaagcaagagaggaagctgatgcaggaattcttcagaggaaacatgagcttccaattcatggcaagaagatcattggcttgagtgtcttaggaatcaaatcaacatcacaaaaaaaaggtaagaatggccaatcaatccttttcttgtgccatctttggggggtgttctatcctttccatctcctttgcagcagtcaagaatattgcaaaagcagtgcttgttttctttcaatgtttttttctgaatcttggagatgacgacgacgatggcaatgcatgcatgcgtccaattgcacaaaccctgtatgtaaagaaggttcaaaagcaaaagcttctgaaatctttagagcatactggtcctctcaattccatttgcatctgcatctttatctgcatgagatgatttagtttatgacttggtgtcgagtagtactactagtaacctcactatcatctagaaagcagcgagctttgttgctaaacaaacaggggcattttgcaagattttctcaccgctgtcctacataggcacacaaacattggcaaaatgtgtttaaattaagctacagtttcaaatttaaacctaggactaggaggtttgaaatttttttagtgagatgggtttctcttgtttcgatgaacttgtcgtgtccattgcaaagaagaactcgttatatataaagctctctctcttcttgtttcttgcagcgttgagagctcgtcggcatcaatcgatcggcaatggagagtagctcgtcggtgtcggtgtccgacgagagctcggaggcgaacggcggcgggtgctgctcgtcgtcgacgacgccgagcatggacgcggtgaacctgagccggactttctccgacgtgtcgtccttctcggaggagcatggcggcagcggcagcagcgtcgaccacagtggcccgttcgagccgccgtccgccgccgccgtgtcgaggctgatcggccgccgctcgccggctgcggcggcctccgctctcagcctcagccgcctcagcatgaagccccgggccgacgtgctcgaccggcgctccaccgacgacgagctggagctcgtcaaggagaggttctccaagctcctgctcggcgaggacatgtccggcggcggcaagggcgtctgcaccgccgtcgccatctccaacgccatcaccaacctctacggtacgcagcgcgatcgacatgatcgccggcgaacttgttcttgctaatccgtgaccaccatgactaatccgacgagctaatgcagccacggtgttcgggagttgccacaagctggagccattgccggcggggaagaagacgatgtggaggagggagatggactgcctcctctccgtatgcgactacatcgtcgagttctacccctcctcacagactctccccgatggcaccaaagtcgaggtatccatccatgatccatccatggacgattcaatggatttctacttaccaaacgccatggctgattgattgcttgctccatctccattgctgttcatcctgcaggtcatggccaccaggccaagatccgacatctacatcaacctccctgctctggagaagctcgatgccatgctcattgtaagatcccaacaaatttgtcgcaaattaaaaacatgctgaatttgacgaattttggatgagctgaatttcgaatttgtgcaggagatactggagagttttcagaaggcggagttctggtacgcggacgccgggacgaggtcgttcgggtcggcgacgtcgtcgtcgacgatgtcgtcgtcgtcgttccggcggtcgacgcaccggaacgaggacaggtggtggctgccggtgccgtgcgtccccgacggcggcatctccggcaaggcccgcaaggagctccagcagaagcgcgactgcgccacccagatccacaaggccgccgtcgccatcaacaccggcgtcctcggcgacatggaggtccccgactccttcatggccatcctccccaaggtaattaaacaacatcaccaactccaatgcaacagtaacatcaccatttttttccgataatagaagctttatatgatacttcctctgtttcacaatgtaagtcattctaacatttcttacatttatattgatgttgatgaatctagacatatatatttatataaattcattaatatcaatatgaatgtggaaaatgctagaatgacttgtattgtgaaatggaggaagtacattctaacggagcttactcccggcctccgtatgaaatgcacacggccacaaaacaggatctaactagaccctcaacacaaaacaaaaaaattagtgactatcaagccgtagactagatcgccacccatattccagagtaaaaaaactcctatgccacctgatccaaacaacgcgataccaccaacaatagtatttgtcgtcatcatcttcttcttcgtcttgttcatcatcgtgttcttggcagagtgggaaggcgagcgtgggggacggggtgtacagggcgatgctgggggcggagaagttctcgccggagtacctgctggactgcctggacatgtcgtcggagcacgaggcgctggcgatggcggacagggtggaggcggcgatgtacgtgtggcggcgcaaggcgggcgccagccacgggaggtcgcggtggggcgccgtcaaggagctcgtcgccgacgacgaggagcaggacaagaacgtgatgctggcaggccgggcggagagcctcctcctctgcctcaagcacaggttccccggcttgtcccagaccaccctcgacaccagcaagatccagttcaacaaggtaatcaaactaactaatctacaattcatacaaatgcaacagcattagcatccaacattagcattcaactaatcaaagtacgcgaatgcaagaacagcattggctttcaactagtaagagcatgcaaatgtaagaacaaaattggtactcttgattcagctgatcaaagcatataaatggcaagaacagcattggtattcaagtagtaattcagagcatgaaaactcaaggataccattggtattcatgatccagctgatcaaagcatataaaatgcaagaacagcattggcattcaactaattcagagcatgcagatgccagcattggcattctgtgatctatatcttcttttcaaattcaaaatttgatacgttcctgaccaaatgagattggcaaaatttttcatgtaggatattggtcaggcaatcctggagagctactcaagggtgctggaaagcttggctttcaacatcgtatcatggatcgatgatgtcctttttgctgacaagacggtcaggaaacagtgagcgacagccagagcgtctggactctggattgaagcttcccaacaagagctttagatgtttctgttagtgtagctgccaagagaaaaaaaattaaagtaacagtaggtagggtgattttgctgaccttagtgagggaactgtaagctttagcttgcaacaattatgtcttgtatgaccagcagtggttgtatgtatgaagtaatctgctctgtattcctttttgtttcctaacctggcctttctgtcctcttccttattaccaaatcatggtagtactgcacaggtttaagagagtaaaaaaatctgtggttgctaagaacccaggactgactcactgaacatgtatgaaaatacctggacacataaaaaagtttcagtttaaatctagagagcatccaatttaactgaatacgagctaatccgcacttcaaatctagacgcaaactaccattgcatttgcagatttgctgcctccatgatcctactcaattacatttcatatacttgcgtccatcgatggattgtgtctttgtattcaaaatggaaaatccaccgagatgataagttaattgcatagcacgagacaggtaaaaacaggataagatctggttaaacaaatatagctcctcccaagagcgaattgctgacatacaacgatgattctctcaaacttttgctcggctgtatggcatacaactcgaagttcaacccaaatataaacgtggtttataaacattacaacggtgaaaaagtgtgataactaacacaaatactaacttagttcaacttgaaaataataaacataatagataatgcatactactcataataatcactcgaagcaacatggccactctcatacagtgttccatcttctggatgcttaagctcatctccacagaaatagcagtgttgtttgtcaatgggaagacctggaacacctcttggataatgaactctggcgccatagtaaccacctgtaaaagcaacttgtatatgttagtaacattttaaatagaatatcaaagttttgagttctatttttggactaaccaattttttctttcccttcaagagagaccatgcaagtgggtatatatccattgttttcccagcgtacttccgcgaaaaataactcctccgagttcttgcaatcgccctttgcaataaaatttacatgaccatgaaaaccttcgtccagatttccacagctagtgatcgtcctgactaactcatatttgatctatgtttcaacaaaaaaaaacagataccagtaattaggccacaaagatatagtgtgcataatattgcattaagaaaatgaaaatataccaagggccaatttcaaacaaattattcaccagactattgccacgaattatctacttgattataaggataaaatcaaatattttaagaaataaacttaacaaacgcacacaagcttccggtgtacacacaccaactaataaatgttataaaaaattccagaaaaaaatgtatacaagtacttccaatagtagtacacatgtatgaagtctaagcatcaaattatttttagccgtaacaaaaaaaaaagaacatatgacagcttgtaagagtataaatctgccagatttttttcttcttttctctctccatatgatgaatttaaagatgagactttacgcataggtgtaatactattaaataaatgtacatgtacaaaatttgctagaattttttgtggaattttttagttggtgtacacgatccatgcagacaaagttgttttctcaccggcggtacaaggaaaaggactgcgagcgcgaaaagacggaaaaataaaaaactgaaacttgttgctcctatagaggagagaggtggtggaggaacctcccaatctcccaacaggtcctcaaatatgctaagctattctcgataggggggctagctaatttgaggatatgataagtacctcgagctcggacttgaagatagatttacagaatgagctgttggcaactccacctcgacctccataagctgtggtttgtcatcatcaggaagtggaggacttttaacgaataaaagaagagaaaatcaatatatatataatataaaagggaaaaaaaaggaatcagcatcacttttaatgaacgaacaaaaggagaataataagatcaaaatcaatgaatagagcaaagggtaaagaggcacaacttgagatccaatccgtgttgggtctccgaggggatcagcatgttgatgtgagcggaggagggaagtagaggcggtggtacggacgcgctgcggcagatttgattgattataagaccaaatccctccaaattaacaacgaacttgtggtgcttataagggtggagagggatggatgagctagtacaacttacgcaagaggttcgtatccacctcttctgaaaaaaaaaaaaacaagaaggccttctttggttatttttcttcggagtaagttcactttttgactctgaatcggattcgtataatttgacttgttttggagagcggtttggccttcccgacctggggacttggggagagtgcttcctcgatgccttccggacctcagcgaggagggctgcggtggcggaggcggatctcggggcagtggaaaaggggggagctcagcggcgacgtgcgacgggcggccggtggcttgggcggcgtcccctccatcgccggcggcggacgacctcctcggcccgccaccgccgccgctccgtccctcgctcgccgcccaacgccgccgccgctccagccctcttcagcccgccgccgccgatggccgattggctgaagaagaacagaaaggagagacagagggaggaagaaggaaagaaagagggtgatatgtcagtgggtcccacattttggtgtgaatgacagtgtgtcccacacgtatttttttaattttaatacactacgttaacttcacgttaaacaaatcaacacgtcacatagacatcacgttagcgaaactatccttttaaatcaccgaaagaatcaaattacaccggctttaatagttgtggttctaataaattcggtactagtgtttagggacacgaatcagatcggtcaataatttagggagtcagagtggacttattcctttttcttctaacaattccattccaaaaaaagcagtacgtacacaattgggcttctttcttgggcctccaggcgcttccgcagccccagcctatagcacttggatttgtggattcatagtttcgggagtggaaataagtctattttgcttccatcgaccgtaaaaccggatataacccgtctcttttaactcccaaaaccgtctcttcttggcttcccaagaagagctttagatggttctgttagtgtagcttccaagagataaaattaagggataaagtaacagtaggtagagtacagtaggtagagtgattttgctgacctagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13873 - DNA, 557 bp, Oryza sativa
ctgaatcttctgagaggatttgctcatggagggtatgcagatctgcagagagtcacccagtggaatcttgacttcttgagggacagcacgcaaggggacaggtagttgttagcttagctcaagtgctagacattttgcaattagttttattcaaaactctttacgcatattagtggttgtttcatatgaatgcaaatgtttattttccaaacaacagacataggaattgcattatttagtacagatggcatgtacgcatcagacccttaatataatcatggtgacgtggcaaatagtagctagggatttctagtaagtatcattgataataatcctttatacaatggaaaccaagatcatgtcctcttttgtttttttctgtgagcaggtatatggagctgtccgagagggttcacgatgccatcggatttatggttgctgctggtctgactcctcagcatcccatcatgacgacggctgaattctggacatctcatgagtgccttcatttgccatatgagcaagcattgactagggtggactccatttctgggctt

SEQ ID NO: 13874 - DNA, 914 bp, Oryza sativa
cggctggtggtggaaaggcggcagcggcgctcgccggcggctgccgcgtgtcgtctccgcaacactggcttccgtggacagtggcctacgcccctaccccctccttcccgctaaggaacctccgcgagctcgccttcatcaaccccaaggtatcgaccgccggcgagaccgcgagttccttaaggccatcctcggcaagctctagggcaaccccgacgtcttccaccgccgccgccttcttcgccccaccgtcaccactgcgccgcagctcggggggattcggcgtgcaccagggtgcatcgttgaacgaggaggcccctaccgctctctcgatggacgcctctccctgccagccgccaccacctcggggggattttgcttccaccttcgcctccgccatcgtcggagcttgtcggggtcacttcccccaaccctccgaggcgatgggcctaccgacacggacggcgatacgggcgccgtctccgcttggagcgttgccgctagcgaccaagcaatccccgccgcacaccggcgccgtcgtgcccctcctccgccgcacactggactccgacggggccgatggtggttagagcgagagagactttttttttctgtgtgttatgacacgtgggtgctgactcagcattgttgactgaagtcaactcgccacgtcagctaaaaccggtggcaatactgccttaggacataacctggttttgtaagttgagggatgttatatatctgtttttgtggttgggggacgattttgtaactcgaagttgatggacctctgatgtactttttccatcagaatttgtcggaccaaactttggtgggccagcggcagcgtcttatctgtataacttgggggaaaaagtacaccggaggtccttcaacttgtcatcgagttacaa

SEQ ID NO: 13875 - DNA, 566 bp, Oryza sativa
ccttgaaatccgctcggcttcatctttgtcttgaaggggttctttgaaaagtcaaaaatcgtatgaggggctctcgccagtcggcttcaatcatagctacgtcatgagtgcccgcaatttgagcagtatctttgtgaggaccgtcgcgtataaaggtgttcgacgaaaacatcggaaggcgccacctcgcgcttggatccaaagttggcaagtctgtcggcggcttcattattgtgtcgaagaacatgacttagttcgagtccatcgaacttgtcttccaatttgcgtacctcttgtcgatatgccatcatattgtcatcaaggcaggaccactctttcataacctggttgactaccagctgtgaatcgcctctaactattagacgctttatccctagggaaattgcaatccgcagcccatgaaggagggcctcatactcggcgacgttgtgggacgccgaaaaatgtatccaaagtacatagcttaatctttctccagttggtgaaattagaaccactcctgctccagtgcccgaaagtctttttgacccgtcaaaatgcatggt

SEQ ID NO: 13876 - DNA, 495 bp, Oryza sativa
tcttctttgacatgtaatgagtgctcaatcacctctctaggaataccgggcatatcagatggtttccacgcaaagatatctttattgttctgaagaaaagtgatgagcgcactttcctatttacaatctaactcggcgcctattacagcagttttagcaggatcagagggatctagggaatctttttagtcttagcttcgctttctccacttttagaagtcttggtagcaggtatttctccttcgctcgccgtggctgcagccagtgggatatcctcttgggcagacgccatcttgcgggtttgggccatgtgcaactctccttgtggcatgtgacagcttgcttgatgtcactccgtaaggataggactcctcggggaccaggcatctttatcatcaagttaagggtagtgcgggacggccatgaacttggctaatgccgggcgtccgagtatggcatggtatgctgtctcgaaatcggcgacgggctgcagga

SEQ ID NO: 13877 - DNA, 704 bp, Oryza sativa
ctgcaagacaaagcaatgcacaagagaacagcgaaccagaaaaatataacggacaactcaaattgacaacaagcatgttattacagttacatacttacatatgtattatccatgtcaccaaaaaccataaacatttgaatattagttcaagtcagaaatttagccagtattgcagcatctattaccagcttatctatcagctatcactacaatttcggtcaaggacctatgttaccacttaccatcataaacaggtcataatcagcacatgctagttccagttatatgctttcattgagctacaacactatgatgcagacctcaccaaaacatccactagtaggtagtacataggaattgtaaaatggtactataaccgatatagatttcatacgaatggtggcaacttacttggatctttagttgtccgcactccagtaccgccaaagtcacaagctacatcgttagctccattttgctgataatagctgttgaaggcatatgaagcatgtgatgccaatgtatcaggctggtagcagggctgactcggttgaatagcagagcaatcaacattgcctggtccacatgcccaatttaaaccattctgtagatctgtctcagacgcattagcagaagcaacacaccaagtaccatttgcatttgtaatgtttcctccagtcatgatgtccacattgcctctgcca

SEQ ID NO: 13878 - DNA, 5489 bp, Oryza sativa
  unsure (1)..(5489): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgcatgatgatgagtacgtagcttacaacttggttcattaagctaaagagtgttgtcttataatataagagattttgtttatttagttatataagttaaatctcttatatatcatagcacgtagttagttatagacagctcaattcggcttgtttagaacccgagtgcattcgtccaaaaaattaaaaaaagacctcgagtttgagcgaatagaaagttttgagtcacccctagatgattgtacttgtttactgtgaacttttaagttgcacttcgaaattttgccacgacttaaaaaagaaagaagaaagaactatgaaaaatggttcaatttcaccgtgaaatagaaaaggtccatggaagaggtctagaaagcaccctcgatcaacttggcccaacctagcaacttccgatccaaagctgatcatatcagagaccgtcggcctggctaggcccagaagcagcaccgatttggagctggtcttcgcagcccatgtccggcccgttcttcttcttctccttgtttttttaaagtaaatttcagaaaagagactatctaataaacgtttgcaagttttttgggtgaaaaactttcaaatgtaaagtagtgtaaaacatgaggttttctggaatttgccctcttttttttttctgttgcggaataaataagggagctcttcattgtctgtcttatccatatgggcatggcttcacaattgtttgatgagattataccactggaaaactggcgaaatccagtgaaatttgaacacatttcaccaaaagttttgaaattttttgaacagaccggtttacctggcgctttctagatttgagccggagtgaatcatctggaaactaacgaatatcaagcggttttcatcggttctgtgaactctgctctggtttaattaaccaactagaccattgtccatcgctctaggcttgctttgcaaataaatgagagccgtctcattacaagaacaggaacgaatgaaagtttacagctatgcaaattcctacccaatctcctcaatttgtcccaggaccacttctattttctgagcgatgacccagatggaccatttacaacaattccactagatttagggaatcgcatttaacaaagaccacctgaaaaatcaattaacccaaattaccttaaaagatatgaacaaaattccagctaatgcattatcatagagtattttgcaactcacttcgcagaattgttgacaaatacatacttttgctgtcataataaatctgtgaagaaataactatattttaagggaaaaaattaacgataaaagtatatttaggactacgggagtatatatattacaccttttgtcggtttatagacactgagggaaagaacacattaggaaaagtcctaaaagaatatttgcaattccatgtaagtgggaaaggaaaaagggaaacaaaagcatttgcaaaaggggaatgcttgtgctcaaaaggatgagtggattatcttatctctgccgtttcatcatgtcatgaggtggcattctagtgattattgcgaccgttactggctctttcattgtcttctttcattgactccttttttattagttaggtattgaggcgtctcaagtaaacaaaaaaagaaattaaagataaaatagttatccaccagctggaaatatatatataaatacaaaatatttatcctgaaagccaaagattacgcgcctaacgagcaaggcgaacgtgcattagttaggctcatgataaatggcagatgagaataccagatgacaaaaggtgacagtagttaggaacaaaatgaaaggttttatctttttctttaacaaatggttggtagtagtaataggccctatttgggggagcttgtcccagttgcagtttttcccaaaagatgcttctgctagaagctgccctaaacagtccacacttctaagaatctgtagttacaaattctgaaaaatgaactaagaagccagaagctggagaagctgggtttcagagtttttttagattctcagaagctgactatcaaacagctgcttctcagaatctaaagctcccccaaacaggccgatagactagtagctggtgggccccatgacacagtcacttggattttcctctttccatgaggtgactgcttgcatttggtgttattctctgccatatataaacaccaccattggtcgccatggagaaaagagggagagggtgagagaaagcagcagcagagcatatcttattgagcagccaagaaagcaaggtattggaaggaattgaggaggagaggaagtgatggaacagcatgagctttcttcttcctcttcctcttctgaaccctcttctccttcgttttcttcttcgtcttcgtcatcgtcctcgtcctcgctgctgaggcagtgcaggatttgccatgaggaggaggatgagtggtgcgctgcaattgagtccccctgtggatgctctggctctctcaaggtaggtacaaagttacaagctgatcaagtgatcatccatccatgatccttccctgcatttcttgtagttgttacatgcatgatatggttcttgtgatgattaatttactagtttgttagtggctaaaatgatgtgtttatggtttgtgtttgttaatttgtgcatgtgcagtatgctcacaggggatgtgtgcagaggtggtgtgatgagaaggggagcacactctgtgagatttgcctccaggtagactcttctttgtgaaagtttgtgtttgatcattagtgtaccatatgacctattcgtgtataatgtgaaacagctagccacttttattgggttagctagaaaggtgaaatttgtgcaggaaaggtgccaaacagctagctccttttttcttgtttatttatgatttgtaattatgtgtagctgtgcaacattatgtttagaggataaagtaacagatttctttggggttaaaagaaagttagctaatgcttctaatcataagcaaagtgcacttttcttgtgcaaaatgtaaacttctgccaacctttcataaactattacactagccgcctaaataagacattctgaaagatttttcatgcataatcctgtttttttaataatacaagatgcttttcttgacagaattttgagtcagattacaccatccctcccaagaaagtgcaggttgttgaaacggcagtcactgtcaggtacctcctccatctcttgcattgtcaatttctgataggaaaagatcattaagataatgctcttaggataaggtgtttctaatctaagcctatctggctagtagtatcatgcaactgtgaactgtcaacaccagtaatgtagcactgtacatgcccttaaacggagtcttaaatcagtaggtaacactctgttttcaaccaaggaaccaaccaatcatgcaatgagagacaggattagcatactaacaaccagtggttgatgagatgatctgtgtagccatttattaatgttaagatggccactcaggtagatcccccaagatgtcctagataagccacaggacccaaccaacaaggcaagtataccttccaaactagggaccacaatgacacggtgacagctcttaagatgttaagatctatcaataatacaagacaagaaatgcagtaatgcatcttggcatattacattggcctgattagtggttctccaatgagattacagagataaagctgcagctcagttttcacacagaaccatcacaacaaaatataaaaagagagaaaaaaaaaagaagcttcagctggcaacatttccacacagaactacactgaccaattgcgttaggctgtgtgaaatgccattatctgaacaaaaatgtacaatagggcatcatgccaaaaatgaccagatagacagccaaatcaaaccgtgaagtatgagctgtggatgcatcggtgaggcgtcctgtcaagagcgtgcgtccaaatcacacggtgtcaatgcacaaatccaccttcccggccatccagcattccagctaacgtggccaccttagtcacactcacatcatcacccggggttgcatcttgctgcaaggtttcagcagttgcaaccaccagatcggattagatgggggacacatgtgccaactcggtacactgcctgatgcagagccttcttttgcagagacgaggagatgctccctgaggaactctctcaggaggatcaggagcagtatgcaggatccgaggcgcagacgggtaatggagactgctcctcatggtgccgatcattgacgataacggtatgagacagctgaagcgaaattgtccattgtctggcaggccgttcagggtgtctcctggattctgatatcatctgtgattcttgtgcagttcaccattatgctgctggtgtggcatctcattgcagtggtgacaattgaagcggcggatcactgtgcattcagccttgtcacagtgagttcactatctcaacagaggagtaaactaatcaattgaaattaactaactggggaatgttgcattgcagatattcttacttcgggctgctggaatcttgttgccgttctatgctatcatgcggatggtccgcatgattcagcagggccaacgacagtttcggttgcagctgcttcaggttagtcttgactgacttctgctcaatggcttataggagcataatagtccgcagtcatgataccttctcttcctctgtttctgcaggatcaacggagaagaaacgcatcaaacttgcacagtatgagtggccaggagcagcaccagcagcttgtaattaatgttcactgaacaaatgaacttaaatgcttctacattggaaggtcacaggaatgtgcaatatgtgttgaggggaatatgttcaacatttgtaaaattttagtatatttgtagatagcatagtaaaaaccatgaatctgcagtctgatacagtttcgacttaccagtgccatggacgcctcaaatatgaatgaaggttcaaataagtgaagattgcaacaaaagaaaaagactatttttttcttttttcttttttcttaatttgtttgtcatgaccaagtattggtgtcaagatggtataaacccagcatttacagaaaactaagctaacacactaacagaactaagataaaattgagaaaataaagtacctaatcttgttc

SEQ ID NO: 13879 - DNA, 5985 bp, Oryza sativa
aaagaactaaaataatgcccattataccaaataagtcaatttcaacctgatgcagttttccttgaaaaaacgcatacgtaaatttaattcaggaaatattaggacaagagcattcagttttaagctgaataaatctaaaggctagattcatggcattattactattttattttctttctatcctgcataccaaatgtccttgaaagattaatcaaagagtaaaagctaaaaaaaaaatactaacacatgcatcacaaaagttgaaatgtgagcatgttatatctgtcaggtttaaatttaaatcaggacagtaggaatcagaataaattaaattcaccaaacagaaaagtacaatagaatcaaagagcattgctcatgtttggtgtaacagtactaagaggagctagctaactgaatactgtacattaccttgactcttaccaaccaagtgccaagttagaatcaagcaccacatgatagacagaaaggtctcccatgtgctgtgggacagtagaaaagtctgagacatataaagccagataaggaacacaataatacaacggaacagatttataaaacaaatgtggcaaataattacaacgtactgagcttgcagttttcataagcagtgaaatatctacaattagacacgcaaatcatatttgtaatagcatttagtaaaggacggaaccagtgcacatctaatgttgaaaggcacaacaagacaactccatgttaaagaaccacagaaacagagctaaatctttgatcacatgtgaacagatcagcaaactgtaatacacacaacatttttagtaaaattgacaaatctatccccaattgtaaacatatggcaatgttgggtcctttgtttatgcaatggcatagcaacgaagcgaacaaacagccagataattgatctattgaacataaagataccaaacaaggaacttagtcatactacataacactaaaacaagtagccttttgaataagacacagaacatgcctacctctcaaacaagtgagtaatgatgcaaaagtacttagaagttgaagtgtggtatggaacaaacatttattgtttttaagaatctcaagaaaggcatgagctataaacaggaccaaacatgtgacatcttaacaattgacagtgaagactggtgcaatagctctcatctaaccagactaggtttgttgtggggtgattcgctttgtatatagacatatactaaagaatgccattctacagtattttgataggaatttctgacaagtgacagacaatgaagtagacaagatcacaagattcagctcacaggagtaagaggaatgatcatattagtaaactgcaacagagctcaaatcacctttaaactagaatagagatcaacaaacatggaccacatggaataaatctgcataggctcatagctgctgcgagatagcataggcaaaataaaccttagcaactttgctacgaccacatctcaaattgcagtcaagaccaaaactaacaactgcagaacaatgccattcctatttctacaatatagatagctctgctgctagtcaaaaaagagaaaaaaaagcaagatgcctcatacgggtatagtgccattgaccacaaaaaaacctggtcctgcacttgctctactctgcagaattaccaatgaattaggatcccaaagcagggaaattggtcaattttgagaaacaaaataaatcttaatatacagctttctttcagaattaagaacacaaaatatttggacgcaattgagatttgctaactacaaactaaaggcagtataaattgctggatggaaccacagagttgcggctcgtaagttccggctatcttcatccttagaacctactccgtccgtcccaaaataaactaacctaggttgggatggaatataatctagtacaacaaatctagacatgtctctatccagattcgttgtactaggttatgtcccatcccaatctaggttggtttattttaggatagagggagtacacatcagcattgcttaatcataagcacctcaacatacttgaattcaacgatatggctgacagactaagccatggtacgatgcataatccagcataatgagttattgagatatactaacggaacaagagagaaatggaagaggcactcctgaatgaagatttagcgtaacacatgactgaactaaaataaaactaccataggctacatcataattaactgaatcattttgttcacacatgaaaacacactaatatttcatggaccattactatacaacacagaaaacaactagcacctttctcctaaaaagcaggagcaacacctcaaatttcagccaccatcaaagagatccacatttctgctggcaaatggtaatcttagaacgtcctgctctcagtctgattagggacattcctcttgacacgttttttcattctctctgcccactggtggaacacattagacgcatcaaatttacctgtaaacttcaccttctgagccaattcatacaatatgtcaggcttcccagccttggagaaatctgcagcaaacttattgtagtctatctgtggagtcttcatccctttttggatcatctcttcaatgtatttacatgcctcctcaggtctaccatgtcgtatatgcccattaataaacactgtgtaagagttcacatctggacaaatccccttccggtgcatctcctcccacaccgcacaacccatcatgtagttcctcccgccaaggaaatatgacttcatcatcatgttgtatgtatggatcgtaggctcaagtcccttctttatcatctttttatatattcttgccgcatcatctggcatattcctattcgtaagtagcttaatgagagcattgtatgtccgtccatcaggagggcaccccttttgagtcatttcctccaatagggctgtcactctatccatcctctttgcattcccatatcccacaagcaagcatgtataggtggcgacatccggctggcacccaacatcctgcatctcctcgaagcaccgcattgccatgtccatctttcctcgcttacagtggtcccgaatcaacattgtatacgtccacacatttggagcaggcccctttgccttcatgagctcaaacatcttcacagcctcgggccgcctctgcccgcgtagcaacccctcaatcatcgtattgtgcacgacaacatcaggcttcaacccattctccagcatctcattccaaacccgcccagcctccaccagattcctcgcgttgcaccatgccagcatcagcgcggtatacgaccgtaggtctggagcgtagcggtcacgcattctgtcgaacacctgattagcctccctccccagcccctcctgcgccaaagcaactagcaagcaattgaaggactccaccccatcgtcgaagccgtgcgtcctcatcatctcaaacacgccgaccgcattcttgatctcaccggcagcagcaaacgacttgatggcgatcttgaacgcgtccatgcagagggcgccctccttccccatctcttggatcaacgccaccatcgactggaactgcctcgccttgccgaggatgtggaccatcttgcagtacgtgatggtggtgtgcgcgaagccgccggaggcggcggcggcggcggcggcccaccggaagaagcggtgggacggcctgtgcgcgtgcttgaagcggtcgagcaccgccaggacgagcgtctcggagagcggcggcgagagcgcggtgagcgccgcctcgaggctcgcgtcagcgcccgcgcccgcgcccgccgcgacgacgtccgcgatggccgcgcacacccgccccacgtgctccgggtggctcgagtccgcatgcgccggcgagcccccctccccctccccctccacctcgtcgccgtcggatgccgagcaggtggaaacgcacctcgccccacatgccagcggcgagagcagagggagcgaggcggcggcggcggcggaggtcagatgcggtgggggcagcggtgaggggcgaggaggtgggcgatgggggagtggcagtagaggcggaagtagacggtgagggcgatggaggaggcgatgagggcgaggaggaggagcgtcgcgcacgggcacaggagcaccgtcgccggcccgggttgccgcggcggggagaagggcggcggcggcggcgacttggaggtctccatggacggcggcggcggcggaggaggaggaggaggggaggaggaggaggtaggtggtgggtttgggcttaacggccatggacggggatcctgccactgcgtcggtggaattttggtgttccccttcctccctcccgtcttccactgttccgctgtaaaaatgtaaaatcctttttcggtgctttgctgtaaatacctaaggcatccgcaatgttgtgtttagcgggtataagtagcattagatactcttttttcttttaacccgataacaatacagtaagagcaagtataatgagctatatgcctactataagtttatgtggagaagagatgtgacaaaaagttaagggtgttggctttcataccagagctagcttaacacaagcttcaaaacaaatacaattaatgtataagtaagagatatagagaggagaagaaaattatagccaaccttatagctaatctattatatatgttggctttaagattggctaatagtaggaagtgagctctattattatccttgctctaagagtcataagtagttacttccttcgtttcacaatataagttattcagcattttccacattcatagtaatgtcatctagattcattaatatgaatgtggaaaatgttagaatgacttacattgtgaaacggaagaagtagaacctaattacacaggtacaatcaataaagaagagttaaactacagtgtttctgacaaaaaaacaattataaaagggagctggtcattgctttccaaccgctgttctagctgttgcttcttgccaatacttcatgccattttacagctccatactctaaaaaatacttatatgacttgtaacttgttgaatcaaaacatatacattctatcaaatagaagagatggatccctccaacagaagtttataaaagaattgcaggcatgatatttatcatatacttcctccatcctaaaatgtagctacttagtatgggacgtgataccacctagtactacgaatctagtactactaaaatgtaactaaagacaaatattttaaaaatgattcataatcaaagattttaaagtttgacctcacccttatttaaaacgacaagtattatcagcccggagggagtatatgaatctaatcggtggcaagttttttagtcaagatgaattaaaggacaaatattgagccgaacccatacaaccactctcaccgaaaggacaaatattgagccgaacccatacaaccactctcaccgaaagaagagaatagttgaggccttatgcaattagcaatgggttgaagacatatgacacaatatgacgtctgcccttctcgaggaatactttgttacatggcgtgttggcacgcccaacttacagccgtcgaaagaaactaaagacacaataagatggaagtggacaaccatgagaatatagtgcaaagtcagcatatgaaatacaatttagtagaataattgaggtggcatcatgcagtcaaacttagagaacatgaatacctaccaagtgcaagatatttgtttggtttatattcggtattcacgtagatgctagatgccagatgaacaatgacccatggtctaggttggagcaaagtcgacggtgacaaattatcagcaaaggagacgatgaaactacctatggcagtgacaaattatcagcaaaggagacgatgaaactatctatggcagtgagtaccttagagcagaggagaaacgtttggaatgggtcaaaaccctaa

SEQ ID NO: 13880 - DNA, 8845 bp, Oryza sativa
ggtacaaactttcatctcgtgccacacaaaaaatgcattggtccatttcctaaaccatagtctaaatgatagttttacagtttacactgatcccaatgttttctaattgtgtggtctagttagtataggaccgtttttgactgactagatggttaaatagtctaattcgcaatttaacttctaaaatggacgagaaccgtttgtctagcatctagacacggtctagactgtctagactatggcttaggtgaacattgttcactagcacgggatcggttatctctaacgggcttcaagcctcatctctttcgggtaaggcccccgccactaagcaaatgtcactggtgtgagaaaatatctcaatcgggcaccaggccatcacggatggatgttatctcaatcgggccaacaacaaagcccgtcacagataagattgaccaagcaatacgagtcaaaccaggttaggtaggagcccgtcatggatgactaatcatctcaatcaggccttaaggaacagcccgtcaccgatagttttgacctacctgttgagtcaaaatagtcccggtttggatgacttatctctatcgggcttacaccaagagcccgtcacagatgactatatctctatcaatctttatttagagcccacagatgactatatctctatcaatctttatttagagcccacagatgactatatctctttcgggcattttaaaactgcccgtcatggatgattatgtcaacatgtactgcgtgtatgttccatacagtcatagcaagccttctttcctttcacggtttatccagaaagattacccagtgcgggataatcattaatggtgcataacaatagaacttgtagcttgaagttctcctgaccatatgcatcccaagtttccacaccttctttctagagaatctcaagatcattgataacaggctccaagaacacatcgatatcattgccggggtgcctcggaccttggattaataagcacaacataatatatttccttttgaagcacaaccatggcgggaggttatagttcgcaataagaactggccaagtattgtgagaactgctcatgtctctaaaaggattcatgccatccgtacacaaacatatcctcatgtttctgaggtcggcagcaaagtctttgtgcttttgatcgatattcctccattgaatcgaatccgcagggtgtcttagcaaaccgttgttccttctctctgtggcatgccaacatactaactttgcttccttggggttggcaaatattctcttgaaacgatcaatgatgagaagatacaacacaaccttcgccggaccacctcgcttcgacttctttccctcccccacacttttctttagcttgtatcaagaagccttgtagacaagacaaacatctaagtccgcatattgtttgtggtacaatatgtagtcgtatggacaagcgtgaattctacggacctctaacctcaggggacacgaacttgctttgcttcatatgtcgtctcgggcaatgtgatctcttcaagaagcatggccttcaatattcccaaaagttctgtaaaactcttgtatgcccatccactacttgccttcagcttcattaggttcaaggtagctgacaatttggtatgtttttggcttgcatctggtgtatagaggtgtctccgagtcactaaccaacctgctgaacttcgtggaatctctctcgttgtaagttgggtcctcgacgtcacgtaacatgtcttgcagcagatcagggtctacattaaccatttcaccgcccaatggagatggtataaacatgccatgctcatcttcatctccttcttcatgattgtctgcaccacttgtctgcaactacaccacttcccgatttttactctccatacttcacccaacatgtgtatcccttcatgaattcccccgttgtatgaagtgagagtgtacgtccattctgctttcaaacatattctcattcttgcaatctctacatggataacacatgcatttgttgtttcttcttttcctatcctcctccgcagcgttcataaaacttaatgcgccatttctatactacttgcaatgacgcttcaaagtagtcgcatacatctaacttcgatccaccgctgcaaaaatgaacaaaatattagttaacatcttataaaataagtactactaaattaataagaaattattagtaactttttacttattttcatgattttcctgcttttctttggaaaaaaaatgataaaaattcgctcccttcaatctcccacaaaaatagtgaactgtgggagtcagacaacagacaggtggagtatttatagtgtgcaaaatatatctcaatcggtccaaagaaacgagatttctaacgggcataaataaaagcctgtcaccgatatgaatcatcggtgacgggcgttaacctcatctcaatcgggccttatttggagcctatcaccaatgttcttcatcgctgacgggcttagtagttgggcccgattgagatataggaggtaatttcaatcggatctaacagtgtgcccgtcacagatgagtgtcatcggtgacaggttataggtatatacacctcgattatgtatgtacgagtacatctataacaatgttaatttaggcccgattgagatgactttgttctgacggcccacgaaacccaagcatgtgaggggccagtggccaaataactattcctattagctgtgcatgaagaatttgaaaatcgctaaacatctgattttggagtgctcggtcactgtgatgtatggaatgaaaccttcacaaagttgcatcatcaaatgaacaacacctaagaccatagcagccttcttgactagttactccctccgtttcagtttataagacgttttgacttttgtcaaagttaaactattttaagtttgactaagtttatagacaaatatagtaatatttataatactaaattagtttcatcaaattaataattgaatatattttcataataaatttgtcttaggttaaaaatattactacttttttctataaacttgtttaaacttaaaagtagtttgactttgacaaaacgtcttgtaactttaaacggagggagtagaatggttgtttcatataacaagtatgcaacatattccgcgcttgctgaaattttgaagcctatttagcgagaatatcttgacatggcagtaagcctatttaccgttataagagtatgtacctatacaaatcatatataccatttggcaacttgtactttgtttcttctgagataaatagaaggcccacttgcccaagctgttttttttttaaaaaaaatctaaccagatagagcaaacatgtgacaaaatttgaaggaaattcactctaaatttctatcaaagaagattagcaattatgtttttttcctacattttaattgcacgggatgggatcaaagctatgggtgtaatcttttttatcgtttgtcaaatgcaggccaactcggtatctatacgtccaactaaaatggaagatttttgctattttttatttttattttttataagattcccgtgtttcaaaggagaccaaataaaggtcgctttactcaaatcaaccttataaaattacattccaattttacataaccaggtggcaagcacaaagtaacagggtaaccaggtatacattgtgctggtaagcatacattaagctttcacccaaagaaatggtactactggcgaagtgagcatagcgtctatatttgtactgtttctaaaaaaaaaaaagtacaactccatttcataaactcatgtaggcttggatgtctactttttatagtggtgttcgggagggagagaaggttatgaacttctatctcacgcatgtaaaataggttggcttattagtgcattaacaattaaatattagctataaaaacttaaaatttagattaatatgatttctaaagcaacttttctattagatttttttttcgaaaaaaagtatttttgagtagtttggtaagcgggcacgtgaaaaaaaaatgagggagtataaattaggaacatgtaattaaaaacactctcaagcattgatggaaaccgtcaattgagagattttagcaagcagtcatctcgttatttgttttaaaattaaagagagcaaaatggacgtggcaggattgagcagataaaaaaaaatggatcacggcagtcagatttcaagaattacatattgaccatacatgattgcttttttgtgcaaattatatctgtattctatcgtaccaatatcaaatgataatgtgcacaattcctgttaccatgaactatacagttaattaggatcctacgttggaaaattaagtacagaaaaacatctaaagtgatccctccaaacattagtctgcaaatcagaaaaaagttgagttattcacaaataccaatttgaataagaaaaaacaacttttgaaactagcaaaggatgcaaccagaaagcatcaaaacgtgctattgcctaatgcaagtagacctcaacagagcatgtcatgtcgcagcaaattagctgattcatttgtgtaagaaaacctcacctggcattcatcacaaataatccagaaaacttcttgtttggaggagaaaaaaaaaaccactttggcatgacaaaatcttcccatcaagctttaaaaactgcctgcttttgagaagcgtcctatccaagacccaattctgtataaataaacatatgaacaagacaaagttgcagccagggatggatctctcatttcatggccaatgatgccgctgacgcctcagctatcaacgagagaggctgacgagcttggaggcaggcgccgatgtcaaaagggtgaatctcagctccatcaaatataagattgactccaggtaagaccacatctttggtgtctgcatcatccggttctggttttgctacaggtgtggtgggttggtcctcagtgacagatcttgtggcagcttcatacacaggggcgagagcgtatgacctattagagttttaaatttagaatggaatgatccagtggcaaaattaacattacaagaatcatattaacctatacatcacaagaacaatgtattgagttgcatactgatacacctgccagttcaacccaaaagtttaaaccgatgaggaaggacggttaattcactttaccgctacactatgcggtgcagttctttttatgtatagaacatacctgaggatgctcccgtcgaagcttagaacttcagtgaagcatttctgccgtcttgcaactttcagtctgtcattctcacggggggatcctccagtggttggcgccactgtgtcatgaaatggactccatctgccactgacaatgttgattagttggcgcggcgagttctttgaactgcccctttgattgaatagccttgctgttggaccagttgcttggtactcagcacaaagttctctcagcctctttctcacattctgcattgcctcgtaatgttcagtgaggtcatctttttgaagcatgtgtgactcgatgaccctttcgcatattttttcacataactttggattgaacagtggaattccaaattccaggctcaaaggtatccactcataattttcatcctttgagaaaatttcattggatttgcttatcctgtgaagcctaactaaactaagataaccaactgtgcccaactcgactctactggacagattatataatagcgaagacaaatttaatattttctcctcaggtaaatccatgctggctactgtggatgcaattgacccatcagcatttttcaggggtaacgggacatcaacggtgacaaggtttccagtttcatcaagatcatttaagctcaatggctgcactataacagcagaatgctttgtcattgagttcaggtaatgcagcagaaggcttccctttactaaattcccttcgaactttcctcctaatccacccaccacagattgatcccaagaccatatcaacgccttttcgcagctggctaatggttcaggcagcatcctcaaacggtgtcctttcataaacacagcagatactgggccacaactcccagatgtatacagtgcaagcttcatccaaggtgtcatggaagagtaagaaggtggaccaaaatgtactaggccggcagtgctgggtagaagtactgatgaatatggaagaggaatcatagacaccataatgtcatagtccctgacaagtaatctttcaagtgttgttgcggacagtgaagccaagctctcgcagcgaagaatattgatccggtaacttcttttagttttcgacaaggaactactgtcagttgatccatctggtagaggggttttgctcgtatcagaatcatttttgtctgtgctttccttactttcagagacaatacttgagggtgatgatgtactcgcatctgcaacatctgagtcaaccattgggtggtctgcttgtgacagttcattatgatgatcagtatctgcagtgtcgacggtttcaagtgaacctccattactcttaacaacattactaatgccctcatcaatgctttccttggataaagttttggagaaattctcctgcaggcagaattcctggctgttcggttcaatagcttcatctggtgatgtccctccagacagcaaacactcaaggaagcatctgaggctaaaagcatgatttgcaaattcctggagcacaccttcaaacctctttccttctaaactagcaaggtccttgcatagatcagcaatgcaagaatcaccaagctttccggcctcgtatagtgtcacagcatgagacttcagacctgtgatacgtatgtgagaaaattattaccaatcaatgacattgaacagttccctgcctagaagtagaaaattagtaacaaatggaatataacctggagataatgaacccatcatcaagtacgaagttacattggcatcaacaatgaaacccacataagaagccccagatattctcctgggtccatcggaatcactggtgagcaatgcatgacctgacctttctgagttgatactcgtaagtgaaccttcgtcatcatcactaagaatattactaggtattgtagatccatttgaatctctaagaatggagtctgcatccataagctttacagcccaacccagtcgacaagcaaatgatgcagctgcctgaagctgatacaggtcagcctgcaacgttttagccaattcagcaactgtagcattttcacttgatacaacaaatacagcatatagtagtctgcaaacaagaaaggcgtaaaatcattttaatagctacagatgattcttgcaatgcactatagtttaatagggaatggagctcagttgtgtggaagaatactcaaggcaagtactcactcttcaattggatcttcgtaagactgatccttatttgacacaaaaccttcaagccttgatactgaaacaacaggacaagtacagaactgaaccaattggcatttagggagaattgagctgtgttgtagtttcgtgtctacagaataataccctcaatatacacacactgttagtgcctctaaggatgttataggtttctaactgatattgtacttatcagcagtttaccgttacaagcttgaagcaactgtgccattgaattataggccaatcctccaacaattttatgctaaaccataataatagaaatcatacataagtatgtaatgacatagatttctccgaaaccatacctctgaaacggtcctcaggataaacagccacatcgaagtataccattcctctcttgtaaagaccatttataaccttcggatcaaatagaacataggaattatcttcgtcctttgatattttatctattgctgatgcctctgcttctgaaagcctctacagtaaagtaatattatcaattaccaaaaaagaacaaggtacttttgaatcttagagagaaataagtttaactaacactgttgtatgccatcatggtaagaagagaaccacaaaaaaaaaaaactcgctatatcattctgttaaaagtacaatatccttgcacaaagaaaacttgtcactgatgaacctaaccttaaactcttccaatgtgaagttgacaaaccgaactccccaccatggttctattgctaggtccgcagggagtgctggcagcagctctttcgcaattgatttgctcagcttccacattatcttctgacataaacgagtggaacaaataaaaatataacagcgagaaactaggctagatatgttcattttctgaacatacgataagcacttgtgctgcattcaaatattacagtccattcctacatcacagtaataatgctaaaatattcccgtggattcactaattaaatcttgtaccctggcaagaatataagaaccaataatatcatagacgacagatcatgatatggaaggtaatgatacctttgatctacacttgttcataatatcgataaattcatttctcccaacacctgtgatcctcagggaatcagcagcactgaagtttggaatactgtcatatggttgctctgccagtattatcaacaatatacaaatataaagaggtgcgcacaaaacataagtctccatgatgaagataaacggattgtaaaattgttgtatagtaaccatatatcaataaatgcaatatataaactcaaaaggtaccacatattacaagctagaatcagaaacgtattgtgaagagaacaaaaggttcctccattttaaatggtataaactgaaaccattttaatcaggaaa

SEQ ID NO: 13881 - DNA, 2465 bp, Oryza sativa
agataacttttgcttatcaaatgcagctagtgaacatctgatcagaccctttgagattgaggaattagacaaaataattagagaaaccaagctaaatacagcacctggcccagatggttttagtgtacctttttatagagctttttggccccaagtaagaaatgacctctatgagatgctgattttgcttcacaatgaagaactggaccttaagaggttgaactttggtgttatctctctgatcccaaagagtagcaatcccacatacattaagcagttcagacctatttgtgtgttgaatgattgtttcaaatttctcagcaaggcggtaaccaatagattgacagaggtggcaaatgatgtcatttcccccacccagacagcctttatcccaggaaggtttatccttgaggggtgtgttattatccatgaggtgctgcatgagatgagaaccagaaatttagaggggattgttttgaaaattgactttgaaaaagcatatgacaaagtgaggtgggactttctcatagaggtgatggagaggaaaggcttccctactaaatggattagctggattaaaagctgtgtgatgggaggtagagtctgtgtaaatatcaatggggagaggactgacttttttagaacttttagaggcctcaggcagggagatcctctttctccccttctctttaatttagttagtgatgccctagctgtaatgtttgatagtgccaaaagggctggagttctcaaagggttagttcctagtattttccctggggggatcacccatctccaatatgccgatgatactgttttgttcattgctaatgaggataaacaaattgtggcaacaaaatttattctgtactgctttgaagaaatggctagtcttaagatcaactttcacaagagtgaagtgtttactttgggcatgaatgagattgatactttgagggttgcccaaatgcttaattgtcctgtgggttgttttcctatgaaatacttgggccttcccattagtccagacaagatccttaaccatgacttcaagtttttggggcagaagttagaaaagagactaggtacttggggggctggagacctatctcatgctggtagagctgtccagatcaatgcttgtctttcttccataccctcatatgctatggggttctaccagctaccagagggtgtacatcagagatttgacaagataagaaatagatactactgggctggtaataaacttaaaggaaaataccatatggtcaagtgggaggatatggcttttccaaaggactttggaggtttggggtttactgaaaccagaaagatgaatattgccctcctggcaaaatggattattaatattgaatcagatgatcagagtttgtgtttagaggtgctcagaagaaaatatctgcaagagagaggtgtgtttcaatgtaagtctgattttggctcccaattctggagaggcttactcaatgttagaaagtggttgaacctgggggctgaatggaaaattggtaaggggtctcatgtctacttttggaaagacacctggttttgcaactgtcccttgagtgtgaggtacccagctgtgtttaggatttgtaatcaacaagaggtgatggtgtcccatgtagcccaaaggagactggagtgcttctcttttggaagatcctttggacctgaggaactgactgaatggggggaattaacaaaaaccattgatgatttagaggtgactgatgaggctgacagattgctttggggattagcaacaaccaagagatacacaaccaaatcgatgtatagaactctgacctttaggggcttgagggaggtgaattcagatatgtggaaaagtccatgccctacgaaaatcaaacattttctatggctagctcttagagataggattcagtcggctgaacaattgaaaaagaaaaacgggagggatctgagtcatgtcaactctgtgggaatttagaatcaactaatcatattctctttaactgtgacatggctaggttaatgtggtgtatttgtagagatgttctgaactggaatgtaattcctcgctgtttcgatgatttcttccttttgtgcagtagtgacactaacccttcctccattagagtttgtatgagtatgcttgctgctgtttgctggaatttgtggctgactagaaataatatggttttcagagatagattgctttactccccactaaccctggctttccaaattgcttctaatcttttgcagtggaggaagctctgtcaacctgaggatgtgccgaagctggaagtaatggtggataggatcaagtcagttgcgtcaagtctgaaaccgcagaggacgggtgttggatagtttcctgatgtcttgagtccctttgataagtgatgttggctggctgctagaacagcagactttgatattcatactgatag

SEQ ID NO: 13882 - DNA, 31551 bp, Oryza sativa
aaaaaataaataaataaataaactgaaaccattttaaatagtataaacttgttagctgattaaaattcacaatcaagtagaaactgaaactatagccaagcttacgtagttgtcaaggtgaacagaaacatttttagtagtataagttatgagtgagaaatcaaaactactatttggatagatgaattttagatattgatgcagaaacagcggtgcatgttacatcacacatatggagctttgtttctggtagaatatatgtatctaaaattcaaaatgagtcaatgtggacattgcataacggcatgtcaatcagcaagtacgtgatgcaagtaggtggaatgttataatgagggtgtgtttagttcctgaaaaaagttggaagtttgaagaaagttgggagtttagaaaaaagttggaagtttatgtgtgtaggaaagtttttgatgtgatatgatgtgatggaaagttgggaataggcgggaaactaaacacggcctgagatgctttgctttctattaataagcagttaccattcttcatagcttcaaaaagcacatcacagtaatatttgaaaggtgatatcctcattactcgacagatgtggtctgcaagatggtacgggtataactacaaaaaattaataaaaagtagcagtcatgaaagctttctagaaaaagtagtcaagcctagtaataaaattactttctccgtttcacaatgtaagtcattctagcatttcccacattcatattgatgttaatgaatctagatagatatatatgtctagattcattaacatcaatataaatgtgggaaatgctagaatggcttacattatgaaacggagggggtacttcctagttaattgaaaaattgttaatgtatgggcacaagaggtatacaaggatacaacccaaagaaaacattttaacaaaatgtagctgtcatgaaagctttctaaaaaaactagtcaatcatactaatacaattacttcctagctagttgaacaaattgttaatatggctgcaggaggtatgcatgaatacaacccaaagaaaaaaattattaacaaaaatgacaacaagtgtatattgcatatgaaatcagtcaaaacataccatttcacaaattgaagtatgaaaacaaagagatgcaaaaggtgtttctccactacttctgaatgctggttctaattaattgagagaaatttgagcaacatactgcaaggttcctgcggagatagcgcatcaactcctcatagtattctccctctttgcaaattttgcgcgcgaaacaggaggtccatggcaatcgttttcgtatgcaataatctacaatcctgccatcaatgtatttaggaagctggtcatcactcatcaggcatacatctttaagaaacacccaaatgcattatgcaagacaatactctgaaaatcctgaaactaggtcagaaaccaaaaataattgtcctgagttatctaacaagattatgccattccacatttgtgctaccttggatggctgaattggtgcagttgggccctgtgtggcttccatcaaaggtactgtaccattgataacccaggcccactcacactaacaggccaaacccagatgataatggtaggcgacatcacatgggctacacaagtcggtgacaatcccggatagtggataatttgaggaattaggataatgaacatttcggttgattaaccacgaacatgacttgaagaatttaattgacattcctatatataaatactttaatcagatcattcgcccattcatattcctaaacaccccagattgcgtcccaaaatctccaagcaaaaaagaaaaggaaaaaaaatccccataatctaaccgaacaaattaacttgcgagcagaaatgggattaatgcgcggatggatggaatgcggggtagatagatattatacctgcggtgccagtcgtccttggagacgagggcggcctggatgcgcttggggaggctctcccatgggagctcctccctgatcgccttcaccatcatctgctcctccaccgtcgccgccatctgctgctgcatcctcgatcgatcgattaattccttccccaccaccaccacctcctcccctccctcacttcaggattgattcccctctcgccgatcgagcaatgcgcgcggatgcagaggagagagagagagagagagggagggggatgtgcgcgaagaggaaggagcgcatgcagaggaggaacaggagagagagaggggcttcctgcatcgtttatgtcctttttttttcccgttacatatcggttcgctgtggaatttgattatatcaaatttttcttaatatggaatttaaatcattgagataaaaaaaagatcatttttgtttgcgagaaacacggtacataagcagatgctttgcataaatatgcacattcacccgtataaatgcacatgacgtgtgaaaaatcatgagacaatgtagtttatatttgttactctacaaacttttttttaacgttactccacaaacttgctcgacatagggagggagaaaaataataataaatcgtaataataatggtactggaaaaaaagaagaaagcctatgatgcattgggctattgcattcagtaggaggtggatgggctgggcttaaagccttaaatgcaattgaggttctagtgacttactgtggaattaggttaaactgtatacttccgccgtttcatgcattgtccatatttatatagatgttaatgaatctagacacacatatatgaatgtggacaatactagaatgacttacattatgaaacggggggaatatcattttctttgatacaaatttaaataattacaaaaatatcgtgacaagaatttaaaatataacaaaggttgtgatattgtttaggtcataaagtaaaaaaaaaaaagaagaagaaagggctatccctcaccttgcatagattacaatttaccctttgtcaatgtaaggggttgtttagattgatgtcatttcaagccataccttttttttatataaagttgttaaaaatatgcatacatttagttttttttttgtcaaactttggtaaatacataagaattcctgccaaaattttgttaattttgtcaacttgcctaaattagtaagttttatattggctacaatctgaatagtgcatatattacaatctactattgtcaatataggtcaaaggaattctcttaaacgaccaccacaactaaaggccatgttttgaaagtttatagtagctataacttcttcatcttcagctcttaaaatatattttaacataaattctatagctctccaaacaaattttaacatagattctatagctacataatgcaaaaaataaattaaaagctagaggctagagaacctaactttttaatttcagattctcaaaatttagctagcaatcaattgcttcttagaattggaagttcaccaaaaaatacttaaacagcatgccaacctcaaggacatactataaatggaagtactactagtattcattttctttatgtacaacgctgtataaaaaaattgaaggtgtgtacatgttttgcacgtagtgggttagtaagctggttagccgaagtgagcgtagtttaattggttatgttcttttgtgatggaacgagttcacttggatttaagttctagacttaataagggtactcgtatttacgactatttattctttcagtgatagagacgacatatctatcaacatcgagacgcttgttatgacttcatcaatatgaagatatgtcggttgagtcttctgaatatgctcataagggtaggatgtgcatttgtgcatttataggggtgaatgtgcatgtgttgtgagcgcttatatttatactaacgataatacttctacgatatttttgaatactccatccgttctaaaatataagggatttttgtcagatatgacacatattagtactacgaatctagatggggagcttgtccaaaagtattaaaatatgatgtatcctagtactaagagatgagtcatatcggatcaaaattgcatatatttttggatagagggagatgtagtttgtcacatagaattgttgtgtgtttagttcatgccaaaattggaagtctgattgaaattagaacgatgtgacaaaaaagttagaagtttgtgtgtaggaaagttttgatgtgatgaaaaagttggaagtttcaagaaaaagttgggaactaatgccatgttttgaaagtttctagtatctataacttcttctataatcttcagctcttcaaacatattttaacataaattttatagctctccaaacaaattttaccatagattctatagctatagaatgcaaaaaataaattaaaagctaaagactagagaacccagctttttaatttcagattctcaaaaattagctactaatcaattgcttcttagaattggaagttaaaaaaaacactaaatagcatgccaacctcaaggacatactacaaatggaagtactactagtatttattttctttatgtacaacgcagtataaaaaaattgaaggggtgtacatgttttgccacatagtgggttagtaagctggttagacatagttgtcagggttacgggttaggtataccctttaccctttgatgtacgtcacatatcggtatggcatacccacgcgcatacggatactccccgcgtacactaaggaaatccttcacaaagtctacggaggggaagagttttactcggacaagactgggtcatcaatgtatcgtatagggtctgttatctccgagttctacttggaaaccgcctgacctgcgatataaaagggaccccccgaggaggacctggggcatcgaatctcagagccaacacaaccctcacagcctacgaagtcggagcctgcaaggagccaaatcgccgggatctagttgaaccaactcgaccacgatctcaccggatccgtcaagttccattattccctttgtaacctgtgttttccaccatataatcccatatcaactggattaaggctattacctatcaaggggcctgaaccagtataatcctcgtcttttgtttgcttgatgtcgtattacgtagatccttgtaccaacataccccaataccctctatatccggtctacgggtaccacccgtcgacagtggcgcgccaggtagggggacttggtactcaaggttctactactatgtcatccagcctcgtcgacaacagcgtcaacaccaacctcagccaagtattccctgcttcaacgatgctgatgtggactcaagtcggcgaaatcgtcttcccgatttacgccacgatgtcgatctcaaccggtccgccaatgaccggaaacgagaacgtagtggctacaaaccaaggcgactccatgtcaaaaaatccgcccgccgggacggagaacggagcatcgacgacatccgagctcgagaaggattctgatgcggccaaaccttgtcgttccgacatgaactgtgagccgacgaagatgacttccgaagcgacaaggtcctggtgtcctatccacaaaaccaggaaacacattttgcaagcctgctgggttttcctcaacgtccgcgctgaaattcgcgcctgcaaagagcgtggaattcagcttatttctccaactcgtgatgtctattgtcctattcacaagacaaagaatcacgacctctcaagctgcaaggtctttcttagcgccatgaaagcgccatcccctaaggtccaacagtcacacatccccatcagggataaagacaaggaacgaggagcgacgccaacttcagatcgatttgttggggtaatcgatattgattctcacgaaccatcagtcttgcaccttctcgaagactatggatcatcgacaacaagcgcgccgcgagaggtattggctatcgaggatgtcggcacatcagtgcgcaccaatgcagaagcggagaatcaattgaccactccagcccagcacatcagagccgtcaacgctatactgagggaaaccccctacgatcccgttctgaacgacgatctcgcgcgttggacagaacgactacgggaatcagtgaccaacctcagcaacgcgttcgaagaggccactgccgcagcacacccagagcagccaccaactcgcgatgccaatggtgaaaacctggaacggagggaatcgcctcagcgagctacccctccacctcgtggcactgacgatctccgagatcacatcaacggccgccgagagacacgacgcacacgagacaacgtgaatcgttcccgacgtcatgtctcttcacagcgccatgataacgaaaatcaaggagaccgctcaaacgaggaccgagaccatgataaccgccacaaccaccacgatcacaacgatcgcgaacgacaggtgccagacgataccggtcgaggacgtcgccataacgacgacaatgatggagaccggagccgagacaacagcgggagacgatgacaggattctcgagatccaggccgatatcctcgtaaccgtacgccggaaccaagtgacccatcgtcatcgtcatcatcctcgtcttcctcatcaccagacagacatccacgaaggacacacgatcgccgacaacccaccacccccagcgctgggtgtagggctttcagtcgttccctacgtgatgtccgatggcctgagagattccgacctggagcaatagaaaagtatgatgggagcaccgacccagaagagttccttcaagtctactccacagtactctacgctgccggagcagatgacaacacgctggcgaattatttgccaactgcgttaaaaggctctgcacgttcatggctgatgcatcttccgccctactcaatctcctcatgggcagacctgtggcaacagttcatcgccaacttccaaggaacctacgagcgccacgcgatcgaggacgacctacacgcgttgacacaggactcgggtgaatccttgagggaatatgtttggtgcttcaacgagtgcagaaatacaatccccaaaatcaccgacgcttctgtaattcgcgccttcaaatctggtgtcagagatcgctatactacctaggagttggcgacaagacgcatcacaactactcagagattgttcgaaattgttgagcgatgcgcccacgcagatgacgcgctaagacgcaagaatgataaaccgaaggccgggggagagaagaaaccagccacggacgcgtctgagtcaagcaagaagaaaaatcgcaaaaatgggaaaaggaaatctcaagcggaagttctcgcaacagaatacgcgaaccctcccaagcgtccagacccacagagcagcgacacaaagaaagcatggtaccccatacacaagacggacagacattctttggaagattgccttgttttcaaaaaatcgctcgagaagcacattgcatttgaaaaaggcaagcgagtacgcgtggtcgaaaaggacgaggaggcggttcctcatgaatcggattcagcatatccagactccgacctccacgtttcacacatcttcggaggttccacaacgtactcctcaaagcgagaatacaagaaagtgaaacgcgaagtctattcgacatggcagggggctgcacccaagatgaagtggtctgaacagaagatagagttctcggaacaagaccaccccaagaccgccgtcatcccaggacaatatccgatcgtggtcgaacccactattcggaacatcaaggtagcgcgagtcctcatcgacggtggcagctcaatcaatcttcttttcgccagcactttggacgcgatgggaattccgcaaagcgagttgacaccaaccgatcaacccttccatggaattactccccaatcctcgtccagaccattaggcaagattacgttgcccgtgactttcggccaagccaacaacttccgaacagagcagatcacctttgatgtcgctgaattcgatacagcttacaacgccatcatcgggagaactgcacttgcgaagtttatggccgcatcccactacgcgtatcaagtgctcaagatgtcgggaccgaagggaacaatcactgttcaagggaacgcaaagctggcggtacaatgcgacaaacggagcctcgacatggtcgagcaaacacccagcccacccgccacgacggagccacccaagaaagtgagcaagaaaaacaagacgccgaaaccggacggcgcaatcaagatcgttccactctccagtgccaaccccgacaagaccgtcaagatcagggcgacactaagcgagaaataggaactcgcgctcatcatcttcctccgcgataatgctgacgtgttcgcttggcagctgtccgacatgccaggggtccccagggaggtgattgagcacaaactcatggtacgacccgatgccaagccagtaaagcaaagactgcggagatttgcaccagaccgaaaacaagccatacgagaagagctcgacaaacttctcaaagctggcttcatcagagaagtacttcatccagagtagctagccaatccagtcatggtgcggaaggccaacggaaaatagagaatgtgcgtcaacttcaccgacctcaataaggcgtgccccaaggatcacttccctcttcctcgaatagatcaactggtggactcaacagccggctgtgagctgttgagctttctcgacgcttactctggctaccaccaaatcagcatggcaaaagaggatgaagagaagacagcattcatcacgccattcggagtattttgctatgtcaagatgccgttcggactaataaccgcagggaatactttccagcgcacggtccagggagcacttagcaaccagctcggcaacaatgtcgaggcctacgtcgacgatatcgttgtcaagaccaagacaagcgacccattgattgacgatctgcgggaaacgttcgacaacctccgacgatatcgtctcatgctcaatccagagaagtgcacgttcggagtaccgtcgggcaagctgcttggattcctcgtctctggcagaggaatagaagcaaatcccgagaagatcaaggcaatcgagaacatgaagtcgcccacaagactcaaggaaatacaaaagctaaccggatgcatggcagcactgagcaggttcgttgctaggatgggagaacgagggcaacctttctttgctctgctgaagaaacaagacaaatttgtatggacacaggaagccgaagaggcattcgttgcactcaagcgctacctatcaaacccccttgtacttgttgctccccaacctaatgaagaattattcctctatattgccgccatgccatattccgttagcaccatcattgttgtcgagagagagaaagtacaacgaccagtctactacgtcagcgaagctctccacgacgcaaagacaagatatccacagatccaaaagctactttacgcggtcatcatgacatcaaggaagctacgccactactttcaagcccacagagtcacagttgtctcctcctgtcctctcggtgaagtcgtgagaaacaaagacgttgtcggctgcattgtgaaatgggtagtcgagctgagccagtttgatgtccactttacgccacgaacagccatcaagtcccaggtactcgccgacttcgtagccgattggactatgcctgataacaaatcagacaaccaaatcgacaacgaaacgtggacaatggcgttcgatggtgcactcaacagccaaggagcaggggcaggatttatcttgacatctccctccggagaccaattcaagcacgcaatccacctcaacttcagggcgaccaataacacagccgaatacgagggactactcgccgggataagagctgcagctgtacttggggtcaagcgactaatcgtcaaaggggactccgagctagtcgcgaaccaggtgcataaagattataaatgctctaaccccgagttatccaagtatcttgcagaagtcaggaagctagagaaaaggttcgatgggatcaaagtccgacacgtctaccgcaaagacaacatcgagccagatgacctagcacgacgtgcgtccagacgagaaccgctcgagcccggcacttttttggacatcctgacgaagccatcagtgaaagaagttagcggcgaagttagcccggacacccccgacgttagctcggaggccacaaaggcagaacgcaccgttgccgatatcgagaccacagacgactgacacatcccactaatcaaattcatcaacagcaaggagctgcccgaggatgatacagaggccgagaaaataacccgtaaagcaaagatctactgtatggtcggcaacgatctatacaagaaagcgctaaacggggtacttctcaaatgcgtctcgtccgacgacggcagacacctcctcctagatatacatgaaggcatttgtgggtcacatgccgccggtcggacattggtcgagaaagcttttcgacaaggttttttctggccaaccgcccttaaagatgcatgcgacatggtccagcgatgtgaagcatgtcaattccatagtaaacacacaaagctacccgcgcaagcgctccagactatccctctgacttggccgttctcgtgctgggggctagatatactcgggccattcccacgaggacagggcggctacaggttcctattcgtggcgatcgacaagttcaccaaatggatcgaagtagtacccacggggaaaatcaaggccgacaacgccatcaaattcatcaaggggatattttgtagatacggactaccgcaccgcatcataaccgacaacggctcccagttcatcagcgtcgatttccaggattactgcattgggctgggagtcaagatatgcttcgcctcggtctctcaccctcaaagcaacggacaagtcgagagggcaaatggcatagtactacaagggatcaaaacccacgtctacgacaggctcatgtcacatgacaaaaaatgggttgaagaactcccatcagtactatgagccgtacgcaccacaccgacaacgtctaacaaggaaacaccattcttcctcgtgtacggctccaaggccatgctccctagtgagctacaacatcagagtacacgagtacagaagaactccgacgaggaccaggaggaacagcgaaacgtcgatctaaatctactcgaggaacatcgcgaacgagttgccgttcaagcagccggctatcaacaggccctccgccgttatcacgagaagcgcatccgagcacgcatactttcgatcggcgactacgtcctccgatgagttcaaagctaagcagggcgaaacaaactctcaccaaaatgggaaggaccttacacgatcacacaagtcttgcggccaggcgcattcaaaatcgcagaaggcgacggtcgcgaattagcaaattcttggaacattgaccaactacgtaaattctatgtatgagtcaatatcatccgtacctgtaagacaccttacagtatcaataaagcctattcttaggcccatattacaatcaaactgttttcacccgatgatcccttaccctaatgacacctagcgttgaaacctatcctcatgtccctttacgccgtcttaacaaggcctccgaggaacctaagggatcttcggctggggacgcccagagccaataaggccttgtcagatcctatagagacgaaagaccatgtaagatctggtcgtgtaagagttctcgccgtgcgtattaaccaagctgcgaaatcggaaattaactttccaacttcacggctgggggctaggatcagagcttattcaaccaaggcaggtcaaaggtccaagagccttatcctccgagaaaatttctccgacgacaaggctgggggctagggagagtgtacgactcaaacggctgactaaagtcgtcaactgagaacgcactcttacacacgacatccggagtaagaaagatttgttaaagatagatttcttttctatttcacaaaatacttcttacagtttttacacaaatccaaagctatattacacctttttcctgagatatctatcacagggtacgaagactaccaagaaggccaacgccagtccatagactggaagatcttctccgccaacggcgccatcgacctcgctagatggtctatctccgctggagtcctccgagaacgagcaaaaccctcacggagaaaatcgaggtccatgcgcgggcgatgatctcgtaggcaagccaacacgtgccctccggcatatcggctcgatcgacgacactcctgcttcaaggcctcgtcaatacgcttgccgatgccatcgagttgagcacaggcttcgttcagccatgagatgtatccggccgccgactcctcgggatctccacggggcactcgaagttctctacagaccctggccatggatgtgcagcaactcttcaagtacgagttgaaccacacctcacgacctcggagtgtttccacagcctgctctttcttcactgcaagcatggttctctcgagttccgctacttcaaattttgtcttccaatattagatacgacgatcttggccagcaagagcactctcgagatctgctcaatgtgagaacaactaagccaagctatacgcctctttcgagaacatagttgatctagtcgggagagcatcaagggatgaatggactactaacctaaggaagtcgtcgccatctccgtccctgtagcaagggtctggtccacattgtcgggcgacgcatgtggttcaaacgcgagaaccggaataatcgccggtgactcgggctgcccgcgctgctggacatcctcgtcatcaacatctctacaaaggacaaaagctctcaagatcaacatacaagagtaagccagaataataattgcacgcacaaaggcggttaagattcagttttacacagcatgtcttgggagtacaagaggtcctactcttcaaatagggggagaacggattcccccagatcaccgacttcttccatcacctctttacgtgtgttgctagccgccccctgatccaagatctcgcgcagatcgagttcgggatgcgatagctttacacacgcgaggacgtggcacgctccggtgtagatcccgttcgatgtttcctccccgatcttggccgcatgcttggaggggatctcccccatcgccgtcgccagttccgcaagagaagatgtcagcgagaactcgtcgggattcgctgggatagtagacttaatgccgcactccctggcgagctgatgcaggccagtgtatgtgacccgcaacgagccacggatttccaacaggttgttcccgagctccgacatgcggtcctcaagcccctgccgttgtcgctcgttgccggccaccaactccctcatcttcttgaggtcttcacgagcttccgccaactagcgtaccagccggtcagcacgctcgttcgccgacgccgcttccgacctcgcctccgcaatctcgcggccgatgccactagcaccggcctcgaggaggcgccccatctcgacctggagctcctcccaggtgaggacagcagccggtggaccacgaccagccgcgggaccgctgactgggccgcttggtgttgcctcgcgactcccgggcgcaagcacgacatccgtcgaggctacagcgggagacgcgccggaagtccctccggactcgtcttgcgccgccttcgcccatgccgccctatgagacaactatgtttcagaaaatgctcgaacaaaatcacggagacgtaagttcatccacttacttctcgccaattgtcacaagacgttgtcgtcgtggaggcggggaagacgtgtccgaggcctaaaaaacggtcgatgcgaagtaaggcgaaattcttttggctgtataatctgacgacaggatagcttaccgagggggttgatgccttgcgacgatgtctgctcacagagaacttcctcccctttgtcggaatattgccaccacttgtagtagcagcagcagcatcagacgcctccttggcgaccttctctttcagagacgccgccacctgatgatctgcgagcggcccgatgatgttagtcagaagaagagcctacgcttaatcaagtcacaatgtgatctcggaaggaaaacgcagaatgcctgtcgagtacacttacattgatggcggcatcacgttcagccgtccctttttcacaaagggaaacggggatggcactcgccgttgtcggaccactgatcatcacctggccaacacgacgttccacggcttcgctgttcagacctgtgaatcgagaaccaaatttcggtaaatcgagagaaacgcgaacatgagcatgtcaggataaatgcgagaaagataccccgaggagaaacccgggtcgcgtcctccggtccggaatagtcaaaggctggatgggcccgagcctggagcggctggatccgcctaccaacgaagtctgcagtgactttataccccgacaagcctcgtactcggagatcgtcgataatgtcgataaacgactggagagagggggtcaaagggggctttgcggtccaagacgaaatcttgagcctcgtactcggagatcgtcgataatgtcgataaacgactggagagagggggtcctagggggctttgcggtccaagacgaaatcttgtccagttattctttgggaacaacgaaggcagggtccgagtctttgatctgaaggtagaaccacctagtccaccatttgctgcgagaagaagggcactggaaggggatataacacgacttcaggctatcccgaagtcggaacccgatgcaaccagacaccctgttggactccatccaacgcagctcgtagtagaagcgaaagagatcaagaaagggctctaccccaatgtaggcctcacaaagatgagaaaagatgctaagaaaggcgatagaattgggtttcaaatggagaagagaaagaccatagaagttcaaaaccaagagaagaaattcagaaggcggagggagaaaaccgcagagaatatagtcttcgatcgcaaccatgtgacctaagacgggctggggattagtacctcctgcttccctttccatggttccgcgaccgggaagggcgccgtcttcctaaagcttcttcagtgacgcactggtggaggatgatttgctgagatccatctctgatcggagatcgccggagaaagagctcaggtcgatgtactagggtttcttgtgggagcggagaagacgaagagcgcttgcaggcgggatgttttttgcatggggggcgaacttcaaaatggatcctcaaaattcctttaaatagacgcactaccgacggtgcgaattccaaggaacagagagagatgcccgccggaaatttctgggtccgttacgcgcggcggttttttggacttcagtttaaattcgctcgtgaccgttgggcttcaaatggtgctctcgactacgttttgtctctacggtcctcgcaccgggaacgacaacagtctcgacgccagaagtcgcgaatggttacacgagctcattttaagcagaagtcgggggctactgtcagggttacggattaggtataccctttaccctttgatgtacgtcacatatcggtatggcatacccacgcgcatacggatactccccgcgtacactaaggaaatccttcacgaagtctacggaggggaagagttttactcggacaagactgggtcatcaatgtatcgtatagggtctattatctccgagttctacttggaaaccgcctgacctgcgatataaaagggaccccccagggaggacctggggcatcgaatctcagagccaacacaaccctcacagcctacgaagtcggagcctgcaaggagccaaatcgccgggatctagtcgaaccaactcaaccacaatctcaccggatccgtcaagttccattgttccccttgtaacctgtgttttccaccatataatcccatatcaactggattaaggctattacctatcaaggggcctgaaccagtataatcctcgtcttttgtttgcttgatgtcgtattacgtagatccttgtaccaacataccccaataccctctatatccggtctacgggtaccacccgttgacagtggcgcgccaggtagggggacttggtactcaaggttctactactatgtcatccagcctcgtcgacaacagcgtcaacaccaacctcaaccaagtattccctgcttcaacgatgctgatgtggactcaagtcggcgaaatcgtcttcccgatttacgccacgatgccgatctcaaccggtccgccaatatccggtttacgggtaccacccatcgacagtagtgagtgtaggttaattggttatgctctttgtgatggaacgagctcaccttgatttaagttatataatatagacttaataagggtactcgtatttacgactatttattctttcagtgattgatgacgtatccattaacaacaagacatttgtgatgcctttatcaatacgaagatacgtcactgagtcttccgaatacgctaataagggtaggatgtgcatttgtgtgttcgtaggcgtgaatgtgcacgtgttgtgagcgcttgtatactgacgataatacttctacgatatttttgaatactccatccgttctaaaatataagggattttggtcagatatgacacatattagtactacgaatttagatggggagcatgtccagaagtattaaaatatgatgtattctagtatcaaaatcgcatatatttttggatagagggagatgcagtttgtcatttaacggccggggcctcccctgctgtgttctcttaaagaaaaagaaaaaaaagatgctgtgttctcttaaagaaaaagaaaaaaagatgtagtttgtcacgtggaattgaatgaaattgaaatggttaagtcaaagttggcccgggatagacggcggcctgtcagtggtacgtacgtgttgatccaaacctgcaacgaaagggacacgcacatccgcaattatgcatggcgacggtgacgcgcggacgcacctaagcacgggctactactggtactagtaactagtgtaagctagaactaacgttaggctggccagccggaccagctaagctagttgctcacaccaaacagcaaagcaatccaccgcgacgcaaattctttgctttcgctctcgatcgggaagagaagggaaaaaaaaaaggagaagcttttgttgtcgagggtcatggccagttttgaccctgttcttctggtggcatccatcggcctctcaaaagccccaacgtgagtcgcacgatattgtcgtacctacggcggtgcttttggccttatatgattattatggacttttttctttaagaatttcgctctatttgagctaaaactgtcctctaataaattattaggagaccctctatcgcccctcctcttcattctagcgatcgacccacttcagcgcctacttgacaaagccaccgatctcggagcgataagcaaattgcgaggaagagctgtgcgcttccgcacatccatgtacgccgacgatgcggccatattcataaatccgaacaaggaaaacgtgagtgctttcgctgagttgctaggtcactatgggcaagcgtctggcttatgcacgaatctgcaaaagtcccatgtagcaccaattaggtgcgacgatttggacctcgacgacatcctacaaggcatgccagcaactagagtaaacctcccgatgaaatacctcggacttccgctgactactacaagactaaggaaagtagacttgcagccgctcttcgataaatcattgaattgcatagccggatggagaggaagacatgttggcctggtaggatgatctaccctagtgaaggtggtgcttacctcgcagcttgttttcctcctgacaggcctaaaagcgtcaaaagggtcactcgagatcctagataagcagcgaaggaaattcctgtggacggacgaagaaaccttgacatatgggaaatgcaaaatcaactggacacaaacacgtgtccctactgcttcgggtggattgggcatcctaaaccttgaaaagttcgcaagggccttgcgtctcagatggctatggtatgaatggaaggtatgaatggaagtcgccggataaagcatgggtaggatctggtacaccatgtgacgacactgacaagctcctctttgctacaacaacaaccataaaatttggagacggcgcaactactagcttctgggagtcggcctggtgggaagggagaaggttgaaagacgtggcgccactagtctacgcgcagcttcaaagaaaaagaacagatcgctccaacaagcattgcaatcaaatcagtggctactcgacgtgacccttccagcggatacaggatggacaacggaactgatcgaccaacttgttatgatatggagcgctacccagacagttgagttgtccgagcacgaggaggataaaataacatggaaactcaacagtcacggtgaatacacggcggcgtcggcatacaacgtacagcttctcagcacaacggccaccaacttcaacaccctaatttggaaaccttgggccccatgaaaatgtaaaaccttcgcctagctagtcattcagaacagagtttggacttcagacaggctagctactagggggtggccgaatggctccgtctgtcctctgtgtcgctaggcccaggaaatggccctccacctcttggcgaattgccgctacacaaggcgaatttggatggctatggcgaactaggtggcatgcagtaccttgcatcctaaccagtggcaacaagcttcgtcgatcttagaatggtgggaaataatcacaagcaccaaagaagcccccaagaaggccctccattcgttgacgcttttggtcgccggggaaatttggaatgaaagaaacagcagaaccttccagtaaaaggagctctcgtcgaatggcctgctaacaaaaataaaagaggaggccagagcatggatctcttagcaggagcaaaacatctggaaaattggcttataacttagttcgttaggacctttggtcatgtttttccttttatactgtacagtttactccttctctattcaatgaaattggcggctcgccgattcattaaaaaaatatttttaggtctctttcactcatgacatattttttatgatgtctaccaacaaattatacaaattttaactatcgtatagcaaaatttatcttttgaaatggagaaaggacatgtgaagctaaagggtttacatgtcaaccacatccaccacaaactttattacttcttttgaaaaaaggacaatacaaagcatatatacataaattaagagatgatgtataaaatataatgataataacatcataatgataaattttattaactaaaatcctgttacaatgcacagaaaaatgctagtttacataaaacaactcatacataaagttacatacatagtggataagcacgttaaatgctgtgattatatataagatgaaatatagaacatacatacatatggtataatataaggtaaaattttatataactgtctatgctttgccaaaactatgacaaaacgacacatatgttagacgctagtatatcgtaaaattacatatttataggtcaaatttacaacaaaactaagatcggaagtacgatgtcgaaatgctatgtacagatttagtgttatttgtcacaaagctatttacaattaaatcataactttcttaattttatagtagagaatatgttaaagtgatgcagatagagttaggctttccttagtttttcataattatttttattacttttctagtatcgtccgctacttaaaaaataatttccctagacaccactttttttccagcgtaaaaaaccgtatgtaaaaacctttgagggtgtcccatgaagacctgcatgcgaaaattaatgaagagcacaacagggtgcaacacttctgttataatttttcaatcctcccaccgaaccctatcactcccctattcctctctatcctctgccctctttcacgtcctctcccctatcacctctcctccctctatctcatccctactcgacgggagcatggctggcaatagcaccagcgacgatgggagaggcagtggaggcttcgtcgcggctcacgtctagtggatccggtgacggtaccctcatgcaggtacgggagaagcgcgccgggggggagggtggggggggtggtgaggcggcctcacgaagagctgggcacagtggcctggcctcaggagcgcgggggtggtggtggaactccggcgacgacgccagctcgggacgggcagattcgctgctgccagtctctggaactgtggggcctcggtgacggcgatgatgataggggattgcggcgacggcggtaggttggagctagggtttcaattttcggaattattattttctcccgttggacgtccacatatatataacatgagcattaaactaattaaggaaatctagtagctagtcgtggcgtgcccacaaaaaaaatgcgactgatcggtactcctatgattaattgattgaggcagagagacctaattcctagttgatcttatgttagaaaaatgacacatgcatgctgctgctgctgctgctgctgctgcagggggagtataatctttgcttgttcatcacgtgtgcgattctcgtcattattcaagggcagttattaataacgctataatccagctgtccggaaaccccaaccgcgcggaagcagacgctgcaacgattcttctcttgcacgcacgcgcgggcaaatcacctttcgtaaatatcacagttcacagttataacgggtttctcaaaaaaaaaaacagttataacggtactaagcttgtaacttaaaaaaaaagatgatttgtgactactccctcctccgtctaaaatttacggatttgatacgggctaggattacgaatttagatatgggacctatctatatttgtaacggtagtttgtgtcaaacccgatattaaattgttatatttttggaaaaagggagtagtagtggaaccataaattacttaaatcctaggctaagttgtggtttaattaatgggttattgattttcttcaaaatttatatgatgatttaattagttttaaatttgatttgggagcaagagctcaagccataactacactagatatgtctccgctctatttgcaactacgtactactccttagtaattgcggcaaaacaagtcattagtttatcaaagagctgagcttttgaatatcaagttttatgaatcggaggacaatgatctgaagcaccactaagaatttttcatttttgttttaatcccaaacatacttgttatgcaaactactactaggatgaaacatgttcaaagcaattccaatttgaaatatatctttcgacaaatagtataattaattctaaatagaccataaaagtaaatgttgaatgcacttattaatgtaaaagaaatgagtgatttcacagtcttgatgatataccggagggaccatattttctaatataaaactggaggagtacttctcacacctccggtactagaacgtattctcaaaagaaatcatattttgttgcctcaaatagacacgaggaagaagactccattttttggcgaggtaaagtgattatcaccagtgcttaatcacgatgtaccaaaaggaaaaacggcaacctaattaaacattaggaaaaaattatataagtgaaatttcctggtgaattagacagtgagtcgctctgcctagctggtgaaatttctcatcatcttattctgattaattacgagatcgatcaaatttggcaccatagtcaggattacttcacgagatcgaccttaatgtttctttaaacaatgaaacatacatcgtttacgtcagaaacaagtcaaccatcgatgttgacaccaagttagttagtggtaggtgttcagtcagtcaaagtatgcttaagtgaaggacagtccgaaacacccctgctgcatgcaaaaagtagcactaactaacaacctaacgcattatattttcgctgaaaaaatatgctgaatgatgagcttcctttacaagttttcttcttttctccgggaggaagtatcgtcgatcgatctccccaagtatcctcttctatgtaaaccctcgattgcgtcaaaccgctgggatagataattaaactgttaaacccctaaaacaaagggttctttaagaaaatttggaggaattcgaccatccgaatttttttctacatgatcaggaatagctatccaaaaatgctatgaaattcttttggaatggctcagaaaatttagaggaattttgacatgagattcaacctttgggataaaaaaatattttcctgaaccctatccaatggtcattactgcagttttcatgtatttttttattcataggatttgaagtactagtgcactctaattctgtattttatttatattttttttctaagtaaagatcgtgccaaacttatttgagtacttagagaccgatgggactagatagctagcttacaattccaattatattttttctccacaaatgaaaaaagagaaaggcccagggtcttctcagctagcaacgcaagctgcgagctagtcggttcgggttcgagcctcaccccctccttaattcaaaatcaatctagtcctttctagattggtcccattttcaggtttcaaaaaaacaaatgaaaaaagaaaagactcttgtctacagttggtgcttaaaatttttagataattatagtaggtgcttaataattaattaattttcataaggtatactagtgtacgtaactatttctggtcagatgatctcaaagactgatcatatcagattgtgtttttctacaagttgacaactccgattactttttaattattattaagaacccaacccactgggttgtagcaggtgaacaacaatattgttaggtactttaacctaatttgtatacaataaagattttcctttttttcctgatgacgaagcttggtccgattaatcatgatcgtgatagtagcgcaacttcaaaacatatataatatacaagaatatatatatatatatatatatatatatatatatatatatatatataaccagtctgttcgagacaggctccaacaaatggatgaataaaattttgagaaacacacacatattaccaacacaaaggtagttcgctaatatatccttttccccaactttagtttgttggatgtttaattatcggggagaaatttgttgagatgtatggtacttaattgacctttgaattttgatgagagtttggaggatcgatcatgtggcgcaaagcgtttggtagtgacagtgtgcaacagcacctgttggctagctatagggctgctaattttccagcatccaccttccaagccaattgatcggccctctatttcctttacaataattgtgtcatgttcttttatgtcataagttaaacaactattaataacaagattcatggtaggaggcacggcagatacgttattgcagctaccacgaggctaggttaggtacttaggtatgattaataaatagtgaaaaccgtgttagttcctttaactatttgttcagaggacctgatcctttaaattaattttttgtttgcttattttaccttgtgaagtactaccctctaacttagcaatttagcatgagacaatgcctcactttaccttctaaatttcctgtcttctctcttcatacaagtatgcattttaattaagttggaatgattttattttaacattattgcttggctacttgttaccatttaaattgcaggcaattttgaattttagaactcattttcggagtttttttagggggtttattatattttctgcttttctgaattgcttttaatttggaccatttagaatcagagtataaagtactacttaagattatttttagtttcttagatcacttgtttggcttataagccacaaataaaaggattaccaagaaaacgcataagacttattaaaatatatagatatatttaatattttttgcaaattgtcatgaaaagttttgaaaatattttgtaaagaaattttttatttgtgctctaacgttgattgatttcctcatttaccattgcaaaattggcgctctctctctctcgctaattacccccattctcaacttttatcctttatatgcctattccgttagttttacctagcgttagtaggtgttaacagtgaaatttggtaaactccgaagtcatcatcggcatagagtcaatatcggcttcaaagtcctggaatcaaccgatgggaattatcaagtcgctaatagtcagattcttactgtattcggataaggaaattaatttactaaaggaagtttatccataagagaccgagttcaagaaggatgcgacatgtcagtttatctattaattaggaatagtctgttagtttccttttatctttaggaaactgtgttgagtgtccgataagaacttaaagtttctttcttgtccaacaaggattagtatctatccatgggtataaatatgtatatccggggtcattgtaaattatctcacagatcaatacaactattctcggcccatcgccaccctctttactgaggtttttacttatcatccggtggaacttggcacctgacgcggggttgcatcggctttcgatctccagcgaaggggtaagccctacgttccgctggccctgacaatcgtatcggctacgttggtgttgtctaacgctacctcttggatcgctctggtttggttggtatgtttgtctacctacttatcatatatcttagttaatctagtcttagtatctcaatttagccatattggttgattctcgcttgagggtttatgtcggtatcggctaaatcgttttactagattaaattatctaaggtatccaccaccctgaaaactagtcaaaagcttaattgtttagactttatgcttctttgcatactttgcgatgcatcatccatagtcgtgcttaaaatcataaaagctaacctgtctttgattataataagggtttgattggggtttcaaccgatgagttatatggacgttgcatcggcttataaggattgtatgcatgtcggatttagccgattacaccaaaggtttcattgtttatctaatctttaatgacatcggaccaccagccgatgtatgctttaaccttcggaacaatgcttattctatcatatcattgttaactgattggtttctacttgattaaattgttttcttattacattaccattagttgattgtctttatattgttatttacatcaagtgtcagattctacatcaaccatatagccgataattcaaaatcctattgctatcggctgccatcaattggtattactccattggcttggcagccgatcaacttattgatctactatttacatatgtcagtagcaggatcaaactgactagcacgcctgtatctcatcaatattttagacatgcgcggaagctaagcagatcttctaggtcgttgtgttcgtcgataacacagtttcggcaccatcggccgagcgcggatttttcgtcaacagtaggcaagtgaaaaggcaattttgcccttacatttattttatgcacgacagttttattaattatttttgcagggacaatttttatagcaaccttattatggactggtagtggaatctctcatgaatctatgagctattttagtcaggaacctggagttattttagtaatgaagttattatgcatttagtatattacatgaaattaattgacattggttgctcgttgtcttatagccacaactaaaacataaacttttttaacttaatttagagttgatttgggggttttaatattattttcagacttatctttgtaattggaatagaattatagaagtataaaagccttgccctgaaattatttttggtttgttcatttgatgcatcttaacttttattgtgaaaactttaatcaacaaactttgttggtacattaattaaaacgataggcttagcataattatccttttacctatgtacttttctgctgaatagctgaatggatgaatgatttgtgataattattggagggtacaaacaaattaattaaatattattttaaagttcaaaaatggatctaaacatttttataacaaattctatcgacgtttgagatcacgactatggtatttgcatagtatggagatcgttggtatcagggtatatgcgagattgaggtaaaagagtcagagacaagaatttttatgcaggttcggtccccttatctgacagataaaagccctactcctgttgaccgaagctagtgttgctctatattcatcataatcacacaagtacaatatttgggataacctatctagccgtcgtcgacatgacagcacgaacaccaacacgtagtcgacaatggggtagtactcttcctcctctaatatgaactcgtcgagatcagagatggcgctagatccctcttgtcggcctccgcagacaccaaattaagtctgtctaggctaatctctcatgtcgatgtctggcggcatattggtttgttctagcttgcgtgtctgtcgtcccctctcgtcatagggggttttgtatttatacccatagatgtccccttgtacaagtagaactagggagacaagtatggatacgatccgagtagtcattgtcgtttccatatagaactctactttctttccttatccgaaactccttctatatacgaggtacaattccgtttaagacttggtatatggtgggcccaccagcttagtcgattactattgggtatgcggtatccataaccatgacaaattcatatatagaattttattttgcacaaattgcactgctaaggagcatgagataggggtgaaaatggtacggaaacttttctgaattctagacctattttcgaaaacggaatctgtcagtcaagatttttttgaattttttggaaacggaaacgaattcagaaaaaaaaattctcgaaaacagaatctaatatgataagggcagttttcgtcgaaactcggaatcggttggaaactttccagaaattttctcggaatttctagaaattttgtgattgaaatacctattgacgagaaatctgcacttggccaacgatgccaagtctgtgttggtgcgaattaacttgacgaacacaacagcctgggagatctgcttagctccagtgcaggtccaaaggttgataagatgcgggcgtgccagtcaatttgatcctgcaactgataagatatacaaatagcagatcaatgggccgatcggctgataagccaatagagtaattccagccgatgacgatagggttttgatcaatcgactatatggttggtgtagaatctaacacttgatgtaaataaagtcaatcggctgatgataatgtaacaggacaacaatataattcagtagaaacaaatcggctaacaatgatatgatagaacaagtattcatccgaaggttaaagcatacatcggttggaggttcgatgtcataaaatccacaagattagataaatagtaaaacctttgttgtcatcagctaaatccaacttatatgctatccttgtatgctgatacaacgtctggatacctcatcggtggaaaacccgatgaaacccttattggcaatcaagaagcaggctaggaattatggttctaagcacgacttagtagatcaaactcaactgatgcagcactaagtatgaaaagaaaatatatatctagacaatcaagcccttgaccgatttttagggtggcaaatatcttagctaatctaatatggcaaagcaatttagtcgatactggcataaaccctaagcgaatctcagccgatataagtaaatcgagctaccaaactagattaactaagatatatgataaattaggtaggcaaatatatcaaccgaatcagagcaatccaagagatcaaagcgatgcagccttgaacaacaccaatgtagccggttgttaacgaaaaatccgcgctcggccgatggtgccggaactgtgttggcgcaaactaagtgaactattacaatggcctgagagatctgcttagctccagtgtaggtccaaaggttgatgagatgcaggcatgccagtcaatttgatcttgtaattgacaagatatacaaatagcagatcaatgagccgatcgattgacaggccgatgtagtaattctagccgatgtcgataccaactgatagcgataaggttttgagctatcaactatatgtttgatgtagaatctgacacttgatgtaaaaagacaatcggctcatgatgataaataacaataatataatccagtagaaaccaataagctaataatgacataatagaataagtattagtccgaaggttaaagcatacatcggctagaggtccgatgtcataaaatccacaatattagatcaacagtaaaacctttgttgtgatcagctaaatccaacttgtaagcaatcctcgtaagctgatacaacgtccagataactcatcggctgaaaccctgatgaaacccttattggcaatcaagaagcaggctagagattatggttctaagcacaacttagtagatcaaacttaactgatgcagcactaagtatgaaaataaacataatatctagacaatcaagcctttgattgattttcagggtggtagataccttagctaatctaatctagtaaagtgatttaaccgataccggtataaaccctaaagcgagaatcagctgatatggttaaatcgagatactaagactagattaactaagataaatgataaataggtgcttacattgacaagattagagtgtcaaagccctagccccgccgatgcaaacagccatgacaagtataaattcgtcgaaaaagtataaaagtaaaacaggtggcgatcgccgaattgtaatgatcgtagagatagtttactgatgaccctaggtgtacatatttatacccgtggatagatactagtccttgttggacaagaaaaaaactttcctaaagacaaaaggaaaacataaaatcattatcgaacacttaaacacactttcctaaagacaaaaggaaactaacaaactcttcctaattaatagataacttgccatgccgcattctccttgaactcggtcacatctggataagcttcctttaatatattaattttcttaaccgaatcctccaagaatccgactgctggcgacttgataattcccatcggctgatttaaggactctgaagctgatattaattttaggccgatgacgtcttcggggcttaccaaatttcactgttaacaccggtacaattgcctaggccagcggaacgtaggacttaccccttcgctggagatcgaaagccgctgcagccccgcgtcaggtgccaagttccaccggatgataaataaaaacatcggtaaagagggtggcgatgcaccgggagtagttatattgatctgtaagatagtttacaatacccccgggtgtacatatttatactcatgagtagatgctagtcattgttggacaagaaagaaactttcctaaagataaaaggaaaacataaagtccttatcggacactaaacacactttcctaaagataaaaggaaactaacatactattcctaattaatagataaactgtcatgccgcatcctccttgaactcggtctcttctggataaactttctttagtagattaatttccttaaccgaatctactaagaatccgactattggcgactttataattcccatcggccgattccaaaagtctaaagccgatactaactctaagacaaatagatgactttggggcttaccaaatttcactgttaacaataccctagacattttttaaacactaaacaatgaataccatggtgtttggctgttattttttctagaatatttgttatgcaaatctgaagttacataagaatatatctttttcctgcattgggatttatcaacaacattactctcttcaaggtagataatttattcatagattgtgttttgtgatgtaccgttgagacttaacaattagaattatatgattatgttttatgatgaattgtttaccgttgagacttaagaattggatttatcagtttgaggggtttttgtattccgttaaattttcattaccatacccgcgccggttcgttttcgctccattttcggtttcaataatattgattccattttcgtatatggggtttctaattccgaaaaaattatgaaaacgaaaacaataaatgtggttttcgtccgttttcatccctagcttgagaaacgtgcgtatttatccaccattatgttccatgaaaaaaaaacacgtcttaaaggattaaatttgacaataaagaattttctttagaaagtatggctttgtatagttagagcaatcaaccaaatagtttataaaaagaactatatatcaaataagcgaagttcatcctggcacgcttagcctacattctgaacatgaccaaggtgctcttcctttacctctctttggcacctgagaacacaatgcattgtggtttgatttagagcattctcatatggtagaagacatatcatctatgtttgtttcatttgttgattttcctttgtttctttgtgagttggtttaagcagtaacatggtagtgtcacatgcaagatactttttgaaaccgacatgcaagatactctctcacacagactacttcctccgatacaagggattttggagggttgtgacatatcttataactacaaatctggacaattatcttttcaaaatcgcttatattgtgagatagttgtagtatttgcttgctatgcatgtcatccaaaatcctagtactccctccgtacatgtaaaggaaatcgttttggacagcgacacggtctctaaaacacaattttgacttcttgtttctataaaaatatttattgaaaagtgatatatgtatacttttatgaaagtatttttcaagacaaatctattcatatactttttacattttcaaactcaacaacttgagagttattcatgatttatatttccaaggtttgacttaaacattgtcctaaataacttcctttatgagtatggagggagtacatgacaagaatatttttattaactacaataggtacactcttgtttgggagttgcacagcttaattaagataatccaaattcagtattgggagctctaatagctataacacgatgctaggtgttgcattactcaatatggcattatgcct

SEQ ID NO: 13883 - DNA, 13788 bp, Oryza sativa
ctcataataaaatgaattataattacgtaaatttttttgaataagacgaatggtcaaacatgtgagaaaaagtcaacggcgtcatttattaaaaaacgaaggtagtataacggaggtagtataagtttgtacacttgagctaaactatggtagtatattgatactagtaacatccccatacgtttctaaagggcgagaactatataattagaaatgtgttaggagagcgattgaggataaaatattagattcggtggttacttgataatgactgttttgaaggtagtaaccgaaaagagaaatagagcagcggtagttgcagcccgcatcgtttggcatattaagtaaataagccaaacgacatatttgcaaatgaaaaataatctgtgaaaaaaacttttatatacatgaataataaactttgatgaaaaaaaacccctcaaaatcaactctaaatttaaagttgaaactttaaaatttggctgatatgcataagcataagtgaaaagatcagaaaagctagttggcacgagcgcgccagcaacgctgctggcgcgcgtgccacctggcgacgctcccaccccatgtgaggcgttttttctgttttttttttcgatttttttctttttctttttctcttttttcagattttttttttaatttcagcacatgtgtgttaacgaccaaatttggtaattcaagtatcaaagatggaggtaaaaccaaagcagaatccaagatagagatcgttccggaaatagagcaagaatcggttaaagtccgaatcggctgcaaccagaatcagcagagtttgagtcggacaaggttagccgattgagccgattccgacaatgtgacttggtacatgttgtcgggttgagttaatgtgcttcatatggattgccacgcacatattaagtcctgaaaaggcaattgtatctattagttaggatattttatataatttccttatagataagtttgggcaaaagtctgccgcaaagacttatggtatcttagagtttgttagagataagagtcgtgtccgataaggacatattttgtatctcaggtataaatatgacccgaacccatgtaatcaaacaatacacgttcaatacaatctcggcgcatcgccaccattttactttcgtttactttcgacgagttcttgctttcgggttaagctgcatcggtttcgatcttcaactagaggtaaaacttgttatggcggcttgcgttctcgggattagtgcttccatctttatgatactttaatcttgtttatgtaattcgtcgagttatcatatatcttatataatctttgacaatattgttatttaaccttcaattggccaacatctattattggaaggtagccgattaggttaaatatcaatgttgacttagattatataggatatccaccaccctatgaaacattcaaaggcttgattatctagatattgcccttcttttcatacttatagctgcatcagttaggtttgatcttataagtcgtgattagaatctcaatctctagcctgctttttggttgccgattagggtagtatcggggtttcagccgatcttacctgatttaactcttttatatcttatatgcttttattgacatgttaaatctgccctttatgttaagatcttgtcgcatttaggtatattaagcttcctgtttgatatattttgcttactttaatatcttaatatagagtggtatcggagtattagatgatacatgctagatctatctgatcggcaatgctatgaatgcttataatctctttgttaatatatatttcgatccaagtgatttatactgtctcggcatggtgactgatctatcccaattacttgatttaagtatatatcgacagaagcattatataccattaatatctacagccgatcgaatagatttagttctttcttacctgtttatgactgccgatcgattcaaatatgacatcggctcaaagataaatgatatgtcattggcgactggccgatctgctatcgtttatagatttaaccgctattttcttgtctttgttccttgttgattgcagaatcaaatcaactggcacgctcacgaacctaaaggcaagatttttggacctgcactgaagttaagcagatcatccaggcctcgtgtttttcgcatcaacaatgtgttttcaaatattttgtgttaaatgtttttaaaccatgacatgaaaattttcaaattttaacttaaaatcaaatcttgagtagaaagttttcaaatccgagtagaaagttttcaaatcttgagttgaaagttttcaaagttgagttgaaagtttttcaaatttgagatgaaaagttgaaagttttgaaaatttgagttaaaaaaattaaattttgagttgaaagttttcaaatctgagtttaaaattttgaaactatgacttcatatgtagatttctttttaatttgttagttaaaaaatctcacaaaaaaataaaatcttatctactaccgtcattatcctaaactgttattatctaatagattagtataactactgaggccgaaaaaacgagcgccggcggcgcgtacacgccagctagcgatgccctgaaaagattgggactgtgcgatttgtcctagggtagggccccctgctggaatcctggaaaaacatcgatcttcttctggactactggggggtttacgtgagggaatctctccaaaaacctggaaaaacgcctagctctaagcaaggcctgaaattagtgatttaggtgtgtctgtgctctaaagttggtgcaaaggggtgctctaaggcctctcacagtgcggtgagctggaccagtgctacaccatgccagctgggattttcgcgtgcatggcagatggatgcgcggcctagctgagctcttcgcccccaagcagagccgcgcagaacctggtccaaacgaggcccataactcctagcgaaatttcgattcgccctccaaaatcctctcccgccgcacctatttcctttttcccaccaccgaaacaccctaagcaagaactcccaagcaagaactcgatccatcccaagaacacaagaggaatcaccaagaagcaaaaaaaacaaagaaatctcgatccatcccaagaacacgaggaatccaggccccagatctcatattaaccaatgaacaacacatctcacatgcacaaaaacaacaatcaataaccggagttggagccaatccatcatcagatcaagccgccgcgccaaccgctcccgccggggacgtctcccgctgccaggccagccaccgccaccgcccgggccggcaaccgcggctgccggcgccgaagggaggagatccgacgctggccaccggggacgccgcccgcttccatccttctcccgcgcccacttcctcctcaccgtgccagtcgctcccgctggggacgtcttctgccgccgggccagccaccgccaccgccaccgcgcgagtcggcaaccacggctgtcggcgccagagggaggagatccggcgccggccaccggggacgccgcccgcttccgcccttctcccgggcccgcttcctcctcgccgcgccagccaccaccgccgaggacgcctcccgccggcgcgccagccaccgccgccggggacaccttctcgccgcggcttcccgtcggcgtcgcatcgagggagaaggtggagtggcggagtagtactcgactcgaggatggagaggagaagtagtactcgatgccatcgaggagaggaggtgagggctggaacgaaaagccgaggaaataaattttcgtggggtccaccggcttgggcgctagggtcatgccccactgtgggcttggtaccctgacttgggtgcctccatccaattaatcttgacaactatgggtgcttgcactattgggtgggtgtctttgggccaagttttgaggctaggggtatgggccccatagcatgcactgtgaataccctaatggtgtgtttggataatgggaaatggggagtgggattgggattgggaaataaataaagagttaggattaaatggaaaagggagaatgaatagttaggatttaagggctcgttcggttcataagattttcaaaacgtaggaataggaaaaacgtagaaatactacaggaatacatgtgcaaacctatggattgaaaaatacaggaatttttcctatgttgttgagcaagctaaccaaatgaatacaaacattaggttggagtggattatttttttcctatgcttttccttcgaaaatagaggaatggaaaactttcctacagttttcctatggtgcattcctatgaaatgaatggtagtttaaaatccattcctatttctatgcttttcttttgtaattcctttaaaacgaataaggcctaaaaatgagtgggaaattatttccctttcccatttaccaaacattgactaaaagttgattctctccaaaatctgccgagaatgaatgcatatcatccatccgcgtatatcccggccgctccaaagcagggaaacagtcccgtacatccgggcggagatcacgtacgtacgtacgtagctgcacgcgcgacacgaccaatccagaccacgattcatccgcccgctgcgtaggacaagttaaatgggggtagtggtggtggtggtgggcaccacccgctcttacttctcgttaagtctgggcgttggattgggaccccctgtgccctgtgccgctgtgtgcgagcgctagacgggtgaacccattgaatgaaccggagtgaggcgcgtcttagagcatccgtaatagtaaagtaaggtgctatttataaaacatgtacgtctcagcaatagactagattaatagtaaaccacttcaatggtatgtctacatgggtatctatatttctctaatccatcgtctcgtttttctctatagattatctccatgttagtagatagctctgctttctctcttcatttaatctctccaagtagaaaaatatgctgacatggatctcttgtagagagtttatagataaccattgtgggtgcccttaccgttaccggcagtaggatgaaaacggtcggaataatcagtaatgccaagttcaaaaacgatgctcggttaatcggtaatggattatatttatcaatttaactacttaccccttcatattaatatgatgcttaaaaaaattgaaaaatcaggatatgtatatatttctgaaaacaagagaggttagaaatagtaccacttctacgaaaacagcgatcggtcaggaatttctgcgacaattttcatccctaacgtcagtgtacaataatactaaggactcggtaacttcatcagggttaaacgaaaattaaaattgtagtaagtttgttttagaaaagtagtaggttttgttcagttttctcacaattcaccgcggttatcataagattatattaccacggttaccgagcttactgcaagataggatataatgctagcacgggaaaagtataaggtgaaaaccatatatgtagtggaaatctataaactataattggattaaaaaaatggatgtatgcgtgatcaatagttaaaattttactcccggtaaatgttttactcatgattgaatctgcgagtaaaatttttactcacggtgacaggaacaaatgttagacgttcattttttttaattttacaatagtttctagattttcaatatattttctcccctaacaccatccgtggtaattggcattgaaaaacctttaggcatgtgcccgttttctctccggcgcggcgcggggcaggcgagagaggctgagagcatagcggtgcagcatacttagagcaaggctaataatacagccgacctgttggctataaggtttttttagccttctctcagcctacccatataatagttagctctttacagttaatacagggcccactctcacggagttttttagttcttgtgtccaagccggctataaacttacagcccgtttctcctctcttctctcctccacctcagtatttagcctgctattaggtaggtgtcgcattcatcattccgagagaggactccgtttttagtggatttggccgttctggcagctggctgcacgcgccacacggctgcagcgtacataaaaaggtttctgcccaattaaaatccatcgatgtgtgaggcgctggaatcgatcgtatcatgtccctacccccagtgcgccactgtgccaggcaaggcatgcatacttgcatagtagctgtactagtataacagtataggaccatgagatgaggccatggccactggaatcaacaaggaaccggcactacgaaagttgaagggttttcaaaggaaacaaacaatgcgatcctggggccagaccgacccgcggacccgggtggtgctggtgctgctgcatcaacttgtcccacgtattggatcgtcgccgacaggtacgctagacaagagggacggccgaggtattacttcttccgttttatcctacatatacttatatagttcgtctttagttgttgctatttctctcttctcttattaaaccacatcattccaattatttttagccattggataatagatctatggtttaaattgtctattctttattctctcataacataatgcaatctcaattatttatatgctcaaaatcataagtatcaatttgttttagttttaattatcatattgcatcatatttgtacgtattatataacttaattttccacagcaacgcggcagggtgtttatccagtattatacgatgatgatgtattattcatcttattgaaattattaacaaataaaatgggttatacaacatcgtaaacacgttctactatttgaacggattatgttaaataatagaacgaatgacaatcctaatatttgaatagctacatatacaaagatatgctaatacaggaaaatgagcctccatatattgggatgcccctcatacaatgcgagcagacaagcgcaaccacaaagttgatcgtctctgtcacgcgtaaaaacatatgaacgagtatcgtctaccgtctttggtttttttattaaaattagttttgactcaaaagtaaatttagtcttgtgaggaatggcacaacagtcgccaaaaacgaattacgaatgggacttataatttatccatattttctttgagtttcacaaaaattattgttctattatgtatacacactggtgtagaaaccatctttggtcggtcgaccaaattttataatagtcccagttccattaaaaaccggaactaaaaatgatttttagttccggttaaaaaaattttgatcaggactaaagataatctttagtcgaggcatgtcaaggggccgaggatctttagtcctggttagtagtaccaaccgggagtaaagatcatttagatatttagtcacggttgttaataccaaccgggactaaaaatctatatttagtcctgattggagttataaaccgggagtaatatttctctcccatatctaatcggttaagtccagatatttagataagattggatccctctcttctcagatccaatccccttactcctcccctctcctctcctcctcccccggttggtggtaccaaacgggactaaagatagcgatcccggttggaaaactgggactacaaaggttctaaaccgggagtaaagaacatttctctaccagtgacattatgttaaaaaaataaagcctacaaagtttcttttttgaaatttgaactaaaaaattttaccaaaaatatattttcataatttagtacaaacactcattaatatttttttaaagaatatattgtcagcaaaaaaattttatatgcctgttcgtagcggattaaatgctaatggtgaaaatgaaattatgatcaaaacaaaaattaactctaaacttaagttttaaatttagatcttaactacatctagtaagctaaaaagctaaagagtaaacgacagaactactatgattcatgcagttaaacccatttagggtcttttttttctgcaactttaaactacaactttctcgttcttggttaacatgatttttaaattgttaaatgttgcatttgtttaaaatttatataaaagtttattttaaaaaaataaatttattttctaaatttatgcaataattaatattcaatcaatcatgtgttaatgattcatctcattttgtgtaccaatagaagcgaagttagaactaaatgaagaagaatgtcactcgtttgctcttctctagtttaaacttaacccgattcgagtgtatgaacttagacaaaagttaataaactatagctaaaatatttggtagaccgagttcctggacatccatcttctacgtagctcggcctctacgtgccaaaaaactaacctctaacttaaaggatcaaaatcagccttacaacccgctctattattgtacggattgctaaccgctgtgcaaacaagcaagcaaagcttagctttacccaggccctacctccctctgacggtgtgggcccacctgtcacaccacgtacgaacggcgaccgtgtgtccggtcgccggctcgccgctgatggtgtggacggctcagcgatatggcgccgtccgcccaccgcgctatcatctttgcccattttttttgtgctggtgtgcaagcaacgctaaagctaagcttaagtccaaactaaatcattgtcattagcgactcacaaacgaccacgcgatgatgatgatgacaataacgatgattccaagaatacgtgatatacgcccttataattagttagcttgtctcgggacattaggcatcttcttgcttgcatttttttttttttgcatatatatgctcccaaaatgccacgagctaggtagttaggcagttagttactactgtgtagtacttatagtgtactatatcatgattcttcaagtatcatcaatataattgatcatgttagaggtagagcatatacggcctctgttttaattttgctgtgtccgtgttcatgtagatgtagtattaaacctagctagggacacaaaaagaaaacactaattaatcatgcatactgagattcttccttgtgaatccatgcatttgaagcctccaactgtaagattaatttgtccgtatccatagatattactacctccatcccagaatatttgacgccgttgacttttttaaaaatgtttgaccgttcgtcttattcaaaaaatttaaataattgttaattctttttctatcatttgatttattgttaaatatacttttatgtatacatatagttttacacatatcacaaaagtttttgaataaaacgaacggtcaaacatgtttaaaaaagtcaacggtgtcaaacatttaaggaaggagggagtatatccatatatatgaggattgagttgtactgggtactcttacgaaattatttctgtgtttaaaggagtactctggattggggacattttcctattccgtgttagatggtaaatgatatttcctcttatatgatgttggctaggtaaaaatgaacaaaccaacatcaaacaaataaaaccaaaggaagcatataaactgaaagaagaaggtttaatccaaatgtcgcctatacctgtggatttcgtggtcaagctctttggctatttggattgaaaaaaattcataggatttttggaggtttaagatatttgggaaaaatttcctatgacatcctttccgacaaaggaaaaggattgctaaaacgcatatttgagaaaccgaaaatgctctagttaacaagcgaccaacgtgaggcgatattatcaggcgttgctgaccacttcatttctcatcccccctctctcccttcttctctctttgctctctctctctctctctctatggcttgctctctctctctctattgcgcatccgcatctggcactcgcatccggcaccgccgccgcccgtcttcctctcctcccttttgtgtcattgccccatcaccgtatccggcgctgccgcccgtcatcctctcctccctccatgttgttgcctcgtcgcctgaagcttgggagcttgagagcttgggagctgcggacgacggcgaccgagctccgtgcggcatcgacaacagcggatatgcggacatggctgagctctgtgatgtcgacaaaagtggccgagctccgcggcgtcgacgacggtggctctgtggatgcggtggagctcggcgcgacgtcgacgcggatgtggttgcaaaaccggagtggaggaagatgtagatctaggttttcatcttgaattttgtgacatttcagtccatgtaccatgatgtttcatcagttagattagaaatgttacggtgggtattcgatggtgtttcattctatttcttgatgtatttggatttgtttcatgtttcgatacattcgaaaccgttgtttcacatgttgtagtaaaatgtttcattgtgtgatttgattgtgtttcactatattcagaactgaaacatttttatgtaaggtgtttcaatttttgtctttgattctttgtggatttgttaatatttcagtaattgaactttgatgtttcatgtttcagaacaaattgttttagtccatgattcaaccgtgtttcatcatttgaatttatctgaaacgtacaagtgttaagctagtggtgaaacatttttcttacacgtattgaaacattgcccaatttttacaacaaaaatcgggcgcccaatttataggtgcttcgtttagaaacacatgaaaaattaaagacatagttgaaatgccatgtacaaataaatcccatgtataggaattcagaacacgcaagttaaaaagatgacatgttaatttggatggttcccaggaaaaaaatatcacaggtatttgatagttttctagagagaagatatgcttatggttagattgtatcgtgagagaaataccatgaggatcatttagattggtaaagtagtactttacatatatttatatttatatctatagtagattaaaaacgctagaaatacttataatttatgaccgaaaggaatacatcaatactatgcttgaggctagggtaaatgaaaaagaatcaacagagatgttgaatgcattattgagcctaaattaaatgcgctaatatactacttaggctttattcgaagatgaaagatggcggaactttttcatgacacctaaaacaagaaaaactattagcgtatgactaattgagtattaactaatgcaaacttaaaaaatattttttttattttatttagaaacttctactgatatagtattttttaaaagaacaccattaataattcaggaagcacctagaaaaatagaccatattattgatattgtatttttctaggtgcgatgtctgtactgagtgcgtgcgtatgtttcatgcaattaaaaaaaaagactctcacaaacatagctagttgaaaattccctacaagttgaacaaaaacacacacgaataacgcgcggtagaaaagataagagacagtaagcaacagtacactaccatacaagaagctaaaatcccggagcattgtcatagaacttcttctctacttgtcagcttataatggcgcatatactgccattggaggagtacgagtagtatcattattttcagactacggcctatttagtttccaaacaaaaactttttacccggtcgcatcaaatatttagacacatatatagagtattcaatatagaaaaaaattaattatacagattacatttaaattgcgaaacaaatcatttaagtctaattacatcatgatttaataatatggtacaacagtaaatattcgctaatgacaaattaattaggcttaataaatttgtttcacagttttcagatgaaatctataatttattttattattagtttacgtttaatacttcaaatgtgtatttatatattccatgtgacatgtaaaacaattttttttgcgaaccaaaaaggcccaggattctattgcagtgcagtaaagtaacgcgtggccggccacagggagggccatcctgccagtttgtggggtcttgaggtgttgtggaggcacatgaggaggtggccgatgataggtcaaaacctttttacccccacatgccactgtctgggaggtaatcacctcacctcacattgatcttgccaacttttacttttaactggccggattattattattcaactcctctgggtcacaggatcacggcgacctagctaaataatgtccttttgacacttgacagcaacactgcctcccaaatattcttaaaaaaatgagtaacttggtgaagttactagactattgtcacaaatttacttttgaagacaaatgtatacactgcatatggcatctaatataaatattttaaaatatattgctccaagtaatgtttaaagtagtaataattattttttaaaacacaaaacaaatataaatgctcacaacgtacacacacttactcctatgaatacatacatgtacatcctacatatatgaacaccgtcgaaatactagatcggtatgttttgagattgatgaagtcaccacggacatctcgttttcgacgaaatgacaaatatgttgcctatcactgaaagaataattagccgtgaatatgagtacatgtgtcgagtttagaacttaggtgggctagttccataataaggaacgaaagacatgatcatacctcatatcattttatgttttaatgatcgttatttcaatttgataatatcgcaaaatggaaataaaagggttttttttactgttgtgacttgtgacggtatacggtttgtaaccttaattagtacttattatgggttttttttctcaaatctaaacatcaacttattcgttttctgttatcatgcttttcaacctattaaaataatggtgcatttttgacaaaaagtctctatatatagaagtttaaaaaaatcaaataatccatttttaattttataatattaatacttaattaatctaataagttttctcgctttgtgtgtgctgaaaatatctctaccaactaagagaacgaatcggcctaagggttgatggtaatgccattgttatagaaacatatttaaatttgaattaattggctcatcgtcttttacttttcactaatagttatatatgtcatgaatttgtaatctaaatctatcgtggtttgcttctttttaaaagaatattatgattttcttgttattgtgcggtgttttcgaggttccatttcaacccttttttttttatattccggtagttgatgatattgtattcggttcctcttcaagttattacatttggctcaaaatataacaacgtaacctatgtttaaaatatagtaacgtattactaattgattggacacctataaattttgatatggcacgcctagattgttatatcatggaccgatgaagtacattcataaggagtcctctagcaaagacaacctatttctcttaaaagtcggaacttcctagacagcttttacatacgttcaatcttacaagtatgtacccactttcaattcttacaaattttgatatcttcaaggaaagaaaagtttaaatattcttcctacggccgttttcccctttccctggaaaaaaggatatgtttccggttacctgcgggagaagtaactgttaccacatgacacacccaaaaccccgggcaaaagtaaccccaca

SEQ ID NO: 13884 - DNA, 17244 bp, Oryza sativa
tcctcgctgttctctctccatgtactgacggtttcgggaacaaccactccccgcaggaggaggcggaggcggaggcggccgaggtgcgctccccaccggcgcagggggtcgaatcggcggtggaggcgacggatcggggcgaggctccaccggagcagccggtggccgcggactccggagcgtcgtcagccgagaccccgccgtctctgctggagcaggtgacggagacgccgccgccgtcgccgtcgtcgtcgtcggcggcggcggcggcggcggaggcgcaggtgggaggggatcacggtggcgagagctgcgacgtgtacaaggggaggtgggtgtacgacgaggcgaacgcgccgctgtacaaggagtccgcctgcgagttcctcaccgagcaggtcacctgcatgcgcaacggccgccgcgacgacgactaccagaaatggcggtggcagcccgacggctgcgacctccccaggtaagccgccgccgtactactccccccccaccccccccccccaccattcccttcccctgcatatccgctcgctctacggatgtataccgtacacgtatacgtgtacgtacgtatctacgcccgccaagtacgtacaattggggttggcgggcgtgcgctttcgtttcgtgaactggaaagcgcgggtgtacgcgtgctgcgtgtgggcggctggctgctgcggagatcatgtgtggtctgtggcgtggtgaggtgttcgaccgcagatgcgattgcgagcgatgagatcatgtcgtctcttctctctctctctctctctctgtttttttttgggctgctttgtctgttctaccgaattttttgttgacgtgggtggtaagctcgaaggtctccggctgctgctgctggtgccgcaatttgcgtatgtgggtgtacacgacaatggcaatggtcgttgatactacagtactacttgctctctcgcctgatgtcattccatgtgtgccgtcagcccgtcactggttttgggcacgattaggctataaaatagtggaccgggaactagtttaagtgggggaaagcagcatggtgatgttgattctgttaacagctaactactccggggaggggtttctgacatgtttgtactgttgctcgatattattctaggatgccattgccaatttgctatagttcttaggggatcattgcatcgtagcaacttgtgtattttacatttacaccagctggttagtacttgcaaattaagaaggatggttttttgttttactttaacattaggagttgcggagattttttttttctaattcttgcaagggttttgtcctaattgttgtttgtagtccaaagttccattaaggcaagtggttgtgcagcatcacgctgcattatgaccacaaagtagatctggtgtgcttgatccattgaaacctgtactcatgagctatgtttctttgcaaccaagattggtatatattgtactttaattggttaggtgctataattaacgagaaaagagactgcacctattgatcagtgtagtcttcaaatgtattaatcaattcaatggttgatagagaagttctgtttgttacagaaagttgttaggaggggaacctgagtggtttgaaacctgagtagttgctggatgacagcgtttgaactaactttaacatatctatattgggatatattagagtttatgcatgtctatcatacaattctaacaggtaaagtctttatgagaccctggaccgtattttcaagttgcaaacaagttttatgtgctgataaatcatgaaatcttgatatagtattttctggttaggaaactcaagtgtatgaatgttgaactgttcttggttggataggaaaaggctaaaccaaattccatgggatgagcagggattttgattcaattttttgggcctaatctctcttgatcaaaatgagccctaagtattggtctaagaaaaacatccaaccaaatccatattctataatctatactatgcagtttttgttacatgtttttttttaaaaaaaaaaactgattttgtggcttgacaaaaaattcccagatttgacgctaagttgctcctggagaaactgaggaacaaacgactgatgtttgtgggggattcgctgaatcggaaccaatgggagtccatggtgtgccttgtccaatctgaggctccctgggagaagaaatcacttgtcaagaatgactctctaaatgtcttccgccttgaggtaattagctactgcactgttccctaacatgacaaataatggaatagtttaatggtttacaaaacagagtcacagacaattactaacaatatggctataactggtttttataaaatatcactataattaataaaaattctaatagattccaaagctatatgtctttgtacatttctatttttgccgaccaaagaataatggctaatgtcttacatttctaacttggaacatttatatggaatatttcaggagtacaatgctactatcgagttctattggtcaccttttctagttgagtcaaactcagatgatccaaacatgcatagcatcgttgaccgcataatcaagccaacatcaattgcaaaacatgcagcgaattgggaaggggtggactacttgattttcaacacttatatttggtggatgaatacaccagagatgaaaattttgtgagtaacttctaaaacctaattttttatccttgtggacattgagacatgctggacaaaatctttgggattgcctggaatattattatgtcctactccctccattttttaatagatgacactgttgactttttctcacatgtttgaccattcgtcttattcaaaaattttatgcaaatgtataagatattaatcacacttaaagtactatgagtgataaaacaactcataacaaaataaattataattacgtaaattttttgaataagacgaatggtcaaacatgtgagaaaaagtcaacggcgtcatctattaaaaaacggaggtagtatattgctagactaagcttgtaaatgcaccttgattgcagacatggtgggtccttttcaaagaaaccagtgaaatacgatgaaatggaacgtgtagctgcataccggaaggtcccaagacatggtctagatgggtagaaaagcatgtagatccgaaaagaagtacagtcttcttcatgagtgtctcacctgtgcatatgcagtaagtcctccctcctctgtgtgtgtgggtcgtgtgtccgtgtgtcaattgatttctcagagggatccacaaaaaacacacagttaaatcctttacatagctaggaaattaaaatggtgctgttagcttgaaagttcagatagtggtaatgttattctgttgtcatatcttgtgcgattcttctagtgaaaatggctgggtgtgctcatggattgtatgataacttttatcttttatacaggagcgagggctggggaaaaccagatgccataaaatgcttctctgagacgcagccagctatcaattacacaaagaaattggaggtgggcacggactgggatctgttctcgacagctcatcacgtaacgaaggctatgaagagggtgccagtgcacttcatcaacataacggcgttgtcagagatccgcaaggacgcgcacacatcggtgaacaccctgcggcaggggaagctcctgacgaaggagcagaaggcgaacccccgcaagttcgcggactgcatccactggtgcctacctgggttgccagacacatggaacgagttcatttacggtcacatcgtctcgagccctcaaaggaggccggttgagccgattgagaatcaacctcagagataacagtgaagaatttgtctatttggaatccattagatcgtttagcgaggaagaagtggcggccgaggccataaattattttctaggtttaggaatctatgctgttgattcacctagggtttaaacagaatggtggccatggggtagagaaatgtagctgtaagcaaccaagatagccctagacgagagctctgatgctgtctgagagtttgaatgcggttgtttctgaggagaatgctttctctgcttcccgtccaaaaaaggtgagtgtatttccatggatgcatgtatataatcttactaaattcttttggggaattgttttcggtttgtcccgtggacaattttcttgaactgtcgcaaacgttccagtaaagctgcaacagtcaatatacaaattggctgttgccttgtgattcatttccttttcattgtgtccttccaagtctatcattttcctaatttcctttttggcaaaacagttatctcacaagatcattataaggttctctgccaaaccaccaaacccaatgttattttttttattgcattctccaatgtaatgcgttggcggttggtccacccaactcaatttgttagaccttgttagatcataccttcatggttatggacacatgcttaaattcaactcaatttcttataccaaccaatacatgagaaatccatggctgcctatacaaaaggatcaaatagaagtaatgatttcataattgcaattggctcacttgatgatcagttcatacttgaagatgagcacaaggtgacaaggtgactgccaacccttttgatcagaccgtgtcatggagttgtcgattgtttgagagaataggtcaactgtgtagacatgccttgaatgttgccagaaaaaatatgtattgaagcgttggactcgataagcaaaatgtggaactattcaagatatccatgggaaacagatagtggaaaacatccatgggaaacagatagtggaaaacctcaagctgcatgctactcttaggtatatctgtaccaggaatttcttcctttggcttccagagctgcagactttgaagaatgttactcccctccgtttcaggttacaagacgttttgactttggtcaaagtcaaactactctaagtttgactaagtttatagacaaatatagtaatatttataatatcaaagtagttttattaaatcaataattgaatatattttcataataaatttgtcttgagttgaaaatgttattgttttttcctacaaatttagtcaaacttaaagcagtttgactttaaacaaagtcaagacgtcttataacttgaaacggatgtagtacttgcttgtggaagaagcacttcatgccgttagtaaaaaagttgaggacaaaataaaacaaatttacaatgatggcatagttgcaaagtcagcatcccagttatctcagaacttggcacatatgtctctggtctgaagaaaaaggagagccagaaaaaaaagagagccggaaacgtgtaacataacggaaaacaaattggattgataaactgcaaaaacacaaaaaaaaaaaatagaaaggtaaatatatttgtaccctactatgtaacaagttaaaatgggactataaattgagccccttctcaaatctattatgcagcatgaagaaaaggcaaaggagaaaaacttgcaaactgatgtggaagaacatcaagaatatgaagcaattagcagctatgctcaacttctactagtatgctgaccagtttcttcaaagataaatatatgtgctaacaaattattctaatttggatattatctttttttccctagggttctattgatgttgaagatgtcatcttatcttaaaagttcattcgaagaggtcaacagaacttagaaggcatcatgctgattttggaagcaaatgatgatctacttttggaccgtgaaagcttttctaattgggttaacctagcaatagcttagctagttgattttcaaagcttttgtctcagtggatgcatgacacccaattccagagaaaatagttaaactctagctcattttgtcaattctatgtgcaagatattatgaagttcaatataatgaaatgaagtatgtgtctattttgtttttttaactatatttggattttcttgaagttcaagaaaattcatatcaaaaggagtgaaattgcaggcaaaatttgaactgaagctattctgtgcttgatcaaattgctaaaatgatgcatgacacatgcacacagtaaaatctggactatcccttgtgtgctggatggttggatgattcggtactgccaaagttgtagtcactattgtgactgcacctgatcggaatccggagggggacgagtagaaagagttgattaggcaattaaaaggagaaatcatgtggattttttaatgtgtataatttgtgccattatatatagaagtcaccatttactattccttgtaagagtaaattgcacccacgatacaacaacttatcggatgggtgcgatatagtgcaagaacttgagaattgaccgttcgagtacaacaacttgacaagtgggtgcgttctagtacaaaacttgacaattttacatccaattacctttaagaatttttgtttttttcaccttcccaaatctcaattgaaatataataatttctacatccagtttaattgactttcatttattagttattagaataaaaatataaatatgcttatatataaatccacgctagtatattgtcaaaataagtacttaaaaattaaatatgtataaaaaaaagtgctccaaataattaagttgtcggataacttcttaacttattgtatcaaaatcgtacatatcttgcaagttgttgcatgtatgcaatcacttataaacttcttgtactaaattacacttacatgtcaagttgttgcactagaacactcatttttcaagttcttgcaccaaattatacccacctgccaagttaatacaccgtgggtgcaatttactcttcttatagatacaacacataacctaacctacacaatgttcccctatttaaatctgaaataaaatgcgatcacaagtcactctcgaccaacgtaagaacaaggaatttttttcccacatgttcgattacctttattattagacaactattcaaaattcaaaattttgaattttaaaaattaccagcgattactgataaaacaagtattttaaaacacatttatttttcataaacctaacttacaaaaatccatactacttaaaaaattgaaaacgtttccgtcgtccgtaataacggaaaaaagggcgaacaaacataaaaacaattcaatttgaagcttaatgcgagtacgaatcaaatttggcccaaaatcctagagaaaacactactacaagaatacaaaaacatatttcatcaacaacaacgacaacccaagaacatcacaagcacaaaaacaccgacgccggaaggggagggtgccaccgtcgccgccgaaccgccgccttcatcacagggacaccgggccgccgctggctcccctcccgctggatccgacggaggggagggcgccgtccctgcccgccaccatgggtgggggaggtggagcggcgtccccgccggtgggggagggggaggtggaacgacgccttcgccggtgggggaggggagtggcgccgctggctccgtcgttttgagagagagagagagagagagagaggcgccgctgctgcctcccctctcgctggatccggcagagggagggcaccgcccctgcccgctgcctcccctcctactgaaagggagggcgttgccgcttgccgccacccgccaccgtgggagggggagggggagcggcgccgctgcggtagaaagggagaggcgccgccatttagagagagagagatagatagatagatagatagatagatagatagatagatagatagatagatagatagatagatagatagatagatagagagggaggcagaggaaattattttagggttagggtttaggatgccgaacttttatatagacccggatcaatctagaccgtcaatcagatcggatgactacgccttctcccacatcgggccacggttcccaggccgcctcatgggccgcgtgtatgctgttggcggctgttaagtgcaaaagttgtgccgccaacgcctgcgtaaaactcagataataaaatatccaatatagtgataggtgttaattctaacatattccatgagtgttggtgcatatttgatgcaagttataaaccacataagttgggaggaaatttagactaaaagtgagaagaaatctatccatataagagttgggttttagacttcaccaaaactccggagaattagcccaaaattagaagaaatggataaggcagggcaaggaggaggcccagaccaaacctggcagccagatgggccagcctaggttcggggttcggccgaaccctggtttcctccgttggatctggggtttggcagggacgctccagatgctctcctgatgacgattgcggggcaatttagatatttcgcatcattccaaccatcatacttgccctataaatagacttcactttttcacacacttccaagcttgagctgaattataagaggctctattgtactatttgtatactagaattaggaagaggtagagtagaagaagtcggaggaattccggagttgttggtaatcctctcctgtttcttttattctattaattactctgttttcaatagaaatatctttctgagtaatttagatttacttgtgagaactacttcttggttagttcctaatcagcatacaggattattgttccctataatcaactaaaatatagtgattgctttagtgagttataaacactagagtagatattaattgtttagacgtggtatttaggtaattaatatctagtaattgctgcgtatcccacagtacgtttgaggtgggtgtagagctgatgacagctctcaagagcacttaagtcctccctgtctgggtacgtagtagagtgacatctaggaagagctgccagtgttattgcattaggattaaaattaagcatcccactaggaaattctctctatccttcgcctaccatagcttagtgtccttgggtgaacttgatatggaagtaatacccgttccctatggaaatcgatacctgagaatattttcgggtgaagtgctacatcggtattttacgtgtgcttgcgaattttctctgtaaggttatgaaataccaacataggctccgcacgaaataagttcagttcaggtcccttaatactgagttctttccttctaatactactaaacggtgcatttttcgcaaaaattatctatatgaaagttgctttaaaaacatattaatctatttttttaattattttttactagtacttaattagttatatattaataaattactatgttttccgtgacaatactccctaagaaaacgaaaatggctaatctctatctctactacttaaaaaatttgaaaatgtttttgtcgtccatctaaaatgaaaaaaagagagaaaaaagtctgattgtatgtaaaaagggcagaaataagtctgatttctattcgatttcattgtttatacgttcaatatctctaacctcttctggtgaaattttcttccatcctcacctatttttgtccgcaacattccaagtccaacacacaacaaatcatccagaatccgcatcaaataacacttcaccttcgcttacccaaaagagaacgaacggtaaattttaattcgcaggctgaagaataaatgctgaaattatgtttgtattgtcaaaattagcaattaagctttgaaaatttcaatgaaattccaaagagtgtagttaattatgaagaatttaaaaagaataatccaacaggtagcacctattttacttgtaaattaatttaattatacactttccaacttaaaaaaatatccaattttgaaggaaatttgtgttggcaactttttgtgacaagttgacaagcacaatcacagcacctaaagctttgcggtgattctagagtcgccaaccatcctaatctagcaagcactagatcaagttgggttttgataaactaaaccagctagcggagccgatttagatagaacgatggataactacccgtctagtgggcaaaatggatggttttcaggataaacctacaaagaggtgtcgcactctccagtggcggcgaacgatttacagtgtaaatagacaaagatggacaaactaagagaaaactaaaagcaatatgaaaaacgattcgattgattgattgatttatttattttttacaatgaaccggccttattccttatataggggttggtcttgccctctacaggctctcctccacgtccaactctcgggatagaaaccaaaggaaacccgaaacatgccttccagagcaaggaaacttcaaaacccgacgaaatagacttgggctcggactctgccggtcagaccggccacatgccggcggtctaaccggagttcaggccgcggtctgaccggcctatacacggcagtcagaccggcctcccagaggaaacaccggtagatcgtccaaactttggcaatttccctattttaatcctaggtgccaaatttgggtgtaaacaatttgtatttcaattaattacataatataaatctttttacttttccttaattttctggtcttaacacttcccgttgcaacgcacgggcacttttgctagtagaataataatcacaatgcaatcatctatagggacaagcataaaaagggacaggttatatagtagtatttcacaaatgtaacgataaatacatttcaaatttgaatgtttcttgtttccttttgaaatgtacagataaagagcctcgtcgcttccaaaaaagaatcagccgttgtcaatatttaaattttaaaacttaattttgaagtcaatttttgagtattttcaaagtagtttcatttttaaattgcgaaggacacaagttttatatacaaattatgttttggtcattaataaaccgtttggctgtgcgaatttgctatatatttgtcgataaattttcccccaaaaatttgtcagatgtaattacagtacaatcgtagtgtaattagactggaacttgcatgtaattacactgtaacttgtatgtaacttttaagaatctctcagtaacatactatttcagtaaaatagtggtcgtgagaacaaatcctttcacatatgtgtactgtgatttttttcttcctcaccaaaacaaatcttgtaatagatctaacgattcaaaattacgtgaaacttacatacaagttacactgtagttacatgcaagttacagtgcaattacactacgattgtactataattacatctgtcaaatttttagtagaaaatgtgtcaacaaatatatatataggtggtcccctaaatttaaattatttcagccagcatgtggtgaccagcttaggagccgggattttgaccaatattcaaaaacttataccaacaagaaaagtctcattaaataggttataattataaaaaacgaaatgatataatagaatcactagcctgagaaacaaaatgtgctctattatagctcaattcgtaaccaccagtttattgaaaccggtcggcatacactgggaacccatgttgcattgagcccaaatgtagcagttatcaaaggctcaaactaggctcactcattcggtcattcctattctaaagccaaaatggacacttacatctaaatgcaacaggatcatagggtacaatatcagatggcaatatgagcattgcaaggtaggatcacatgattgaggcctccacacaaagccttggcattccagcacttaggtatgatccttactagtagataagaacaatgagccctgatactattcagtccagtcacaatcggctcactcgttgctaaacgtttcttgcattttcagtgcaaggtcaagccctcgtgaccatgagtcatgtgaagcttctcaatctccatgagccccacgagatgtgtggttggcagcaggagcgaagaagcgggagcatggacaagctggtccgagttctgggcttcaccttttcaattgcggatgacacaatatggggaggtgggatgctgtaccactggagataccaagaaaggagcactgcttcgttttgtgcatcaggccatttgcctttgttcaggtaattgatgaagctgtcatgcaggttcggcaattctgcgaagatgtactctatgcgcttcataagtgattccaaaaatgtggactgaataatgcctccagttgtaattctaccatcaatcagtgcttcattataggctgatgcaacctgcacgttcaaagaaagatcataatatcattaccaaatgttgttcattttctaatctataagaaggaaataaaggtacaacacatcagagcagaagatgtatgtgaagctgctatggtatatggccaagaagtgtatcatagcacagcaaaaaatattagtttcaaatctcagcacaacagccagttcctagcaaatctgggatacagaacaatttaatttttttttgtcgaaacgaggtaaagtatgtgaaaattgatctaatagataaagatatcttcaacaaagaagctggcaaaacagaatcctaaaaaagacaaagtacaataagaagaagagaaacagcataataaagagaaaaaatagaaactagtcaatttcttgaggtgggactaggaattttgctggaaccatctttccagaagctctgtgagtaacccaaactagtaacaaagagaacatcgcagatctggagaacttaaaagcaagtactaaccttcaagctggaaaggaaaagagaatcagagaaaggaaaatgtccaatctttagatgctcccacattgtctcaattattgtgtaaaaacttatatacacctggaaaagagataatgatgactaaatacatgataattcatgggcactggagatttaacaaaatgtgaacaaaaattcagtaagaaacctgcaatagtgctggcctatccttgctcatacattcataaagtatttgagagcagaactcttcaaaactgccattgcgcctgcatttggacattgataactaaacattagaaagcaagccagacactgatgcaccaaataggtcgtagtgattactgcatatataaagtaacaatcaaacaaagaaaacatcaaaaatatcacttgcctgtccttccatgactgacaacacagttttgcaaaagctatcaagcttggattagcagaaaatgtgcttactaactgatcgactctaagtgaactacgagtagcactgtttgcctgattactgcagctcgtggatggtgtatcacaaacctaaagattgatacaaaacagtcaaactacatgccaatagagaaatattagacacatagtcttttgtcagaagagcaagaaaacaatataacctcatgcattgctcgagaaagcaaagattggcatccaattggatcatctgagtaggaacaagatccaactttccgttttatatagagtactccaccattgaatgggtcagtcctgtctccagatttccaccatggcttatctattaaagagagaaaatataagaatacatatgttttctgaagaaacatgaaatatttagaagagttgcataccttcaggtgtaagtgtaatcacctgagaccaatatctgggtccacaaactcgaatgttcttcagctgcaacagaaatagccttttcagattgtgcaattcattggagagaaacccagtctgggtgtaaacctgcatgaactttccatacaattcccaaaattccaaaaacatttatagatgaagagaagagatactgtatgatcttgatttccatgaccaaagctgattgtgtttgaactaagtgagagaaatatctactacctctgtcccaaaataacatcactttttacccatcctcacataccaatatagaaccaaaaagactagaatgccctccactttatcaaatccccatgcaattgctccccactttatccagtcctaatgcttttgtcctctcgtttacaaactccaacgcaatgatcgcttgaaggatgaagttattttgaaacaaataagattgtgaaaaatgaagttgttttggggcagatggagtatctaaaaggaatgatgttgaacagtgtaaaccataacttttggattttcttgtgtatcccaaacaatatcatatttgatatcaagtctgcacagtcattaatgtcatttctctaacagagcgacaccaataatttcagacttttttgcatcctgagggcatccacacaagtgcacacataataggttttgcacttgatgtttgccctttaaaagatagcattactattttttggttttccattaacttctattcataagtttataagttaatggtaaaccgaaaatagtaatgctatcttgttcacagttggaaaataatttgtagatagatcagtaaatttgctgtaatttagtgtcatctgacatgttaaagatgtgtttacttgtctgaaagctttatatcgttttcagcataattttttgcaacaaacaaatgttgttagagtccacataccactgagcgctctggcagaagacaaggtgtcacttcacagtaattagtctcgtcataatactccgtttcagcaactgtcacttcaagaggacaatacaccggaagtcctgtgtcaacatctactgtctgaatccatcgaggttctgtagctattacatacagatgcctgaatgcctatttacagtaccatacaaagaacattagttgtttacaacaagggaagctaccaatatactccctccatttcagattataaatcgttttgaatttggtcaaagtcaaacaactccaagtttgactaagtttgtagacaaatataataatatttacaacaccaaattagttttattaaatcaataattgaatatattttcataatatatttgtcttgtgttgaaaatgttactacttttttctacaaacttggtcaaacttggagcagtttgactttaaccaaagtcaaaacgacatatagaactcagaatggagggaatagtgaaaagtgtagaactcagaattataggaaaaccacctggagatgacagcgattatcatttggtccagtaggcaaacgtgggtaaagggtgatgagtaatgcggcaactgcactatttgaagttgagaatgtgtgtgtaccacctccaaggaataagaatcctatagccaagcttacctgcattgtagacaagacaggtaaatgcacagatagacctacacatcgtaaatgacctgccggagctatctgtccagattgctcagtgttctcacaaaataagctatcagaatgttaacagactgcgattggcagatttatatttgaacttcatgcagtgatgaattaaccatatggtaactaagatctgagtacagtttgcaaacttgggcatataaaccagacaagctctcactaaactatccaggattcctatatgaacatcaggtcaaatataaacataaaaagatgctatttacagaatgaaccggttgaaatagtcccaggttagttacaggaatctggagggtcttttggcaggaataattcaaaaaaagttgccccattagacttctaaaaagggcaatgaaataatcagtcctcatctggttttgaatttaaagagaacacagttgttcatgacagtaataatactcacagccatctgcagtccataatttacttgtccttctgcagaacttcttcccctcagataacgcagtaagcggaaagtttgtaaatgtccagatcctgccattacctaacaaaaaagaaacacaaattacaaaaacaaagtcgagaaaattgattttattataatgatcacccatatttaagatatgtaaagctaaaagacttcatgaaaagcttgaaatacaacaagaatgttgtacctgttatacataaaacagagaaatatgcattctaactaaccagtgatagagagagaacaataagatgcaagcagagctcaagagttccacgatcaacatgctgcaacaatccctttggcaatatgcttgcagtctgaatagatatgtgtttgatctgcataagaaatattaacaatattatcagaatccaatataggaacaacattggataggcatgtatgtcggtacctcattgagaaaatggacggcataagcgtagagtagttcttgggcatcactatttctactgccagcatatttgagacctgaaattattgataactgctgtaaatggcagaaaaatttgctaggttcataagaatatttaatgccatttctactggttaaccaacaccaatagtcttgtgcatttgcaaatttaagtaagttctatcaatgaaatgcagtgccaccagaagtacgaaggcagtaaccaggatggtgtttaatgaacccataatcaataaataatagatagttcggcaaaggagatggcatactgcagcaacaggccatgcctttaatgacagatagagaagctttgctgcaaattcaggaagggagagagttgagctatataataggctatagcttctgtgtttccttccctaggagttaacgtaagccaatagatatctcttctcaactgaaagaagtactcgatgttgatccacccgtccaaaacagtgaagagggacagctttaaagtcaacttttaagcaaaagaaaagctcaacaattccagaggggaaaatgaaggttaagagggttagcctatctgtaggtatggttagactaattagacaagcactggtcaatggataagtgaaaaagggcaacatgtatttcagagaaaaggtgtccctagttcaatcctgctctcagatttactcagaatcatcagataatcattcacccacttatacaagcagacgtgggacaaagtcaacacatataaatgctatttccagactcccagatcacatatagcaagcagtatagtaatactggcagggatagggtgaagaaagggatttacagaacaaatgttgatttctcaccaagtgcaatgcatgctccagtgacaatattaacataagcttgaaacagagcttcgctatccaattcatcactgtccatagcctcttgactcgtattggaaacaccaaagttgacaaatgaaggaacttgagactcaacccaatctttggtaggttgtattctacgaaa

SEQ ID NO: 13885 - DNA, 22053 bp, Oryza sativa
ggtgttgccactttgctcatcagcagctattgctgcatttaagtgtttttcctgataatattaacaataatttataaaaccattagcaaaactgaattgcttcacaagatgagaatgccataatataaagcaaaaggtatcaaacagaggtagaagtaatgggggtacaaagtccttgtctcctggaccatgtagtatgcaccagtaccatagtgggaggagatacactgtgtgtaggagaggggggagatacactggatggcgtgaattggcacagcaagccatagacgccatccaggcttaaagagaagccttcatcttagtttgtattagggctggctctattaaagtagttctactcctgggctcctggcttatggttgaaaacttgcaatcaagaaaaaaaaaacacaatctatctatcttctcaccactctgccaaaggtgacaagatgcacagaacccttgtcatcccattgagcatagttgttatctccattctttccgtactatcaaaactcacaagtcatgacatgctttgaacaaatacgcattaagaaccaaccatcttaggcagcactcagcattagataaataaggataaagggctaataagatcttacatggtagacttctttactgccaatgtattcaaaaagccggtccaggaaagtgtccatgaatccgaaagcattgcttccacgaccttcaacaaaagcttcggttatttttgtgctgaagtgccagcttaaaatatgcaacatgaatctgtcaaacgaaattcacctaatgcaacaagtcctaatgcagagcctgcagcacagcttacccttttttttttaccacattatcaccaccacttttttcggcaatctcacccttgatggtatgagcccaagaataagtaaaagaaacaacattaggaaaaggaaaaaaaaatatgacctagtccaaattggttcatatattatcatgtgcacaatgccacatcaatatagcccaagaagctggtagactttgcttcggattcagtttagttcaattatttccttatctttagtttggttcaattatatccttctttgtacccttagtgtcttttagattggtttgttacatccatgattctatttaagtggacagcagatttattaagtaaagcaaaaggatgaataacactgtctcatagtccctacagttctgcagatcattttcttaaccagctactctagatctatttccttgccagtttgtgccctcgttcacctaaagccattctacaatccactcggataggtcagtgtcagatctccctctgagccacaaacaaaccaaaaaaattgtagatatgaaaccgctgtgagggcaaaatatccaactccaacaggagattaaaaaaaaggaacatatttagtatttctgctctggcgaactgatagaatattgaatgccaaaggaaaagattaagtgtagatatgtttatagtatactatggctttaccccatagtctaggattggccaatggggcactcatgactgtcttgtgtgtgtatataactcttgcagacaaaatgtgatgaacaattgatatttgtgggtagctaatgtcctttcccttaccctctcaacattagtgtcatggacaactgaaatgaagtgatcctttgctaaaagaaaactaacagaaagtgaaaggaatcccaatcatatagcacggccaagaaagtaccagaagaattttcatggttaatgcatgtgctgacccttcatagagaagtccaattcccatcactgctgctgactggaagaatagaaaatatgaaaattttaagagcagatggataatatttcctgcaagaaggcataaattgcagggaatgtagcttacccgattgataaaaaattacaacaaaaaaatattaggtaaaagcttataatcatgaatgatcaatcactcaatagcaggtgacagggataagaaattgctattacagactacatgacaacaagatggcaaagaataaattataaaaggcagaaacccacaatagaagattatcttgattcattctaactctggtgtactccctccgtactcgtaaaggaagtcgtttaggacagcgacacggtctccaaaacacaactttaacttcttttttctataaaaaatatttattgaaaagtgatatatgtatacttttatgaaagtatttttcaagacaaatctattcatataaattttatattttcaaactcaacaacttgagagttaatcatgatttatattcccaaggtttgacttaaacattgtcctaaacgacttctttatgagtatggagggagtacagttcaaaggttaacactagtcatacccacattaaatacaacctattctaatattgaaccaaaactaaagccaacaaatcaaatgctaagcatcactttatattttccagattttggcccataaagcctttgcttgtcaaatgcagaaaaatccctagttgagcatcgtaagtcgaaatttcaaaattgcatttgctaaaactagtaacgatataaacctactaggaaccacattatctctgttcttagaacagcactaggtaaagagcatgcattataaacaaactgcacaatgagattttagtacttggttaaaaatatttttcatctcatctgtcaataaccaaacaaattctcaaattttttaccccttcggcgaaacccacaaaggaccaaaacctactgaaacaaaaatcatatcttactagaaatgttcatataagagttaaattaagactgtgctccacccaaacataatatttacaaataattgcctggtctaggatccatttcactatcaaatatttacaacacgcaacagtatacaacatgtgaatgtaagacctgttaactcaaggatcacatgctgagaatccataaaaataaatgaaaaacacagtaagtcattagctaatcgcaaatgctacctgcagaagagtaggtaattccaactctggcgtagaagatggatgccgggaagggacatgaaaatagagcatctgaaaaattgcaatcaagccaaaagcagtaaaaatcaatttggcagtcaacaaagcagcacatccccattcaaagtgaccaaacagaaacaataccacaataaacctgattttttcgacaacctaaggaaacactgaatgactaaagtaatgtgccttcagaaggaaaataaaaaaaaaaaaacagcaggacaagcaggtggttttaacctcatcacttctaatagcaagttctgagagaattaggagttatttatttggtttttttctgttaaaaaaatgtatttggttctgttgaaaaggggtttttgaagattatctgctatatatgtccaatgagcattggatgtagataaggagggaaaaccattgctggcagaggtcatgtatacaattcactatgcattcctataacagatggaatccactactttgaaaagaaaaaaagaacaatacataaatctgaaaggaagacttgtctaataaagaatcagtcaggaagtcaccatacatcttattagatggacaaagcttaccaatttgacagcaatatacttttgagacgtaataattgtacaggtacaatgcaaaaggaggattgcgtacctttgaaattgccgggtgcattgtccccctattagatgcagccaaaccaagtagcaaaccaagtctagttatatcatgctcctgcggtaaagtaataaaaaggttataccataccaataaacaaataatgacatcacaaccccattttctcctaccattttgagtacggaagtaatcaaaaggaggacaaagtgctgagtggtgactgaggtgcaaagtggtacagaacgatttagatataacaatgaatacttgaacacaaaattagtgaagccagttattttctttagtaatggaaccaaaggacaaaaggccacctgggagagatatcggtaagcgtcggtcatagttaaaactcgtagatgttcatgcaaaccaaatgcaagaagcagaccagcatgagtaaaatttggttcagaaggtctattatattgtatccaggttcttaacattttctcctgcaaatagaacatgactgttacacattcacaagtagaaggaaatacagagtaaaaggtggcaaagcatttgccaagagttgtgaactttgcagcttttgctactgctgggtaatatggtttatctgttttgtgatagtccagtttacctgaaaaggagcaagcctgagcccagcagcgacaccattgtgaaactcagcccaagatttgaattctgagacgcttctagtacttaggtcaagattaacctatataaaatagtgtaatagggtaaagaaagttacaaccaaggatctacgatgaaaagatgttgtaaaaattcaggggcagcgcagcgttcatgttatgaggtgagatagatcgaaggtggtagcagtggcaacatgatatttatcgcccttccctgctgtacatgggaagaaatgcagttggatgtgggggttggtgaataggcttagcttctgttgctttgttaataaactggttaaatagagtacagctgacatgagtagccaatcaaaaggactaaaaagagcgtccaaccaaccctgaaatatcacaggtagcttcatatcattaactaatatgggttgctatctctaagactggcatatgcagcagtaccagatatgttgtttttctgtcatgaataggggaggccccgttccacgcatgacataggcagtgatattgcaattatatcacagtattaatgctacatggcgacgtgaacagttgatttcttcagaatgcaagtctaccagaaaacagataaaatttgagttacataagaggtaacattactgttgcattctgttgtgcaggcaaccgaccagccaaaacaagctttgggaaaaccagagcctgcagcaaaagaaaatggccccataacaagatgacatagagaacatcaactggccaaggtagtaaaatactggattagatgcaaccataaccatcccgttattatgactgtgaagtcatacctttgttaaccgtgtgtaagttgtagcttaagtaaaagccccacgccccaaaggtaaagctgttgttctttgtgcaaagttccatagttgttgctgaaaataccagaaataagttgggaccaggttactcataactcgtgagatcaccataagaactgaattagtaccctgaccaaaaatgggttttaccagtattttgaatatataaatacttaagagaactgaaatgacatatcataaagaaatgaaagatccacagagcggaaatgcccagcatatggaggaaggtcacagtgacaatgggagcatggtcttgtaattcgaatttaagcagaaacaataatataatgtgataataaatgtagttgttagggaaacgataatttactatatgtagtcagtaattgcaatcaaatagcatgaagagaacctgttgtagatcctgatcagacacactaggattattgggtgtctgtattgccacaggtcttgctgagcataagaggcgtctaacctagttaaaacaatatgatagaataagaagcaatatataaagaatattagaataaacactatcaagccaagttgacggacaatgacaatataaggttgaaaaagaccggtatatcttatgcaagctaagtgattgtcctgttgtggatgtgtcaaggatagatatgtatttaactccttgacaaaaacgacaggtcatttacagtcacggaattacagtggtcaatagctatgttcatgaaactatttgcacttgcacctacaactttatatatcaaaacttatttttttctacaactatcgtgggacatcagaaaactaccacaatagcacacgatttttgtcagaaactgtatctcataggcactgccgttagcaacaggacaatctgatacaacaagcttgcatgtcatacacaaatacaatgctcatgctgttacagtgtaccatacaccatgccatgcgcaagctggccctgtgtgtatgacagatggacctgacctgtcagatgtcccatgctaaacgaaatgttcttttatgataaaatcatgtgctactgttgtagttatcccaaatgcttggtaaagttgctgcaaatttatagtttggacaaaacagttgaagttttctgcaatttatcttaagtttcaatttcagtatagttgtaatatctccatgtgggctcagcaacttatatagaacttaaaggagtgaaagatatgcagctgtagggacaatcacttgaagtaagaattggacttcagtagataatactacaatttaaatacaacaactcaaaagacaactgtagaccaaaacaacaaaataccaagacaaacctcattcagacgtaaatcacgaccatatcgcagttgtgttgttgaggtgaagatgtgttccattccatcttctacagatctgtaaacagaatcagtatcctcggaattcaaaatttctgatggagggacatccaatgcagtcgtcagtacagttacaggttgcaaatgtagcatatatgggactgatattgatgtcagattatcattgttccaaaacccattttctctccttcctgaccccatccttgccatagctagatcatccctcccaacaagaacataagcaggtgcaggccagtcatctggaggagactcacggcatttgtccagtgcctgtaatataaaatgatatcttaagaaaaattcagtaccagcttataacaaacagcaatgatactggacagacatggcgaagcacaagagatactccaattggtaataaatccaattgttggcgcccaaacttctcagcaaccatagtgagaacagtaagttcctcggtgtttctggctgaaccactggctacttcacagtagacaccagaagagagattttttccaatcctttctgctcctaataacaaactataaaatgacaccacttttctgccccagctcacagcagaacttttttccttgcacattagagcaggaatatcatctgaagtcttcaaatcacagccatgacggagacagttttcaagccaacgaaataagcatggtggagctcttaaggcagtagcagatgatagggaatggaattcaaccaagttgtcaggaaagtctcggcaatagtaatctacataactgttttcaccaagggacgaagcaactctacataacaaggaagcaagactagctagatccctgaaaaggaaaccacaaagccaagatagtttaaaatggatcaagacagtttgccatatacatggtaacaacaatgtgctgatatatataatcgaaagacatctcaacccattcaagatcacatcaatcttatgttgtagatctagaaaagcagcagtaacttgctgatatatgcaattttttatgcataggatcagaaaatataatcacgaacaccaaacttattgatggttgaaatgccttcttgctgacactgaaacatagattctaccactgaatatgctaaaagaaaaatatagtcccattagtcaatatcccattaactagttgctccacccctagagaaaaagcaagtgctcgtactactgccgtattgcggaactctaagctcttcattaccagttggtagaggaaccaacctttcaagaacttagatgtccactgattagcagcatgtatgttgtaaatatctgtggctctatcacataacacccacacctctggaggcaaggctcccctgagttctcttcaccatcaagagaagaaaactaattgttttgccaaattacacaattattgggatccaaaaattatattctatgtaaatttggaccacaagcttacaagaatgcaatacatggtatgaaatataaacaaaaacgtgtaccaaacatttaaggtcacaggagttgtatagtaataataaacaaacatcaacatgatcacacttagataatcaatatcaacaaacaaaacatttagacaaaaagaataggaagcgcttactgtttcctcaaaatattcagcttcaggttctcatatagggcatgcaatgtgtccaaagtttcacttataaaccgaatataaaatgaaacatctgcactatttccgtcttgggggaaagagtggaaactcatgctgcttgtattatatgacataggcaaagaggttcgggattgtttgccgtacttggcgtggtgcttgctgttgatcagaaagtcccaagctgtgcaaggcgattcggatgatttagctggtgaaatctgtccatattttgcacaaatcttttctacttcataactaaatgattcccattctgaatccacatgagagctcgaacaaaggtaagcagcatcactatcaccccagagaagagaaacaaaatgactgtaaaagcagctctgcaagccctctgccattgcggttatgcagtcaccaaccagagaagaggaagggctcttgcgtaatgaacatcggagcatctggagagagcaaaatatgtaaaaatgttccataagatcaactgaaaggtaaaaccgtaaaagtcaaggcattatccagttggagataaaatgagctttaacatcaaagccacataagagataagaacgtggaaaggagaatagtttgtaagaacaatcatattttgtatagattagcccccttctgcattagtgacaggtagccccactgatacttcttgaacagttcaagtaggcaagttattatgggcattgacattgtagcaccaacagtaaataaacaataatgaaattggaacatcaaaatgtgactctcggcgattagaagaaaggctcatgtcagtgaaggtgaaaccagacgcagcatatgctaggaagtcagaacgataagaattttagtaatagcattggtccatgtctaaccttgtgataactcgatcttagtctagatggggtttgccacaaagggtgtggccaataaaatgatggccacaagttagggaaggttgggcaagaaattgagtctgacatatgaagccattttggctaaaataagtggcaagccagagctgcatagggggcagtcttgcaggatttcaaacccactcaatcataattgtagttatatttataaatatatttttgaactggtggatgaaaaatgaactaatatgcaggttttatgtgggatagtgcactagccaattgcatccttacaactgtggtaagctagcaataaatcaaacaaatgcccaagaaactgtgccgctgctagcatgcccaacattatatggccccttgagaagtctttagggttaaaacataattaataaaaattaacaaccgaatttaagagataactgtgtcacttgcgcaaacgaaagaaactgcaagggaggtttagaggtatatccactatggtcacttcagtaacttgatgcagattataaactaaaatggcatcaaccattgccttcctccgcataaatgttgtgttaacaaagaaaagaatatgaagacagttgaagtcaacaacctttactgaatggcaaacaacatagccatcatggataaaatcataaaatatataagtataacaccaaatccatagcatcagtttttctacattgcataaagaagcacatcagtatgaacttctgagttctaacacgtcacacctaaagacttgacaaataagccagcaaattgctaccaacagaaagactatccccaattttttaatgaacccaaacatatagaaataaccaaaaatcaacacaacaaaaaaaaacttagaaaaacacaaccaaaatacagccaggaattcacaccattctaagtaaccacaagtatactaaagcaatatatgtcaacctaccagaccattgctgcatgtcacatttatacgaccttcaacagcatccgttatgcttgtgatctccatatcagagtaaaactctgtaaccccagaatttagctcataatttgaaaatatacccttccccaattcagtaggaagagtatatctgcagaggcactgctttccagactgcacttgacaaataaaagaagagcaagaattacagtttgaaccaggacttagggtgcttcttgcagcttgcaccatgtttaagaaaagtctatggtttgcaccatgtttagaatattgttgcactttggccgccttttgcccccttctgtttgctgacaaggcaacaacatccacttgctaacctttttagagaagcaaacctgaagcataatggcccgggtaaatggcaatcacggttcagacactaaataaaccatgatttattatctgttgcctatgtggtgtgaaatatggatgtgtgaagtagtgtcattcatctgtatttttctataatccgcagtgatgctatgatacatccggaggtcacgctgtttattcaacaaatggcactggatatttagttaacttattttgccgtgaaacttacccattgtgatggattcatgctttaattctttgtttgtccatgaaacttactaattctgtgtcctgacatgattgcaaattacatggcacatgatgcacacagcttttctagatcaggtctaaggtaaggtggctgcttgttgcgccatgtcagcaaaagaagcccagatggaagggggcaagctaaaaacatgctactaagtgaagcattataccaaaatacatggtgcaaatttaacactttgcttaaacctggtgcgaactgcaacaaacaccctaatattaaactgaaactagaatttaatcatatacaacagaaaagcgcagctgctattatgactactaaagcaatggagaaccagatttgtcacatgaatgaactaaaggtcatgtacacaaaaagaaaggcagctgctagggcattatttaggatcaaaatgtaaaggagcagaaggaacatgacttcataagcatatgagcatgatgaaagaacgtatgcctgcagcatgaccacagtgaacatacataaagaagtagatcattgtcaggagttagaatgaggatgtccgtaaagggaaggactccagcccatgctctgcaagatacaaatagcagcattaaaaatagttccttgaggattcagaaccatgtgctaaggcaaaccaccttgggcgagttacgacaactggtgcagcagctaatgcaggaatgttccagctcatgtgaggtttaatatctccaaaggattctccattattctcgtcaacttgaaatctcacagcaagcaatattttttgctcatgaagtaaaaaacaaattattggtgtaccatcgatgtcagttgccaagaaaacctggtaggaaattggagtcatttccaaaacatatcaaagaaaatgatggtggtaaaataattgcaaagtatgaacaagtaaagggaaacaatcccatacaaaaaagggaaacaacagagacagatataaattatgtttaaacggagtttgattatcttattacgcaaatttcataggggtacactagcgtcaggctcatggaaggcctctaagtcatcatgaacactccctacaaaaaaaaaaagtaaagcttcactaatgcccatttggtaaagtccttcaactggcacggagcacatttgacaattgcagaagagagggggaaaggatcaccattgtcctattgtacctagaattcatctattcaaagctacaaacagagaccctgcaacaaagaaatgagaagtatatatcggttgtggccataatctatccatgccccatttttcttattatgttacattacataatgaatatcatttcaaaacaacctcttcttttgtgttgatcttaacagcacaaaaaacgtgttactttgtctaatgaatcaatcagaaaacaagcaatacaacattgaaagatatggccatagatggaaaatggaaaatatgacagaaaaaagagctcttttcatgaagttggaatggagcaaaccttactagcagcagattgggagcatttcccctgccatatcttacggaatgcaaacttatgcatagaaatatcacatggaattgggggcactgcattgtcattgatttcttcctggtaagttgtaccatcaatttgccaaacagagtgctgaaattttcctgccacatgaaaaatcaattttcatttcaagccacaaaataatgggaaatgtaaagatcaaaaaattgaaaaaatagtacctttgtgatatgatgccattagaggtactatatcacttgtccatatagttttttcatcaaaatctttcatcatatccaacctgccccattcttcaaaatatgttgcctaaaaatatttggtcatgatgcaaccaacaaaatggataaagaaatcaatcagacttcttatatattcataaaatgtccagtgaacaatgcatggaatacagatagagatagcatatttccactgatattccctacaactacaaaatcatgaccacaagataatagttgcaaatacaagtgcactttcaaaatcaatatagcagcatatttttctcacagaagtattgctggctatgttggtgacaacttcaaactttagatctaaaaatgtgaggacaccttataaaaatcacaaaagcagtaaaataagcaaaatatgtgcacctttctgttttggcactcagtaatagtaaaaggaaaacatgccaccatggagaaatcaatgcatttgtaatctaccaaatttgaaggaagagaaggcaaattcatctcaaaaacttgcatcatggtcaaaaacatacacttcctctgtttcacattacaaaatgttttgggttttgaataaattcatgcatggatcgatgtatgtgcttcattcatatatgtgtctgaattcctatggatgttactgaatccagatgagaaatggagaggccaaaacgtcttatagtgtgaaacggagggagtagtacatatatatatctgaggcccttcaagtggatgcagcacaaatatacctgaggctcttcaagtggatgtttcaagatgaggtgagacgaaaaaatagccccatcagctttactgacagtctccaaagtattgacttgggatgaaacattgtaattcaatccaaattccttgttaggacgaattaaatccctcgattttagcagtgaagttgaggataataccatatggcctccatcagtagatttctgaagtagaaggccagaaggaagaggccatattgatgaaacagcatatggtagtggaatactggcaacctcgcctgcaatttaaatcatgtgcatgagaaaattaagggataatatttcagcgatcatttggcactacactatatagtaagagggtaaactcaccatttacattgtatatagataaagtatcgacctgcagaacacatagaagtgcgtcacgagttttgtccatcctacaccagcaggcctacagttcagttcaacatcagcaaatgagcacccattgtagatttttagtaatcagaagcatgctgctaaatgaaaagaaaatgcactgtaagctaaaaaaggatcgtattgcttcatgtcaacatgctcattttgttctccggaaagatcaacaacctagtactgtacaactaaaatgtgtacagagtagatagttgaagcattgaaggagcaattttcagctctagtaaaaacattgaaaacaatttagaggtgcaggagaataaagaaacatgtctgtacagaaacaaaaaagatcagattaagtactcagaggaggaaacacatcgagcacagagaaatcagcagtcacagttctaattttatgagcaattatatgaaaaagaaaaagataagggaagatagttacttgttaaacaagcaaaacaaaatagtcaaaataccattatgactgtatttggtgagaggtatcttttgtggacacgtgagccggcactccatattatcctgcaagatagggaaaacatgaacatatcatactgatgatacaagaaatcaacatttaccaaatgaaagaatcaattgaactacaaaattcaagtagttaagcacaaaatatagtaccatcaacaagatatataacttcatatccaacttatatattaaaaaaaaaactcgactctatggggaggcatccccagagcatttccactgtaagtcgaaaaacatgctggatgctggaggcccaggacacagtcgcatttaattctgaaagccttttactcagcgaggtcaacctttgttttgcacaacccaggattcaagccctgggcgggtagcaccacaactcggtgcctaaccaccacacaactagtgtgttcccgcttcacccaacttatattggtgtgttttcatctaaatcactgcaaacatgcaggtcaaactttggcatgaaagaaatgaaataaattatcatcaaaaagaaatttcccacttcacccaacctatattatgtgttttcatctaattcactggaaacatgcaaatcaaactttggcataaaaaaatgaaataaattatcataaaaaagaaataaatgaactcaacttccatccctttaaatttaaaacagatcgatcaatcaattaaacacacaagttcatgccacatttttcagatatcaatagaaacaaaaatccacctaaccaatttctttctgctagcatctagtctgccatagatgcctttgaggctttgaccatgcttagctaaagagattaaatgtattgatatggaaatatgcatgatgacgaatctaataatatcactaaatttggtgactctaaatgtctatgtgaatattaaagtgaaagttttaaatatgtgcatgcctcctagggtgactacggaggagcattccagagtacgacattgacctggaaatgcattgtgcttatctgcacgctgaaggtaaaatgccctattgcgctcacatctttgctctttgaccactagaacaaatagcagcatataaaatatagaagccaatacgcagaaatgcattggggacacataagcatactacaagttctagtaaattaaaaatgaagttgcattacttaggccctgtttggctaatgggatagggaaatcatttcccatccactaaaagacatctttaaatcttaaccattcattctccctcttccatttaattctaacccttcattcatttcccaatcccaattccactccacattttccattatccaaacacacccttagtgtgagtctgcaaaaccatatgcctctcccggacgtagagatacaaatgacttagaggtggaaatcgaacaatgaaattcaaagattcttaatgcatagttgttgctacatttcgctgcgatcacagagcaataaagtcaattctgcccatttcccccatttcgacgggatgacaaagcttaatcatgcccccaactcccaatccccaccaacaatatacagtcactgtagagcggaggcgatgtcgtgcgcaccgattcccacggatgaagagctcgtggtcgccgtcggcgccggaggaggaggaggcggcctcctccccgggctccggggccggggaggcggcgagggccgggtcgaagaggaagtagtcgtagtcctgcggcggccgctccccggggccgccctcgccgtcggcctcctcggccgcgagcccgtgcgggcggaactcccgcagcaccgtgagccgccgcgacccgatcgccggagccatctcgctctccaccgccgcagccgccgccgccgccggcgacgaggtggaggggaaggagaagtgggggaaaagcgcggggcgttgtcccgctcgtcgaggcttccaaaattttttttttttgccgcggtggcgggggcgaaaggggaaaccctaacgagaggggacaaggaggaaaagaaaaaataaatgaaataaataaaatgcatttcagttgggcctgggccgtttgtcgatgggccggaccagtgatagggggaataagttcatttgggttcccttgagatataatgcgtgatagcgcactagcgttgctcgaggcagagacgcgcggtattgcgacgtcggcacttggaaaggttcttgcggcggcgcgtctggaacaacagaatgggctgtctatagttccacactaaaattaaaagtttaaaaaaattgaactatgtgacgaaaaagttgaaagtttgtatgtgtagaaaagttcaatgtgatataaaagttgaaatctaaacagagctatgctttgcgtagagataccagcggggcggctgcgtgcagttgagccgacatattgtcttccttccctgaccacgctggacggctgtttgtggttgtttctgttgcaacgcatattttctgtgtgatcaaattagcacatgataattcactagtataagtccggccatccttgacgattcatatgtgtcgagctaatgcaacctttttcggatgactcatctctaacggtttaaaaaagtatcatgtttaagatatgactatcggggatggtccgtcaccgatatgtcatctttgtggggtcgtagttctaacacgtcacggatgacctataacgagtcacaaaccatgccccatcaccaatttaaagtcatctttgtcagatcgtagactcgtagttctaacacatcgcatatgacctataacataacaggtcacaaccattccccgtcatggataacatgtcatccgtgacaggtgtaatgagataacccatcaaagatgagagcactcatccgtgacgggacttaattaacacccttcacggatagcattatccatgaagagtgacaatcacgaaccatcacgtatgaggaaaaattcaaatgtttgaaattttcaaacaaccttaaatagagacataccttatgaccttaaaactaataatatttaaatttgagatagtttacatgtctgaatatgccttataagtggtgatagctattttgaaatacgtaattttgaatttttcaaatgatctcagatggagacatagtctatatcaaagtcaaagggttcgatgagatgtacaactttctaattgacaatattttcatttaaagttgttttcatctccgaataagtgttacaggtgatgtgatatatttcaaaaatattttttgaatttttcaaacgaccttgaatggagatataccctacactaaagttctagagctcgatgagatctgcaactttgtacttgaaagcattattatttaaagtcatctagagtttcaaatttgtgtttcatatttggacaatagttaaaagaataacatctgattaccaatcaacatgtggtctgtaggtgagatggtaagattggtttgcatgtgttgagaagtcttatgttcaaatctcatatatgacatgtatgcatataccatttagaatatgctagtaatatttaaaatatattttttagggtttttatatatttaaaattcaaaaattgtaattctcgtacttatgaaccgtcacttatgagagtcatccgtgaccgtcttttatcgataaagatgattgtcatctgtgacggcggccgacccaacacagatgacttttcacataagtgacttttggttcgtgtgtacccctcgccgacacagatgaggcttcccacccattacagatgagctatcccgtgctagtgattaacagtgaaggcaaactccttggatccatggattacagacacaagaggttaaaaaccaaatcacagacatgtgattagttagcaaatactgactgcacttaggcagttagcattgtctctatcactacgagacatgccttcctgaaccgatgccggtccggtctggtcttgataactatgcccgtaatgcatccttcatcaaggtactgctactacccctccacagccattttcatctctacctcttgataatgttgtttccaactttagatctttaggagttactttgggtaactctaattttcctatttctttctcgcttaatgccttgaaacatattgaggtagatagatctaaagtaggaaccaaatctaatgaaaataaccagaccaatacttttgtgtcggagatggatccttttatgtcaagtgatgacgagggcgacgatattgatggtgccctacccgatcacttagtaaaggatatttcagagattgatatggaggatgtggaccaaagtaacaaaatttgtgacttattggtttccactagaaaatctaaatcatcttcaaaaagaaaagagcgaaagactcgtcccaaaaatccaaaaaaacaccaaaatggtttcgtcatgataggtatcttttggaattgcagaggtctttcagatttgactaaatttcggtatgtggcagatatacttagagaaaaaaaagctcgactttgttgcgttgcttgatacaagaaaggacgaaatgtcaaagacaaattcagatcgcctcactggaggtgctgattttgtctggcattgccttccaccaaaaggaagataaggagggtatacttcttggtattaatgtggctatcttggatctatctttaattgtcgaagggggtttttttattaaatttcatatcaacaatagggaggataattttaaatgtattttgatggcagtgtatggtccggcccaagatggatttaaatctagtttcttggcggaatcaatttgtacatgccaacaaaatcatctacccactttaactaggggatttcaacattatgagaagtagtgccaagaaaacaatgatcgatacaaatgctcgttggccttttctcttcaatgctgtgattgatatctttgacttaacaaaaatcactataacgggcaggcaattcacttgggcaaactcacttcctataccgacatacgagaagctagaaaggatcctcacttccatagaaatgggaatccatataccctctggtttcggtccatgctctagatatagaggggtgtcatatcacatgcctatgttccttgacacagaggaagcggctttcgctggaaaccttaagcagttcaagatggaactcagctgatttttgtgggacgattttcatgaatgtgttgtcgaagtttggaatagactagtcaagggtcgtaatgtaattcaaagatagaataacaagatgagcgctttacgtcgatttcttagaggttggtctgctcataccaatggcatttttaaacagaaaaaagctcattttcaacaaaccactgactctctggacatcgctgcagaggctagactcctttgggatctagacttcttcttgatcaatcgagggatcatctcacaagcctacttcatgaagaggagattaaatggtaccaacgcgcaaaagtctcggatgtactcttttgagacaataatacaaaatattttaacccaaattgccaatggcaaacataggaagaagaggatcttctttctacaccaggatgaaggaaaaatagggggctgatgcgttgaaaacatacattacgaatttctacaagagactctttggactaccaaagaaaatccgttttcgcttgatgagaccataactgaagatatggctcaggttacacaagtagaaaataacttccttactgcccttttctcagaggaagaattaaaggaagcgatctttgcaatggagcataacaaagctcctgggtcagatggtttccctgttgaattttaccaaaaatttttgggaagtcatcaagcatgatttgcttaatttatttaatgaattctattctggcggtcttccaagttttggtttaaattttggggtgattactctaattctgaaagttgaagaagcaaatcgaatctaacaatataaaccaatatgcttgttgaatgccaattataaattattcactaaggtcgccataaaccgaattagttcggtgggtgaccatgtagtgaatccaactcaaattgccttcatgcgtgggtgaaatatcctagatggagtcatcatcatacatgaaacagttcatgagctacacaagaaaatgttgaatggggtgatattcaaaattggctttgaaaaggcctacgacaaggtcaaatggccctttttgttacaaactctacggatgaaaggtttcttgcccaagtggatttcttggatcgaatatttcatttccgggggaagtgtggcagtcaaagtcaataatgacgtggggccttttttcagactaaaaaaggcctacggcaaggagaccctctctctccaatcttattcaactttattgctgacatgttagccacccttgaaaaatagggccaaaacacaagggcagtagaaggtctcataccacattgattgatgggggactgtccatactacaatatgccgatgacataatgctttttatgaatcatgacctacataaagctcaaaatatgaagtcggtgttgctgacctttgaacacctatcaggtttgaagatcaacttttataaaagcgaactatattgttttggctaagcgcttgattacagatatcaatataatcaactctttggttgctaggttggcaatttccctttccaatatcttggcatcccgatccattacaggaagttaagaaatgcagaatggaaagaagtggttgaaagatttgaaaacaaattgagtagctggaaaggaaaacttgtctcgttgggagggtgacttgcgctgattaactcagttcttagcagtctcccaatgtatatgatgtcttttcttgcaatacctagcggggtacgtaagaaacttgactaccttcgatctatgttctattggaaaggggatggacataagaagaaataccagcttgctaaatgggacatcatctgtccacccaaagatcaaagggggcttggaatacgcgacctagaggtaaagaatgtagcgttgcttagcaaaaggctatacaaattactcaccacatatggaatgtggcaacagatgctacgtaataaatatttgggatcgcaacctttatctcaggctttttgaatgcgggagactcatatttttgggccaaccttatgaaagctaaactagattttcttaggttcgagtcctttcgtattagggacggctcttaaataaggttttgggatgataaagggttgggtaatacctcattgagagatcaatatccttgtctctataacatagctaagcataaacagtcgactatgtcacaaatctttcaaaacaatcctccgagcttttcatggagacgagatttaatcggagcaaaattagccacttgtcacaatttatggcctcgcatagctgatttggtgttgacacaggatcaagatgaatttcgatgggatctcacccccaatggagtcttttaagtcaattctcattgcttagctcttgtccatacaggcatcacgaatataaatagacgtatttggaaggttaaagtaccgctcaaagtaaagattttcctttggtacttacgtcagggcgtaattctaaccaagaataatctagctaagcgaaagtggaaaggtcatacgaaatgttgcttttgtcacaaggacgaaaccatacaacatttgttcttccaatgtcatattactcgtttggtttggtccgttattcatatggcttataacttaaaacctcctcaaaatgttaatcatatgtttgggcgttggcttacatgtgttcctaaggacatgagaaatctacttttgatgggtgcaacaactctttgttggtccatttggctaaccagagacgaggtaatttttgacaacaagatggtgtcttctcctttgcaggttattgctttagtcacctggtagctacgcacctggcctatcctccacaatagggtcttcaggatactattatggtggtattgtgtcgtttggaacaggtggcacgggagttttttttttttgccttggaac

SEQ ID NO: 13886 - DNA, 3861 bp, Oryza sativa
caaaatatagttaattcatgttcatgtaaaactatccaactttttttaggggaaaatatctatctggatgttcattcatgtactccttgtaaactctttttgggagaaaaatatcttatgattcatggacttttactctgaaccagcatgcctatctttgtaagccaatgtaaacaagtaatctgactactgctctgactttgctgaggcagctggcatcagggacactgtattggcaatcaacgatgacaacttgataacagtaaaatcaacaaggaaacaagtgctagtacaatatcaaatttcaaaaaaagcactctcagattttcaattttaaagcaaaagattcaaattgcaaaacaagtgttaatacaatctcagattttagaacaaggatacaaatttgtaccatgttcaacaacaaaagaactagcaatattagctactaaaaatatatgaaactaaaaatatatgaaaatattccatctataatgaagattttttaaacagactaatgctacacttgcattcctactagaacataacgtttctctgttacagtgccgtgcaacacctatagagagaataagcattaagaaacatagtagagaaaagagcatgattacatcatgtcttgatatatctatcaatacctacgttcctcttttttcttttttcttttttctttctttcttcctagcgtaccacacaaaatactacgtcgtcgtcagatgaaaacggagagcaatggcggcgactgctcggtggtggcagcgccggcgagcaatggaggccggcggagacacaagctggtgccgaagctgcagttgtctccaggccaccacttcgtggtcttggatgaggagctcgttgacttctacctccgcggcgagatcgagcaacgtaggccgcccaggcacccacggacttcatcaacgaggttgacattattagtttcgatccagtcaaattgatcggtaaccaatcttttttaattatttcactttattaacagtgtaaaacaattgatcaaccattgaatacatatatgataattaattaaccatggtgatataagtgcatgcacaacacatgcatgaataattacttgtagagaaatacaagggttacggagagaatatatggtacttcttcacggtgaggaagccgtcgaagacgaagaagcaggacaagccaaacaaatgaatgatgcaatatctaactgaaaccatgacaatcacatgctaattaattagaacgctgaacatattttcccaattaaaattgttacattgttaattctaaaaaatggtaaaacacactatggtacacacatgtgcaaacgtgtgattaaaagtcaaaacaaatggtactcgtttttcaatagtacaactcaaatatacatttcagagatagtagaatctaagcagatagttttccaagaaatcttttactataagagaataaatttcagatcacgaaaggaagcataggcaaaatgatctttagcatgtctgaatacgataaattgaaattaaggatgtcaatcatgctataaaagttaagtttcaatagataaatggatctaataagagaagagcttattgtttctgaatttctgtgtgatatgcataattctgttgtaaactagtgcacatatgaaacaccgaattgctttagaggggtgaatatgaaattcaagatttgccattgaaagtactcatcaaaagtgtttctcaaaattgatttctcaaaattgttattagaaaaccagacctaggaaagaggtgagaagaaaaaccaaaactaggggagaggtgagagagagaaagaaaaaaccgttatcgaaaaatccaaatcgcaaaaacaaaagcggaatttaacttgtggaatttaaatagagaggcaaaaatgaaacgaaattcatcaactcattttattcataggtgttgcaaaacaaccgctcaatgaggagcaaacacgcaccttaacataaatttaaattcaaacacaaaagccactcgggcaaacacactccaaacccacacctaaactctattatagagcatctccaaagattacaaaaatgacacccccacccttgcatccacctctctatttatagttgaaacccccctaagacattgtcacaaatgcccttagggctaatccctagcctaaactccatctcagccactcgcttttccttctcctcaaaggaatagctccggatgattgccacatcatcgatccattttttttctcgctgaaacggatgtatcaatccatgtcctcaccgtcttgccgaatcagaagcttccacgcatcctgcccgagccgctcccgcactcatgattgagggcccgtttggtaaggctccaaactccaacttcaatgggagctggagccagctgaaaagtgtttggctagctttgtcagctccagaactcctaaaagagaggataggagggaggttgacaataatacccttgtggtttttgttgttttcatggtatataagtgataattgtatattttttctttagaatttcttcaaaattacaaggttaaataataattgacaaaatagttgacataattagcaaataatacaaatttttagtacattaataatataaatctcttgggaatggtaggcacataatctggattcctatcaaacctatgaaaatgcatatctggtgcatcatggtcacaaatgaaatgatgcaatgccattgttgccgccacaaccatcttttgctttggtagcggaaagctaggcatatttaggagaactcgccacttcatcttccatacaccaaagcatcactcaataatagtgcgcaaactcgagtgtaagaagttgaatttttcttctcaccagttggtgttgaacctctccaaaattcagggacatgatatctttgtcccttgtatggtgccaagtaccctggacgattgggatatccaacatcgacaagataatatttccctacgattaaaaaaattagaaatatacaaacattagaaatattccaatttagaatctcttcatagaaaaatagacaagacataatatgtggcaattaccttggggagcatgtgggaagatagctatatcggtttccagtgcattaaataacacagtggtgtcatgcatcgatccaggttgtccaatagatgcataggtaaatctcatgtcatgatcacaattagccataacattttgagtggtcaatttagacctaccaatatacctaaccttatcttcatctagaactactgcaaggatatgagtaccgtcaacagctccaatacaatctttgaaatgtggccacatgcgatgatccctcctaattctatcatgggtagtagggaagtttggatcttttgggcgcacgatatcacgccccaattctaccacagcaagcaatacttcttcaaacttcctagaaattgtctcaccataatgcttgaaatggctttgtgctctttggtttgatgagccatcaccaagtatgtatagaaaaattgcaagtgcctccattgtatgcatatgtatagtagattcaagcttgtaaccaaaagaccatgtaatacaatgaaggtgttcccattcatacgaagcatcttatagcattcacctcatgtggctaacgtttcttgcacccattccatcccactgaggcgtgatgtccttggcggagccttttccaagtagagtgtgttataactctctacagcttttctagtcgaagaaagattggatgctacagtttcgaacaaatgcatggtaaactcatcataatcatattcctcatccgatgaaccatcttcactatcacttgacatctacac

SEQ ID NO: 13887 - DNA, 16278 bp, Oryza sativa
  unsure (1)..(16278): unsure at all n locations
accacatgcaactagtttccatacttcacttcgtacttcttcttaagccatgaaaaatgtcctacaggagtgcgcaatgaattgacaaacatcactctttgatccttttatttataaaaatctcagttgcaatgaggtgctcatttgtcccttcaactagcccacaatcctcctccaaggccataacatcctttatggaacaacccagaagatcctcgctcgacctagcaaatgattgaatggatgataatgtctgtgctgagagttcattactcttggacatctcctgtaccatcttttgggatccactcttgctcttttccccttatccatctttgatccaccaccatccctctttatcttggcagttgattcatcctcatcagtttcctcatcaatttcattatcatcggcaatatgaattgcatgagtggtgtttgtcggaatggtgccttgtcctaaagaccaatggtcagcaccagtattgcgaatgtcttcaaacatcttctcaagtagctcttcattttgctagctagccttcatgaactttgcacacccgggtttgtcctgcataacatggcattataaaattgagttagaacataaaacctagtagaacaattcttaattttacacattattataaaatacttaccgatttcaatttcctccaacgttctgcagtcgccatcactgtttgccttgtgttgtcccatcctagtcctgtttgagttctcaatttcttccaatagctgtattcgaccttaagtttatcccgtttattcttaatttgaagcctagtgtacctcaaacttgctattgcggcaaattgttcaatgacttcatcgtacctaggatttgataaatggcaatttggtcgattaccacttactacttgatcaacaaaaagctcacatacaattctagtgttgtggtcattctaatcagcacaatccattgccatcttaacaccttttgaagactcattttgagccatccctgccatccacccaatcacacctttcttttttcaatactaacataaaaaaatatttatatttactgaacaaaggctagcagtactcatgtatgtgcataaaaaaattcactttgtcacaatatgaaatataaatgcaaaatcacccaaagtgttccctttttttccaacagaagtaacatgcattggacagatatatgcaaatcattgcttgcattcccttgcaagcattcataccattctgaatgcataaaccaatggcagcaattcatataatgaacaatcatctccattcttcatatccaaaaataggatcatcaacccctagatgaatgaaccctttatgaatgaaacaatcggcttatgttgcgatgttaatccttatcatatacaaagaagaatcaccctcaacatacatgcaaaatcagcctattttgttcttagtctagaactaaaatcgaaaataaatagaggaaaatagaggagatgtaccggatttgtaccttagggcaagccaccgaccgggagtcctaccgccgccgccgcgcgtcctgagccgccgccctaccatcgtcggccgttccgccgccgcctgcgtgtccccgaggcgccaccgccgtcctgtcacaccctaaaaatccaaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagttctcttttggctttgggccgaaagtcggcccaaaaccttctctctctctccccagcccaagccggcccagtccgcctggagccgccgcgtgcgcgcgccctcggacgctgacaggtggggcccgcctgtcaggtcgtcgtctacctccggccgcccgccgcccgagccctagcaccgcgccaccgccatctccttccaaatccggccgcccctttccgtttccgatgaaattagtagaggggaaatgatcttcgggatcccctctatcttttctcttatggaatcgtcggctaatttcgtttggaaatccgtggattcgagttcgattcggatcgatctctctcctccgaaccctagactttccttcgcatcgccggtcgccgtgggccttcgccgccgcctcctagccgctataaattgacccccaagcccgccactacccgccgccaccctcgccttcgcctctcgtcgcccgtagagccctagccccgtgcagcctagcgtcgccgtcgccgccgtcgctccagccgtgcgccgccgtcgcttcggtcgtcgtcgtcgctcgggaaagccgccgtcgggttcgccaagccgtcgccaacctcgtccgcccctctgctatcgctgtcgatcgccggagcatcgccgtcgtcgtcaagccgaaggtcgccgccgcttcttcctcgtcgccgacgtcgtccgatcaccgtctgccgctgttttggtcaccggtgagttcgccacgacgccctctatgtgttggtgtcctccgttcgcgttgtcgcgccgtcgttcgccggcgagcatgcacgcccgagccgccgccgatgatgacgtcatcgccgacgtcatcgttgccgtccgttgtagaccggtcgtagaccgatggatctcggtcgttcgttttggatggatcgatctcggccgttcgtttccgtgagccgccgccgtgcaccctgtccaccgcgaaccctagccgctgacgcagtaattctcttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttgtgtgctgttttggtgattttgctcttttctgtttagattccgacgtttctggagagtccgtttttgcaggagaagaatttgaagacttccaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttattgattacttgattccttgataccttgggatattataatttgactagttgagctttatatatattggttcaactagatgttagacataattgcttagccatgcttagaaacactagtccatataactgggatacttatgactcactattatttaatgatggcttaatgatagctcacgatggtcaatcgtgattggttaattaattaatttgccaactaaaacttgataatggtgggttgtgagcacatggttttgatggtcgtgcacatgacaattaaggactggttcacgagtttcggttgtgaaacattaaccgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaacggtgtgctgtggtggattgtgttgtgcgaggggtactgtcacagctcctttctgaggtactgtggtggtattgaggcgcatggtgacatgttgtggggctgtgtcttgtgggtacagtggtacatctctggacagagtaaaactattcgaatagtcatgcccgcggttatgggcgggtctaacaatatctttcatgattagtttcacatttctcatcataataaaagatgctataactggtaataatttgattagctcctggtttggaatggtatattcctggtttggagatagaactgtgcagccgggatggttgttcagaatggttgggcctatccaacagggtatgttgtatagcgttggattaatattgtttaattactacttaactattttattaaattctgaaatgtttattaaatgttgtttatgcaaatgaaaccctactatgccatcctttgttatcctatgcacttgcatatttgctgcgtggcttgctaagtatgtcatatactcaccttgcaatcattcatcagaggaggagttctacagtgtgctgatggtgtggaggattaggtgtagccctggtcaagctgcctgtggagtggagtcgtctgcgccgtgtatcttattttttcgctgcttagatctttattgattgagaggaactatctacctctgtaatgatattttattcgtttaataattagagtaataattgtactctattatcaattttgttattgtgtgcctcagttgattcctggacgagggttcacacacatgtaagcgtttggaattttggatagaaattccgggcgtgacacatccgcgcgccgccgtgcgtcgccggccgcgcgtcgccaggcaagaagcgcgccgccaaccctagtcgctgcgcatcgctagcaaacagggagagtatgggatgagggcctgaggggtgaggtgggttaggtagggtagttcactggcattttgttgtaaatatgttaaaaataaaggatagtggatcttttggggtggagtagagttgtggagtagtaaaacccaactccacccacttcaatttttaggagtaactctactaactccactctgaaaatctaaggatctatactgtttggcacaactccggctctaggtaagttggagttgggagttagagctgtgctaaacggcttctgagggcaagtactataatgccccatatgttgcctctaagagtgccatattggattgagtgataaggtggaggagagaaatgaggagagagatgatgagccacccctaaatcaagaggtaacctccatacaaatttcaagaaaagtgtgaaagtattagaggtattggtatgtgtactaaaggtgatacattatatgggttgcctctaagtttatgagtgaataaaataaataggcaaattttgccctaggacatccgaaaattgtgtaattggctgggagacactgtaaaatcacgtcgctgctgatggacaccataaaatttgtgtaatttgctataggacacctgaggtaatattttatcatttcttatcaaaaagaggagagagaaatttcaaaaagacaaaattgcccttagccctatctaatccccattgttggcagccgcttcccagcgccgctcgccaaccgtcaccgtcaaagccgcagccgccggctcgctgatcgtcatcgaaactatcaccgccgcccgcttcccagcactgctcgccgctgcctccgtcaccgcagctgtcgggctcgtcgaccatcatcgaagccgccaccgccgcccgctgctgcatccgctgtcacctccgccgccgcctccacaaccagcgacgacgccgtctccaccgccggtgccgccgcctccacaaccaacccaatggcatgctcgatccgcccttagacccactcatccctgctacgacattgttgttgggcgtcgccgtcgggctgagtgctgggtgtgttcaggtgctgaagatcccgcatgagaagagcgcccgcagcgacggcttgagccttgccgcgccggcgccggtgccatccggtccagcctcctgaagttggcctggagcagccgcgctcctggcgtggtcgcgccgccgagcccggccgcccttgcctgcgcgccgatgccgcccaactgcgccggcacaacctgccctctagctcaggcaccacctcccgcatgaccgcgcagcgccgccccagccgaggcgctacaccggcccacgccatcaccagcgctctccctctccctcaggctcacttgaagaaatagctgagagagaaagagagaaagaatgagagagagaagaataaggaagaataaagaaaaattaattcgaagggtagaaccgtacttacacagccgtttctctctcatattcctctaaaaataataaaataatgcagcggatgtccaggagctaataaccagttttttatgatgtcctacagcaaatacgcgtttttacggtgtcccatagctaattgcatatttttgaattttctgtataaaattttgccaaataaataaatttagaagtgatagtcacgtccaccgtagcacttgcctgacactctccgcgccgtgggtcccgcatcatacggcgcgaacccggcgtcgccacgtcgccaggggcgcccgtgctccggccggcccgcttgacagcgagtgaagccgccgctccacgcgcgcgcctctcctccgtatcgaagccgcgtcgccacgcgtctgtctcccagtcgatgcgcaccacgtcgcctgtgggtcccgcaccgtacggatcctacgtgtctccgttgctttcccacgcacgcggagacggagccgggccgccgtcacttggaccatgacggcctgctccatcttggactgggccaatccggtacagccatgtggcatcctggcctagcccatgatcacagatggatggttggcttggcctctgccaaccaatcacagccaaggttatcaagatcggggatcgggatactaggtggtatcgttttgctcaaagtaatatcgtatcgtaggatcgtatcagagtatcgggatactacaagattttcttttttaagtttaattaatatttatatttattatatatagccattccatataaaaaaatacagtaatgatatatgtcatgcaaacagagatatttatcaagagaaaccactttggtttttatatatttaactgattttcatataaatttgagcatatttagtaacattattttcaaaccatgttattttaaataatattttgtagcatcatagggatcgtagaatcgggatatcacctaagatttcgtaggatcgtgtagtaatgaatagtaggatcgatatactataaaaattaggatactagatgggatcggtaccgtttcggcttagtaggatcgtagtatcgtaagatactaggatacgaatcgggataatgataaccttgatcacagcacacatgcatgtctcctcgtgcatgcatgcactgctcaagctaatgtacacacatgtacttagagcatacatgtcttgggcagggccggcctgactttctgtggcccggtatagaaaagaaaaaaaaaggaaaaggctatatgtactaactttttcttattaaattcttactaacactaatgtgtcatgctataagtgcatctagattttttgtaacttccatctacttaaatcaaacggttgaaatgattgttagtaaaagtttagtaagaaaaatttagtacgtgcagcattgctcaaaaaaaaataaaggcccccattcaccataaaaatacaagataatatttaaaatcttattatcattaatgaatttcacactaataagtttaaaatacaatcaagcagtcacgatatgctcgatcaccgattggtcttctgtctttcctctaagcctctcaggcctgatatcataatatgtatattttaaaggcatctaatttttagagacccattacgatcacaccgtccgcattgcctcgtggccggccctagtcttggctgcaccaatgagccatgcatgtgttcgttgtccttgacacacatacatgcagcacattatacgcttagttgccaattttctttgcgaatacatggcgtacacatcgaccatacgccatgtattatacgctgcacacaaaatacgtcttaattccaatttctttgcgaatttcaacgcttgcagttgattttgcgaagcccgttgcgataacctcccgacacggtgtttgtccaccgtgtgtcaccttgatctcaaccttgtcacacgacttccttatcgttctggatctcaactcctcactgagtttagtcctgatctgccgtcgacccaggttgacaatcagaaatcatgacgtcagtcccaccttgtcacagcttctggaccgtgcaagacctctgctccttcctgagcatagtcccgatcctcgccattgatcaaagttgacttcgattacctacacacatgaaaccaaacatccgattctgagtatagacatcgcaacctgaccgcattagtcgcatgtactcacgttgacaatcgccagcattccaaaccaaatttctcgctcaaaaccaactcatggttacacatttcattgccaattttccatcacaaataaaccaaaaacacacttggtttcacaacatagtaacataatttgaacccatagggcccaaatggatgaacaaccacaggaactcacttattattattttttttgagggaacagtcaggagcttcattaataggaggatataaaaacacaaggccacaggaactcacttaggcaatacagcaaacatctcccgtgcacgaaaactgaagcagatttctttctccagaaatccggcatgtgggcggaggtggagctcgagcgatgagggagcgggcgacgggtacgcaagggcggagatgaagctcgaggcccccaccaccagggaaggaagagagctcggcggcgtcgcacgcgggggcccggcgctcgatggagatgaggaacgcatccccctggcatcagcgcttccctagatgcgtggtgcttgggcagtgaggagcagagtgcttcttcttgatggagagttggccggcggcgagagcatgagctcgggtttccggttgggcagagagaagcgttccaagaaacagaggagaggacgatcgccgtggaatctttgctcgccgcaaattaatccacctccgccgccaatccccacaccgccgcatcgaagacgaccgcaatcacacgcagcacaaatcacaacacacgagaagaaacagagcacgcatatataaaagtttattgttttatttcaaaatcagtgaataaatacatcattagtgttatgaatcatcgatctatttctacaatgaatagtatttagctacactaatcgtacaagtacaactacaataatcacaaattgggagaagtcttgaacttttgatcagagactacggctcggctcgcatgccggctgcttcttgtttcttggtgcgcttcacttgttcttgcgggggcgctcgtgtaccaccccgggccgatcgtcatccaccttctcccagacggcggccggcatccctcctctctccgaccacatgccggcgcagtttccctctcggtatatttcgacaatactaaagggtggctattaagctggaaaagtggatgggttcagagacaagaaattttatacaggttcaggccttcttaatcaagaagtaataccctactcatgtccggggattgatccgccgagtgtattattgatcgtatgatctgggtgaaaatcgtgcccctagaggcaaccggacccctccttatatagggaaggaatccgtattacaaaatacagtccatatcctaacggaatatgtaattacagataaaatacaatcgtaaccgactaggatcttaggtatttccttgacatacaagtttggaatttacccgagtcctcttaaagatattctatctatacatggcaccccataaacagtcggactatacatgccgtgtagatataggttatccataatctccacagtagcacccgagacatttacagtcgacaaaatagccttttctcgtagcacaaaatgataatccgagtgcttcaatttcttctgcattgatctcccgagtaccaaaatcaaagattgtgaagggctaaaaataaataatcgggtgcatcgaatagatgcacctaattaggtgtaacccccgactatgtaagtagctaaaggctaaacatatagtcgaagtgcaaataatatccatccgagtggttttacaaccgaattacccaaagtaccacacagctaagcatatgcgacgtttaataaaacatccagccgactgctttagctttaatataccaaaaatgaagatataaagaggcccgagtaaaaaatactctaaaggtccataaaccaacacatatggcaagaatctaagtaaaaactctcaaaagatctatcaaatatggtataaatatgatatcatgataattgatgagtctaaatagcctaggctatgactcacgccataatcaaaataagcatatatcatgccgagagaatgactgttcaaaaaccaatcatctcaacaaaacccaaacagccttcgcaacctaaaaaggcttacaaaagtagtataacacctttctgtcgggtacctttttatttgcatcgtagtaattccaaggaattatctaactgcgtcaaaaaggattttaacagcattgggccatactgttgtgagcaaaaattgccgaagcaaaaatgcccaagtccctaaggatcacaactagccacgctgataataaaattggcctgaagtactgtacaggcccaggcccattagcactcctgataccctaataacagcagaaaaccaactgccgcttcgtcttccccgccgagactttcgtcatttttccccattctccgctacagtacgaaaccactccaacggaactagggttctccaattctcccaaatccatcttccaaaactccatagaaatcatttgcgcatccaccgcatcaatcccccatccattcccagccattcaccgaaccaaatcatattatccagatcgcatccatggcggaagagagagagagagagctttgagagtcagtgggcgccctccgatgtaacagaggagaacctgaaggagatggtggtgcatggtgttcttctggtaaaggagatcattgggtggcgtccagcatgcggcgaagcattcccaacccctgacacacacgaggtcgtggtattttctcatttcttctatggcaggttctctcttccaacctcaagattcttccggggaattttggatttctatgggattagcttgcatcacctaaacccgaattccatagtccatattgccaacttcatacatgcctgcgaagcatttttgggcatcaggcctcatttcgccctattccgccatatcttcttcctcaaaccccaaccgaacaagagcaagccatgcatagttgggggagctggatttcaactgagaggaacactaagccaaaaatatttctccatgcccttcaaaacctcaaacaaaggctggcatgcaaattggttctatgtacaaaaccccgagcctgcactccccgagtactcgtgtcttcctccggtttatcaggacacttggaactcacttccaatgggagaggaagctgctcaggcacttgccctgatggaccgtatgctgaagctaaaggagcaaggtctgcagggagaacagatcacccggcattttatcaacagccggctagctccaattaaagagagatcccgtacagcctttgaatttaacggcaagcatgacccgaaccatgaagatccagactctcttgactttaaagtcatgaaggagagaatgtacaaaatcttctcaaacgctaccgcagtcagttattcgcacttgctactagtggtgccatacaacgccttcaatcctcctccaccggtatgtattcaaacatttcagcctttctcaaaaacacgcttttgccttctgttaagctaattgaaagttcgaaatatcatgctcaggaattcgccttgttgaagtcggatcttccgatcgctcaacgccgatcacccagccggcagactggtcaggcgagtgggggaccaaaaattcggtctgatactcaaccaaacacctcgaggaaactagccagccagactctcgcaagaggaaattggtcctgagtgatgatgagggcgatgatgctgaaaaaactggcgacaaagaagcgaccggaaaacaaccaaggcaaactaatctgaagaagaaaacatccagtcgtcccatgtcgaaaatcagaaaatcttccaggtacaaatcatttggccatcttccttgtattgctgcttacccactattgaaatagtattgatagcataactcaaatttgtaggaagccatctgacatatatccttctggaaaagactccgagccgactgacatggagacaggcccgtcaaaagaaaccgggctgactgcagaagatcacccgagtgataatcaaccggccaccgacaatgtagaacccagcaacaagcccccgactgggaaccagtcggccgaagctagaactggcgctaatcaggagcccccgactggaaaccagtcgggtacagagccagataaagatatcccagaagtagaagctcaagctaacagccctcccaagacagacaccggtgttgatcctggaattagttctcctgttagggtacaaagacctcctcgtccccgaccggaaatcataacaggtaagcaaacccttcaaatctgctttgatccaacagactttcttcaattgtttcaccattattcatgaatgcctaaggcccgatgattggcgacgaagaagagatcctccagatacagtcagctgaagattctcgcccacccattttagtcaagtggtgggatgatgacatgcaaccacagggaattgtgataaataagcaaaaggaagacgaggaagtatgcctactgaaaaaggcactcggccaagccactcgtcttgtaaatgtaagtcttcctgtacacagcttcaaccatcctgtcagccactttgctcaaatacggataaatttgctttgcagagaatccatctcaggaacgaggcgaagactacgactcttgagagactagttccccatcttggaacccttgaggccacccgaaaccagctgcatgaaactaaagagctcgccaggaagactgaacatgatctaagagaccgaatcaccgagcttcaagattccaactttgagctgagtggttagtcaaaagataattctcatcccctgtctcacttatttatgctgctatccttgtgatatcaaccaacaagaagcgatacagtgcaagccgccaagatatcggaactggaaaaacggatccaagctctggagaaagacaagatcgaattggcaaaacaaagtgactcggctctgaaagacgtcgaaggtactggtactaatacttcaaaacaccactctcatcttcatgcctagtcattgatatagatttatttgtgtagactgcaagatcaaatcccaagctcaattcgacgtcttagttaacaaaatcaagaagcttgaaggagccagagatgaagtcgccaatgccactacaccacttgtccaagccatgttcttcaataacaatggtccgagtgcatttgatgcttccgaaatcttcgacaagctgagaattgctgcggatacatattttaagaatatcaaggaagctggaagtatgggagcgagcttggcattgacaatgaccaagtccttgtacccgaagattgacattgacgccattgatggctttgcagacgagacaagcgaagaagccgttctcgacctcatcaatgatacgcagaaagctgctgataagatagccgttgatgtagttgagatattccaggacaacgacctccagccgactggatctaatgactctgatgatgaaaaaactgataccgattgatgttgtattataacaatgatgatgatgatgatgatgatggaggcacaatttgtacaatactgatgaatttatgctgtgcttgatctttaaacttagctcctgatttcttaaaagcttttatcaaaccttattgagcctaaaacccgtaaaagttgttaaaaaactttcagtcctcattgaccaagccaaaaaatcaaacagggcaataataaatcaggtaagcaaattgaattgataaaaatcacactccattattattatagtagccccgactgataactcaaggaaaaacttgacgttagcagtcaaagtgggaaatacaaaagtaatgcctaagcataaaaacgacaaagatgttcaatattccaagagttgtcgatatgagtaccgtcttctcgcttgagtcggtaagaacctggccgagtgactttggaaattatgaacggtccttcccacaagggagataacttgtgccgatcccgtgtagtctgaatttttctcagaaccaggtcaccgactaaaaaagcttgtgatcaaacattgcaattgtgataacggcacatcccttgcaaatactgagccgactgtattaaggctgcttcacgggcttcttctagtcggttaaggtcatctactcggtcttctccgtagcgctcctcgctgaagttatgaaatcgtaaagattcaaattccacctcacttggcagcattgcttctgctccatagaccaggaaaaacggcgactggcccgtagcccgactgggagtggtgtgcagggaccaaagtacagatgatagctgttctacccacttgccggcatagggttgcagtcggtcgaaatctcgcgcttttattccttgaagtaccataccattggcacgttcgacttgtcaattgctcatggggtgcgctacggaggcatagcaaattttgatgccgaagtcctcacaaaaatctttaaatactccgcaggtgaattgagtgccgttatcagtaatgatcctcctgggtaccccaaaccgatgcacaatattgatgaagaaatctctagccttgtctgccgtgattgtgatgaccggtttggcttcaatccacttggaaaatttgtcaacagctacaaagagatgtgtataaccaccgatagcctttttaaacaggccaaccatgtcgagcccccaaaccgcgaacggccaagataacgggatggtttgctgctcctgagccggtagataagtctgtcgggcaaaaaattgacaaccctcacatattcgcacaattttgtcaacgtcggacacagctgtgggccagaaaaaaccctgccgataagccttgctaacgatggttcgtgtagcagcgtgattaccacatatgcctgaatgtatatcctttagcaattgtcttccctcctccaaagaaacacagcgttgcaggattcccgatgggtttctcttctacagctcagtctcatgaataacataaagtctgctgtgcctggaaatccgctcggcttcatctttatcttgaggaagttcttgttttgtcaaaaatcttatgaggggctctctccagtcggcttcaatcatgcttacgtcttgagtgtccgtggcctcgattgtttccttccgtggtacggttggctcgtagagatgttcaacaaacacatcaaaaggggctgcttctcattttgaaccaaaattagccaatttgtcggctgcctcattgttgtgtcgaagaacatgggtgagctcaagtccatcgaatttgtcttccaacttgcatacctcctgtcggtaagtggtcatgttatcatcaaggcaagaccactctttcataacttgattaacaaccaactgagaatctccacgaactattaaatgctgaatccccaaagagattgcaatccttagtccgtgaagaagcgcctcgtattctgccacgttgtgggaaacagaaaagtgtatcacaatacgtagctcagcctctctccagtcggggagattagaacaactcctgctccagtgcctgaaagcctttttgacccgtcaaaatgcatagtccaatactccatcttctctgcaggcgtgtcttcttagcactcgatccactcggtgacgaagtcggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13888 - DNA, 30507 bp, Oryza sativa
  unsure (1)..(30507): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtggagatcaggaaacaggggagggagagaggttttgccaccgttgttttggagggaaggaaaatcctaagaaggggaaagagtttagcttggcaggtggttctcaggctcaatggctttgagcaagagaatgctattcatcttccaggccatggtttgcctctgctccttcagtttatcccaaggtgcgcatctcttgtggttctgtctcatctcatgtttctcaggcattcctcctctattctgtattctgtctcatctcatgtttctcaggcattcctcctttattctgtacatttctgttccaccttcccattgaagaacttgcaatggtgaaatgcagttatatatgctagtttttgcttagcttctttctcgcaagaatatcattatcacgtgcacttccattatctgacactttggttcctatcattgtttatcgccacattggcctcaccactagtatttgagagtagcagaacatctaatcattcagagttcaatatttagagattgaaggataggaaataaatagtcaacacaatgccacaagacgtacctctcatccagtcctaggaggtacaatgccaactgccaagaggtccagaccctagtaatcatagcatcaattagattgatacactcatttatcaacatgcaaaaacaggttatgtttttagataatgaaagcttttattgaagtcatgcaaaaaaaaaaagggggttatagcatgagaaacttacagcagaacaaagcaaaactttttcaggcaatgacaacattatggaacactttgttttctcaggcaaccagcaattcagcttaaggaatctccctaccctccagaaggcgagcagcttcccagcgatgcgccacgagacatacgactacattgtcgtcggcgggggcaccgccggttgccccctggcggcgacattgtcgctcaagtacaaggtgctcctgctggagaggggagggtctccgtatggcaaccgcaacgtctcctacatggagaacttccacattggcctgagcaatatggcgccggactcggcgtctcaggccttcatctccactgacggcgtcatcaatgcccgagcgagggtgttgggaggtggcacctgcatcaatgccggcttctacagccgggccagctcaaagtaagcaattgcattgcacagatatggatgctatcttgtgtatcagtattcttacctgattatgattgttctcttccgtctacgagtgaccagccaagagagttcacagttcacacatgcaaatttaaccttttttttactgccgaagtgcagaatggtcagcattaatatatacacacaaacatatgcaagagaattcacagttcacacatgcaaatttaacctttttttttactgccgaagtgcagaatggtctcaatcatgatcaagacttcagatataatttactattatattctttaccataagagggcaagcacaaatagcagagcctaaaatgaagttagcataagtagattaaatataccaagtagtctctcagtatatgcaacacatggcctatcactttcacatgaacaaacatcagctctagggtaaatgcagagcagtgatagtgccagtagaaattactaatggtaactggtaagatctgcttgactgctgccaccctagcatactgcagccacctttgttcacccttcaagtggagtaatagctgtctgctgaaacgtgcagcagaacactaaatattattcactgttctcaatagtagcattcaattaccatgaaaccaaagtttctgccaattaggattctctggctacaacctcttgtttcttttctccagcgtccaaatggaaaagggaaaacggggaaacaaacaaacactaattagtgtagctcaaataggttctaatcgactaaaatgagccagccaaaagacacaaatgcataaaaccaccacctgcattactagcactcactctagaacgtacccagcactgcatttggacatgattatcggttcactaggactacatattttggttggtatgattctagacttctagtttatggttatcaaaatgcaggctttctttgagatttatcacaatgcagctctgcaatatataacgaaataaaatccagctgtaaaattagcaaaggttgtactttgagtgcttgcatacaaatgagcactagtgagaaagttgataacataaagaaaataagcagattgcaaaagtggtttgcattaaagtgcttcagtctggtattgcaaataattaactacgctggcagcagcacatgctgtggttttctcagtgaataaaaagacttccttgctcttcttgcagtcatgaactacatgttactgaaacagactagattgaaaagagacattgatgaaaaaaaaaaagagagagacaacaaaacaaaatcacatggggctataattgtttctttgcagtcatggtaactaagttgtctaggcaaaggacactaaataactaaaaccctagtagactcgaggctacttcaagtttgggccaattagtacatatgcattcgaattatttgtacagaatcgaattacaataggtcaatgggtgggccccacacacccgtgctcatcagtcatccctagtgatatacctgctcattaccagaaacgccaatgtgacttaaaaggtatcaataattgataagcttaatcccgtagtcttcaagaaggaattttacttctatattgatattcatattggtgaactacatgttaaattgttattggtgaactacatgttaaattgctaataacttgtataccatgtgtttttgttcttgaaacaaacagcttcatccaggaggtaggctgggatgaagacctggtgaatgagtccttcccttgggtggaggacaagatcgtccagtggcctaagatcgcaccttggcaggctgcactaagggatgggctactccaagcaggtgtatctcctttcaatggctacacatatgaccatgtttctgggaccaaagttggtggcaccatctttgatgagactggctaccgccacacagcagccgacttacttgcagctggagaccctaacaacctaagggtgctgcttcatgctagtgtgaacaggatagtctttaactcgcagagaggtaaataattacacatgtgtggccaaagctcctacaagttgtattatcttctaaaatagagttatatagaattatatgccatgaatagaaagagtaagttcagtaatcacgtaccatatttcagatacaccatttctgatgcagggcaactgaagccaagagcaaccggagttcagttcaccgatgagaatggaggactccaccaggcattcctcaacagcaactgtgatagtgaaatcattgtctctgctggcgcaattggcagcccccagctgctattgctcagtgggattggacccaagaatgaccttaggagccataaaattcctgtagttctccataacaagtatgtgggtaaagggatggctgataaccccatgaactccatattcataccgacgaaaagcccccctcgccagtccctgattgagactgttggaataactgaagctggtgtgttcattgaggccagtagtggttttggccagtcaccagaaagcatccattgccaccatggaatcatgtccgctgaggtatgtcatcaatcttacttgcatcatgagaagctttttgtgcataaaataggtctaaagcagtatcacaaacatcaggaaaaagctgctgcttagatctgcagacttcaaaaaggaaaacagattctaaagtctaaactatcaaaactcacattttgcaacattgcaaacacaacttagaccaattcattaattacaggtgaatatgcatatgcatataatagtatattctaagaaataatacttatctgatttataagtcattgttttatgcttagattttctaggaatcagatctcagaattgaacttcttgtcttggagattaaaaaaaataagtgttgtctacattgcaacaactccaataactgccatcatagtttccattgttgtctcaatttgttccctacttggccttgttggtctaatacatattatattcctatggtacagattggacagctgtccacaattcctccgaaggaaagaagcctggaaaaagcacagaagtatgcaaataccaaacttaatctacccaaagagatattccatggtggttttatcctcgagaagattgatggtccactgtctacgggacatcttgccctgatagacactgatgtcaagaagaaccctgcggttaccttcaactacttcagtcatccacaggatctcactcgttgcgtctatggtatcaagaccattgaacgaatactgaagacaaaccgtttctctgaactgtctgccaacactgatggacattcaatggaaagagtgctcaatatgagtgtgcaggctaatgtgaacttgatacccaagcatacaaatgacacagaatccctagagcaattttgcagggatacagtaataaccatctggcactaccatggtggatgccatgtagggaaggtggttgatcagcaacaccgtgtgcttggagtttcaggcgtccgtgtagtcgatggctcaacattttctagatcaccagggacgaaccctcaagccacggtcatgatgatgggcaggtacataaacacagtaaaaaattaacttctttagtctttacctaatgatattctaactttaaactcttaaagactaaattgcttccctcatatttcatactcagatattttggagtgatgatcctaaggggaagactaggtcgagcagctggagtgtaatcgattcctggacaccagccttttgttatgtgtgacctagagaagaaaaattactaattattgctgggatctagtgtgattcaccgaagaaagacaagctaggagtttcatctgtacccagtaatcatttgtgtcatgtgatattgcagatcaaatggtttattgacccccccccccccaccagtgttttctgttccttcagctggatttcaaggaagtcctgatgacttccttttatggtccctaatcctacattagagtccagttatccatacaactgttacgggctctagtgtctctggggcagcagccagcagcaagtagagacaccccacacgcaagaatcagcaaggccacctccaagtgagggaagaaaatagcagattggagattaaaatcttagttggtttggttaggagacgagattactttggttatttgattagattctcttgttaggggttaacctcatctatataagtgaggacccatacccttcattgcggaagcagaaatatacaagttcatgctagtattccccttctcatttccaaaggcctcagagcctctctttcacagctggaagcctggaataagccctgccagcagctggatccctagcctcagtccctcacacccgtatccaacccaagcaataatagccataaagaaaatctgtttaagggggcaacagaaagataggaaagtattgtttcaaaaacaatcaattggaaattttattgcattgggaaattataagatgtatatttgctacataagctccctctatagagaagggagaataaaagaaaagcaaaggctcaaagcaaggagttcaacagattacatcttgtaataataattttactaactgaaaccttagaaaatctgtaaacatatcctagctgtgcctagaagacaaaaaaatgtcgtgtgtgtttaaaagaattaatagtattagagccatacaggtaccctgagaccatcatagctcagctggatgtcaagcccctctgtctccatcaacttggcaagttcattgtttactttctcgtgatccattaaatgcatcattcctgaagatatcattcagtcaagtcatcaagagcaacatcatgtaaacaataaaagctacatcatgtgaaattcgatcaaattaaacgaccttttcttatcatgtccataaacaagaaataagtagccgaactttgatgctttagttctgaataaactggagtaacatgaatagtaatagttaacttctgacattgaaaggttctgaaaagtgaccaacatgaatatttagatctaagttactatacagatattttcttcttttatgtgacaagcaataggagaaaatatcaaacacaccattggaaaacaaacagcaagctcggcgtgagtgattgtaggacaccctcatcatgcttattgtgcacatgaagtaccaaattattgaacagttaactaaggagatcatttttttagtatattgccccttttttcctttctgagattaaattctgccaatcaatagaaaggcagataagctttctcaaacatgcaatagaacaatgtaccttttctcatagtaaactgtgcattctgttccagagtgattaatgtttttataaattaacatgaaaagttaaagtgcacatagagtttaaactgaagaagtctagcagcgttaattcagtaaaggcattaaacgagcctcaaaatgattaccagtaaacagtgttttctttggtttgattttcctaacttcctcaagggcctgcagaagtgaagaatatatcaccatggaatacagtgaagcaataagaagctagagctgattgatatattagaactaactacccacccgtggtaatccaaagtgtgttgaagaagaacgatcgggtctaagagcatcctggacataattataataaaatcaagcttaaatccagttatacaaaaagttaataaaaacactaagtaacataagaaaatatgcagcttcaagagaatcccataatctcatgctttaacaattcacatatatatatagaaaaagttataacgtcaataccattattagaagttcacagtcttccagaagtttgtaggtttctttaggtatatcactgacatcactgtgtacatcagagatattaagaccatgtgtgttgaacttgaaccaacagaatatattgtaaaaaattagctttgcactttgatctaccttatgtagcatacacgaccaaaacgaaaaccaagagagcggtaaccctgaccatgccagacaggcaaaggaatgacctgaaaaatacagaaatcatatcttcagcaaaataaattagacagggtacactcgaaagtacacttagcgcaaactgacataattaaaaacatattaatttcgtttggacatgcaatttaaaaaggcacattcaaaattacttaccttatagtttacatacttttggccaacaaatcgatggtcacaggtgtctaccggagatcatgaccaaaacaacatattttgagaacataggatgtaactaataggttcatgacggatttactaacatttaactcagaacaacattggaattcaaataactcaaagtatagacatggtcagttaattaagttatgatagtaaacaaaaataaggatatagaagtaaatgtatccttttattacctgcctacatagagtataaagtattattacagtgcagtcaaatgagttgagaaaaagaaatttctttgcggattgaagagctaattattgctgatagcgtgtggtttatgtctacttcttgcttacataaattattattttagacaacagacctcaaggttatgaactgtaaatggttcctctttaataatgttgaattgcaatgctgaaactgcagctccaggtataaccacacttgtgtcaatcaaatagtagtgagtcatcttcatcacctgatagcgaacaaatagtacaagcatagaaagaaaagtgagccagtggcccagttgttaaaatcttgcatacataaagagaagttgtgagtttcatttcaattggcatgacagttgtctacgttaggaatgaaactttctgaggctgcaattctagagaagcaaaaacaaaactacaaacatagcaccaacctcataatcacgttctgctacataaatcgggatggtgggctggacattgttcgtccaatcgcgaagacaatcaaggcctgtaccaaaggagttcttatttcttttagaaagctcaagagcaaaacgagcatggtgtgttgtctcaatcaatattaataaagttgcttgcttcaataaaagtatttgcaaacctccgattgcatccgcatgagaatgagtaataatcacagcatcaattgtcctcaatctgaatgtcagaagctagcgtttaacaaggctaaatttctcggaaacaaatatggagcacgtcagcagttcaatacccataagcaggaaaccactggagcgcagagtggtagaagaacctagcagaggaagcagagaaaaacacagtggtgtctcattactctctctcactctttttcaattcaagaatgataacccagaatggaagagaaatgaagcaaactttcagactcccagatcaaccaaaggcgcatacttacttgccagcgtcaattaggatgttcgccgtgccagacggcgtggcatggcgcaggaggatggacgtgttgcgcctcctgttccgattccctggctcggctgccttggtacagacctgcgtgcaggaaaggacaaagaagaaagtgagcaaatgacattgagcaaccaatcaacacaaagtatgacatagaaacgacatcgcgctgctgcaatgaagagggtggccgtacggtgcaggtcttggagggattggtgaggcagctgacacgcgggatgccctcgctggtgcccgtgccgaggaagatgagctccgactgctgccgctgcttctcctgctcggacggcgaggtggacaccgcgccaccgagggacgcgccggcgctgcacgatgttgaggaggagaaggagcgagctggaagaaacgggagcaattcatcagaaggagctaggcattacgtcgaacagctgaggcgcgagctgtatgtacgtcatacggcagcagcaattcacgccaggcaacgcaccagagctgaggcgcgggaggtaagggcagaacgatgacggcgcgatggccgccgccgtggcgcggacgagaggagggagcccgcgcgccgcggcgaggccccgaatcgagcgcgcgcgcggcgccggcggcacgtgcgcggcgcgcaggagagcggcgatcgcgcccgcacccgcacccgcgccggccatctccggagaggatagagagagatacggccacggttcgccggcgggctgtggcggcgggcggcggcggcggcggcgggcgaatcggggacggtcaaacgacgtctcggccaccggccgctcgcttgtcgcgcgcggcggggttggagacggagcgacacgggcgacgctgacaggtgggccccgcgtaaccgcacagaaagtccccgacctttccgtccgttcagcgcccatcccattgacaggtggggtcaaagccgatatgggcctagtagatgtcagagggccacatgggcctctttaagctagttttgggtacattgggcttttgtgttgggccggcccaagaatattccgttcctccctttcccttctccatcgtctgggttccattccacgaactacccaatccatccatccgccgcgcctctctctccttcatcatcaattccggtgaggatatcgccggatcgacgcgccgccggcgggagccagccgcaggtgcgcaactatatctttctgtgtaccccggcgacatgttctttttccatagttaggtttgggatctgacgagagagagagagagagagcagttcgtatcgttttagcactcgccgcgcagggcagggatccgcgtagggttctcctgatctggggatggggaggattaggagttagggcttcgatttgggaagctgttgattccggatcagtgagctctcgatcaagagtactacctgcagactgcagtctcccgaaaaaaaaaacaaaaaaaaagagtaatactgtggtgatctgattatattgagtgtacattatgttttcttttgcttgccattgccgatttgatggttcagcactgacagccgaaaaacagttgccctgtgcaacgttcccagtgtattatttggctggatgctgcaacatttagcaagcagaacggtgaggaaagatgattaaagtctttttatttgggcatgatgtcaaacggtgtatttaccattttcgctcgattggattaaggcaaatggtctgctatttacctttttttttttcgggcacggatcctgcgtagggatgaatggcaagtatcaggttttgtgttgtttatcacgggctgaaatcctgaatgctcttgttggaattttgtgcagagtggagcttggaataggcagctttctactgtgaatcaaaagcgtgatgaacaaagataaagttcatgacaaggagactcacagaacgagcaacgatataagtcataaaacatctgtggacaaggttaaggcccccaatctgtttgaacgagccaaggaagaggttgaggctctcgttggagctgttcatgataagatggagcacaattccagtccccatggaaataatgctggtaatttgtttgaaccaacggtgttttccgtaatttaatttctgtgaagatgctgagcaccttttattatccccagaaagaagagtaggattttaaactatctggcagaaaagatggaaaaaaggataggatagaggagcatcggctaggcccaaagcacccagagagacaattcacatctaagcttaatgttaccatcagtccatcacagtatcgcacgatcctttgcctcatcacctaagtcacgaccttagctgcttaacaacaggaccaaaaaacacaaagctcatataagataaacgcacaagcttaagctcttcaatgcctaataggccgacacgtagttcttcagtaattatgtcctacttccttcgttttacaatgtaagtcattctagcattttctatattcatgttgatgttaatgaatctggatagatatatatgtctagattcattaatatcaatatgaatgtgggaaatgctagaatgacttacattgtgaaacggagggagtacaaaatctgatctagcaattatgcgctacagcatactcaattgacaattgctaaattttagcttgatgttttttaccttgtgtattgagttccttgtataatatgatgggtcattaatcatgcattgggcatatatcagaatttatttctctttgttgaaaaagtctggttttctgtaacaagatttttctgagataacacaaacacaagttcaagaatattagcatcttcatttttctcccttttattgcaaaaacatccttttcagtaattgtttgtcaaatttgatgccaccaaccgactttaaaacatgatgcagctaaatcatgaaactttctggaaatcctttcaggcataaaagtttagatatgtatgccctaaaaatagtttgaatacaaatactttgcttgaattccttcgaagaatttgcagcacacaaaaaaaaatcaacaatgacttgtcagctctttgtgtgtgatattcatgcatgatggtcagattcttttatgcattgattaaccttatcttcctgtctaatgattatgatacacaccattacaaaattgtgtagacctgcataaggactcaaaggatgaaagcaaggtgtcaatgaacaaaatagagacccacaagaatgaaactcatggtacaagcgatgatataaatgagaatacaccagttgagagagttaaaggtccaaatgtgtttgagcgtgccaaggaagagattgaagctattgttgaagccttccacccaaagaagggatctgacaagtgaagattgagatgttctgttgcctctgtctgcacttgatgtgaaaacattgacatgagttattaatagatccatggatgagttgtgagatatccatcggctggtcttattattgccaaactatggagttgtaactgttgaatggttcattgtaccactgatatatatatgagcagagtgtgtatcatgtgtgacatgaaagtattactgttcttcagtgtttgattttagtgtatgttgaacttagtcctttgcatgatatggtattttacttgctaccatacatgcaaaaatcttttgaggtgcataaataaagagagagtcaattgctgtacaattttataaccttatgctaagcctgtggtttgggttcaacatgcttcacaaaataacagcatttccttagtgaaacaagacagaaacgcgagatatgaacgatatgatacctcaaaccccatgttctttgaaaaataaaattttgagttaaatgttggtgttgctacacctagtagtatagagtcttgaaaaaaattcctctcttttgatttgtgtggtttcaaacgcttcatctaattgatcattcctgttattttcctatccataagatttgagggaactatttcgaaggatcctttctcaagactctaaacggtgtgattttcttaaaactttttgtataaatttcttagaatactgttctaatatttttttttaactttatactccatccgtattttaatgtatgacgccgttgaatttttgacaaacgtttgacctatcgtcttattcaaaaaatttatgtaattatcatttattttattgtgacttgatttatcatcaaatgttctttaagcatgatataagtatttttatattcgtataaaaaatttgaataagatgaatggtcaaacgttggttaaaaagtcaacggcgtcatacattaaaatacggagggagtaacatttatttaatttgtttgttccctcgaataattatcgcaacattacgcgaagcaacaactcaaatagatatttcatattattttatcaatgaataagatctcgtcgttggcttctcatcacaaaaaaaataaatataaatttattagaatattgttttaacctattttttaaaactttataacagttattttatttgtctgtaccctcaaataattattacaatactgtacaaaaacaaatcaaatagggatttcatattatattttttaataatgaatagatctggccgttggtttctgatctaaaggcccagcccaaccagccgctgtctcttccccccactcctcgactcgctctcgcttccgaagcagcggcggcggcggcggcgaggcgagatggcggcggcggcgttggcggggatggacgcgcgggggtgggacgaggcggcgtacaggcggggcatcctgcgggagcgggacctctcctgccgcaccctcttccgcgccgtcttcttcgaccaccacgacgacgaccccgacgtcctcctcgccgccgcctccagcgacggctccctcgcctccttctccctctcctcctgcatctcctcctcctcctcccatcccaccccacaggttcgttcgttccccacacccgctccatgtgccgcgtcctcgtgcgcagctaaggtgttcgatcttttgttttgatttgattggattcagacccacccggatgccgcggtctctctggttgatcccgtctgcatcgtccaagcgcacagtggcccggcctacgacgtcaggttctacccggattcgcagcagccgctgctcttcaggtgaattgctgtgctgctgctcgtcttctcggtggccgtttttgttcaggtgacatggcatgacatttggcgacgtgatccgttggttgtggcagcggcggggatgacgggcgccttcggggatggagatggcacgagatgcagagctgccttgtgccgctatctctgcaaggtgctgcaaaagaaccctcacttcttactaggattgacttggttaattagtttggtgtgtgctttacctagaagttctacctgtacttgcttgcgcacaccccacaaagaaaaggctaaatttttaacaaagatgtaaaacattttgcaagtcccatttccttttctagtgctctagtgcatgttttttttgtggggctaatgcatgttgtttaataggttactttgtcattgcttttctttccaggggatcatttggagccagtacttgatttggtgaaccctcagcatgagtaagtattctgtgaaaaaggacatacatctgataatcatttgacatatcgtttattctagagaaatatgcacttgcactctcatcctccatcttttcagagcttttgttttcgattttgtaggggtccttggggtgctcgctctccaatacctgaaaacaacgccattgcgattaacaaacaggtcaacaccagaaagtctgcattttcacttcatccaaagaagcaaaataatctcttgtgtgcatttttgttcatcgtgtatattatatagaaatgatgcatattgttacttgcttaaaaaaagatatcttattcagttattctttctcatcattcttcttcgcaacaggaaggatctgtttatgcagcggccggggatgcatgtgcttattgctgggatgtggtatgtattttcttgaggtaaatgcaatatatagaagtcctgagctacatggaaggaactacagatttcttatgattcatgtggcacaggcttccataattttctattttctgtgtgcctgcttgagaaaatatctgatagtaggttttacaatgtcttgttctttcaggagagtggtaaatgtaaaatgaccttcaagggacatactgactatttgcacagcattgcagtccgcgaagcgaaccgccaggttggtttgttattattgtactgatgtagtccaataccattttcccatagatgtcttgccttcattttgtagtaacttttagttaatagagcctttcctttttcaggtagttacaggatcagaggatggcacagcccgtatctggggtgagcagtgcttttgataggataattttgtcttgtacttgaagtgtgccttctcatgttcatcctgttctaactggtcattttgtatatctgctcgttgattcaagcaaagaaaaagcaccaactagctatttgtctttttgtactctttaattcacatctggtgatctggtcacaggtcacatcatattcacaaaatttatcctctctcttatgagtttaccttcagacaggtttagaaagatttggcactacatggaaatccataaaaaggcattctcttatttctgctctttgtgcactgcagattgcagaagtggaaagtgcactcaggttatacgtccggtgaaaaacaagatttttgaggggtcatgggtcagttgtgttgccattgatgcaagtgaaagctggctggtaggatgcacttcaagctgatataacaatgtgttatgcatcatgtattttacagttattattatcttggtcctatttttcccaggcttgtggtacttctagtggtatatcagtttggagccttctttcaaatgagtgcatctttaatgtggattgccatgctcctgttcaagatttgctgtttgacagaaaccaagtaagtctatctattcgtcatgttcaagctagagtttagcaaaccagtaaaattgcccatggttagaaatggctcatcttgtatttcaaagatgggctggcaaaaaatttaggacggatcattccattctttagtctttgtgagtttaacaaatgctatacctgtagtaaattagtgttcccctagtcaattatttccattaacaagtcatatgatagttccacaagtgcatgatttatctatttaaccaatgccctttctaaatttttttatgcataattgtttgccaaatgaaagtttgcataattgtgtggatatgaaattattatcagataatctctcagatatgcacagaaaatgcaataaattatttcctgatgatttatgacatggttgccaaaatttgaagctttgtgatgttattgttggagagaaacagaataaaatcaaaagcttttgcttccaaacaaatataagagtgactcttcagccaactagttattattcctgcaaggaaagctttttattattgtctgctcacatctattagagatttaccaaagcaatgttgagtctggcgatagacaatagagcagcacgaaggatgcattgtttcccaactcttgtggtttaggaattatcaactgtttgttttcttatactccattttcaccattcagatcttagcagtcggtgctgaacctctgctctctcgtttctctatcaatgggactcttctttcacaaatcaagtgtgctcctcactcagcattttctgtctccatacattcttcaggggtatgtctgtctgtctcttgattctcattttgaaatgacttgggtatctgtttcaccctacttctggagtctggccgatttgtcctgagtttactacctttgttgtgcagatggcagctgttgctggatatggaggccttgtggatgtaatatcacaatttgggagtcatttgtgcacttttggctgccggagcctggataagtaagatctattggaacaattagctaagcactcttaatagtgtaaagaactggaaaaacactgccaagatctaattaagtactactactagtaatcatacacttgggagctgttcagctgtaacactagttcatctctgtgctaacttatgtaattcacagttgtgccgttgctgctccgatagagatgactctagatcccttaagtttattgctgttacaatttccctaatgaattcccttgtacggattacctgctggttgctgcaacactgctctctttgctgactttctccctccatcccataaaatacaaactcaggataggattttaagatgagatgtgacacattttaatattcttcagattattcttagatagcctatccaaactcaggtttgtctttttatgggacaaaaggagtacatcagctttcctttggcatcacgtggcacttgtttctctttattaggcaatatttatcacagctccatatctagatttaaaatttatatgttactacctccgtcccctaatataagggatattcactattttttttttaacgtttgaccactcgtcttattcaaaaaatttgtgcaaatataaaaaacgaaaagttgtgcttaaagtactttggataataatgtaagtcaaataaaataaataataattccaattttttttttaataaaacgaatggtcaaacaatgcaagcaaaatgtctaaatcccttatattaggagacggagggagtaaattataatcacttaaaaattatatttcatccaaaaatggaataaatatttcattcagaagtaatcaatgtaattgccgattgaaaaatctatggatttgtggaggtggaaatatccaactccaaaaaaaaaaaaaaccttagatccaaagttatgctagctctaaaacatcttagatcggaagctatgccaaaaatcacagtaacctttagaagttttgatgcataattgatagcaccttcgaagctgtaagcctgtaataacaaattcttttaggagttaccaagaatgagtttatcttatgtctgagatatctggactgcaaaattcagtagcaaatgcacgagctgacagctgggcatattgacttctatcccaaaggataacagatcacattcttgctgattacagcacttggaaagctgaccaagatttgacaagaaaaaagaccaatttggcaaatggaaattcatagtgtcacaagcgtgcctaggcctttataatacaaacaagagctgtctaaaccagcaactaaaaatacaagtttttattatacaaacaagagctggctactccagcaactgaaaatacaagttttatacttaatacattgttgatgtcgacggatttttttccctagttccaccaccactgaccccatatatgtacaacattcgggcaaacgcatgcaacatacagaagcacccagtttctgaaaatatatacagcaaattcatcctatatgtacatgaagatatgaaaatatcatcagcaaggcttccaaaccaacaacagaacagatatgaatgagctccaagaatatgatcttcattcttctaacatcatgaagcacatacctgaagctttatctatcacctattcgatcgaagtgcgcgctaggcgttaatctagccatggtggtagatgataatggaacttacaacctgggcaagagccacccgagagtccagccgagaagcagtccagcaccaacgatgcctacaccgaccgcaaacacgacagccttgcgcaagtggctgtccttgttctgcttccttcctttcttccttgttccatccttcctttcttgccctggcgtcaccttttctttgagcatgatccaggggagttcagggaacatggctgctatctggtgttccttcaacctgagctggaggcatatgttctccagctgcagcattttcagccattgcttgcacgcaaagagatgagaggcctgacggaataatagcttgatgacatggtctttctcatcataagctttcttggcagccatctcagcctccctcgcgcgtgtttgtgaatggcggagtgcatccagcaactgggtcctctcagcggcactccgatatgtcggcttgctgcctggtgtgcgatcatcagaactacaagaatcctgtgtacccctgcatccgaatgcgattatgtcaatatatggaccataaccaggaagaagcttggacaaacaaattggtatctgggactttccagggatgagaaataacacgacatggaaggcatgcatgactaccattacttcaattttggatcataacaaggaatcaaaagattcacacaatttcatacatacaaaatcggaataaaatttgtgtttgctcattttcagaactagtttcacacatacaaaattggaataacatttgtgtttgttcattttcagaactagttcgtaatgtgatacgtgaaaataataagccataagatttatccttgtaaagcaaaacatcggtattctaaaagtgggtctactgggctgttcacaaggaacaagcacacctacttgttatcacgtaatcacctgtttggccctctaaattggccagttagaccggatttccctaggtttgggaccaaacaaaaagccacataccactttcttaaaataactagtatcattaagaatttaagacggcgtgaatccaagaaggaagacaccggcaaatcatagtgaattccagcgattgtgaaagaatataacatacccacgtgcatcatttctttgatgttgccagcctccaccatcagatgaatttgtctcattggtgcttgaaatgctatagctgcacagcatagtgtcatactgcactggaggtgattctttgccagtataaggtccataatcatccttgttttcatggttgttcaattttgaaccatgagcacgttgggtgggtcttggcagctcatttttgcctacgttgtgcatttcactttctgcaactacggaagccaaaccatccgcttcagctacctgccaccatggccgagacttcctgttttcttgccaaggtgcatccatctcatagcatgccgtctgtggtttctttggatacaaaggatcaaaagttttgaagtccatatgttctttgtcctcatgaagataggtggcacttcccctgcatttgagggtcatttcagaataggcaggaagactcttgagctcttcaaaacctgtctcatatgtttgtttcataaaagctgttgaaactatccatgggggctcaaaaggatcagctgttttcttaggattgatgtcctcaagtttggacactggtgcgaaactttcgactttctttacatcaacttccccacacatataattcaggtcctcgctagcaagcacattctggcacccaaaattgggctgcaactgaagccaccattgggtatcttttggcagattggagttcattgcattccagtttaaaggcataaagttggggatatggcagtcttgcggatttgtttgatttccattgttggtctcatgctgttgcccagatggcgggcagcaaccgagtttcggagctctctttgcgtcctcttgaacccggcagcggttagcagcacgctgccaagcagcccttgtttcagcagctgccattactcacatgctaagaaactgcaccctgcacatcagaaaaattgtttgtcaatgtcctcagaaaaagttgttcatcagcactacttccatagaagctctaaagaaaacaaatgatagtattaacagcctattttacaatgttttcatgacagaaagtgcatgcatcatccacgctagaaaatttgaagaccgatccatcaagattcatgaactgtttgctcaaaaagaatctacaaccataaaatgaatacggacaagcacaataacgagaagacatgatgctcagatatgcaagcaacgtcgaaataaatgaaatgaaatgaaatgcccatggcaaagaaaacaatcactactaattacagccagatttgaggcggtaaacgattatccaattctccgacagatttcactgatttgaggtaagggacgaatcacagatgcagaaatacagaaacaggtcgaattcttcgaactaggaacatttcaaagtacttgactggaccaaatgggcacgcaaaatgaaaactgaacccgagatgctcgagcaagtcagacaaaatcgaaagattccgaatctccgattctcctcgctccctcctcccgatgatccgattctctaaaattttacaggtgaaggcaaaagccacctcacctggatcagcaaaagactcggaagcttgaacaaggctgcaagatcaaggcaggttcttggacgaagaggctccaacccgacgacgatgacgatgactccttcggatcaccaccatctcacggccggatctcgcagctccctcgccgtcgccgctgacagactgaatctagaaaagcgaacccctaaagcggacaagaagaacacggagaagagaggaagccaagggagaggagctaataaagaagggatctttgctcctctccggataatgacgtgaaggcaaagcaagcagcaatcctaccagaagaaacaatccatccagcaataataatagtagtaataaagatttcaattactcccaaaatcaaaactttttataaattggcaagaaagaccaattaagctgccgtttctgcgctgctcaccgcccctgaaagcgccattttttctcccacaaagattggatttttggtccggttcttcctctcccaactcccagattttttatttttgttcttctcctcgccgtgtcatctcattttctcactcatttttcattttttttgttggttttttagggggagaggttgtccaggaaagggggcaaagatccgtgccgtcccgtggcttcctggatcaatttgggtgatgagaatctgagatatccacatccatttatgggagtgacgtgggcttctctcccgctggtgaggtggggacaggtgtttccttgctgatgcagccacctcaacccccactgatgagtgttgtggcaaagcagggagccactggaatttatttctcgaacccctctctctctgccgcctaaagcaatggaagtaagaactaagaagaaaagcaaatggttcataggaaaaagaaagggagtactgtatgctgtgatgaagtgctgagtgactagtcaacttttttttaaagagtacagtaagaaccaaaagagtacggtttgagttttttttttttttttttttgcgggggagtacggtttgagtctatataaggttattcaaatttctcaatttaactttgagagtgaactttagaataaagttatgaagcggcttgaatctcgatccatctctttagttatattttaaatcattttaacccattccatttttttttaagttgagttacaacagtttaattgggttccagcattaaaagaggtggatatcaaataagcccaaaacaaattgtaatatgcattgccaatacatcataagtctgttagtgataagtcataattttaaaatcgggacactaattttacattaagtaattttatgagatattgcaaatttatagtgaaatttaattagttcgcgtgcactatttaaacttacggcacaaccctagtgccctccttccaatccaaaaatgttagtataatctgttagtgggttgaccagatatgtcactggctaattgggttgtactagttaaattaaaggtttgatacatagaaccaacatcactaatctattttttcttaatacaaacctttgatggtttatatatttcaaaccatgtattatttataaattccatttaaaccatcttactctacttaaaaggtatgataaaacgactttaatattaattatttttaaatatttaatagtaatttgctcacattataaaagtaactcagttgagaagtaacttttcataaaataatgctaaagtaattacatagggataagttggaaataagaaactatatgaagtaaattcataagtaaaatgtagagaatattcataattatatacatggattttcttatttgaagtaatcactatattatttttcttgatataagaagtaacttttcacgatattaaaaggaacgatattgttatagggaaataactataaaaaatagaataactctcaatgatataagaggcaactacactactaggaaagtactatattccaaaatatgaagcacaactatcactaacacaaagaccaaaaaaataatttaatcacttcctcggttagatcacattgatgcatgcaagtaatgtgaggggggttgatgttagaggatttaaaacagagcaaatttggagtacgaggagcaaatttagagtacgaggtgctagttaatgtatacatgcatgcacgcattatatcatgagacagagaaaaaaagtggttgagacatagagggagtaactcataaaaattaaaaatatatagtaataatttcttcacggtattaaaagtcataaaaatctacgatgcctcatgtttacgtttacgtggcgttcctctttttttctttattgtgtgtggtttgggcttatgcatgagaggtgagcgcataacagaccttttctataccatgattaagcatttgggaagttggctggctggctggccaagtagcacctttggatgttgccaagtgctacattttgaattgaatgcaaacttgagagcgagcccaattgaccaattggacaaaacgaaacgccaaagatagatgtgaacctgtagaaaacttgaggatcaaattagtatcacactcctatgtagattttcacaagaactaacctagaccatttttctcttcatctcttgtaaattcttttatagagcacatagtaaattcattcgaactttctcgattatttctatcaacggaacgaccccacatctctttcagctgtccaatccaatatggccacatgggttagacagctacgtcggtgaagtgcccaactttttcagcaatccggatgctgccatgatgcacgaacttacaattctactcccagttccagttgttggtgaagtgaagattttcagcgtacatcctggtccttcaggcttcaataaatcataaaaaagagcatggaacatgctttgtttgtagtttatcccacacaagaatctaattctcgatgttctctttacactacactactacagcaaccaccttttacacgttaccgtgccaaacaaaggcaaacgatatcttttttttaaaaaaaaaaggagaaaaagaaaaagaaaaggtaaaggaaagataaactgtacggtgtaatctttatctgcctaactcgtcttaactactactttactcccaaaactgctaccttaagctgaaccagatcctgtccactaatcaagaattagtctttttttacctgcccattgttttgttgcaacttacaacgcagagtgcgccttcacgccatccattctccttaagcagtgaacagattgagtttaagaaggccaaggaatccctcaacgaaaccctggatgcaaagcaaagcaaagcaaacttattaagatgcaatcttaagtaatgttaatgtttgcaagcaaaggaaaacccagtgacccacaggaatcaatgatttctctgcatataattgctttcatttttctttttgaaacttctgcacgttgatctttagtgaacttgacaaaataatcgttgtcttgagctgtgtgcgcggttgcttcctattcgaggttcaggcaaactggccaatgtttagattcaggcaaactggccaatggtttgactaaaccacatataactccggcagtggttggtccacgactaggacatgcccctctttccccaccataagcagcaatgacccagcttatagacttatagttatagctttataagttggggaaaaaggcagcaggtatttccgatgtgatgctgtgaatttatattgcataaataaatacattcttcaaagcgatagatgatgttatgtggttaacaacctaggttaagttattgttatccaatgctaccatgggatataaaatagagttgtaccttccgctagaagccaagatcaaacgaagggcaatcatcatctgttaacgtcaggtcgcctgcagataaaaaggggtaactgccacatttttcttccaccactctgtaatctgaactgagctgcaaatgcatatgtagtcaactagtcattgattagcatagtataatcaaacagtaggtgctagtactcacagcatgatcttatgatgcaaaacaatatgcagctgtggacagttataaaaaccaagtaatttgattgctctcatgaatctgaaactaccttaaattcacaaacggcagtctttttccaagaaaggttatataggatgcaaacctggtctgcagtttcacctttacccgatggagggtctgagctagtagtacacatagctggtgcagaatctgccatgtatagaccaatatatgtacgtttactcttggatggcaaaaaaccctaaaagtaaagcacaattttgctctaactccacaaaaaggaaattaattgaaacagcttccagtacctttagaactttcagtttgatggttccttgttgaaccttgactctgctcttttgcattggatacatcagatgttggggtatccaccatgtccaattccagactatcaaaagttgttggtctcctataaagcataattcgagtaaacccattttcttattcgacttgtcatgttagatattactactttattgtccagaaggcaatcttctaggatataactgaagatatgcacacaaaatcttacatgactgtctgatgatcataagttggatgggcactccctgataactcactctgaagagtagtgcatattgagttccttggctgcagagtttctaaatttaaacaagccagcactgatgcacgaagttgtgtagcacaatgagacattcgagagttcatattaacaccaatagttctgtttgaactgttgatcactgaaatgttagaagctgtcttgctatgatccgcatcacgagctatatttgatccaaaggatgctgaggagtgtacttgtgaagctggaacactttgggagtatttaatttccgatgggggcctcatgatagacagtatttgggatgctaaaaaagcatagcagtgttattaatatgaagcacatgatcaataagtaagtagcgtaagtcattcaagttagccatgcaatccacaaaggatcactaacatacacttgtaaaaatgaatgaatttcttgaaagtactctactgcgtgaattgttattgtatgagcacaatgcaggaactctttgcattttatttttattttatgctcttcagattgccaaagagaaatatttgatgataaacaagaaagggtaaagcagaacgaccactatagaagcatacagaactgtttcagcttttatttaaatttgatgaagtcataaagaatacctcaaatatcccttgtaatatgtaaaatcacatatttaaatagctacttaccagtaaataaacctgaataattaagctacacattcgcaggaataagggacgaccattttccttatcagtaatacaactatgaaataattactgcaagatgcatgcaacagagacatatctaatctgaccataaagaatgtcctgaaagtacgctgctaaaaggcacctaccagaaagctattttgaaatccatatcatggagtttctgaaataatcaaccttaactgaaactagtcttaatgaacaaagccaatattggtcacaacaaccttagcattgcacaacagaagagagaacactgatagaatgtgccagtaaaagtttcacttgagcagacttgtcttgtattttattttctgaagtgcacatatatcaaaccaattatctatttaatacaataaataaaagcattacaaatttgttaaaacaatggctgattggattgtcttactttcggtgcttgggtatagggataatagtagccaggtgggtgcatagattacttatctactgttcgtgtagttgacatacatgaaggaaacatgcaacataatttttctgttgcgtggtcaaacctattcaaactagaaagtaggtaaagtatacataccagttctcaaagaatcatccgtgttaccaaaagttgttctgccagcctctctcctcaaaaaactagtggaagatcctgatttaccatcctgaagatctgcagaaaataaataaaacatgggcatttctggattagagtatgtcaacagcaggagggtaaaaaataggtgcaagtatgctacatcaagtctgtttaccacagaatcctagaggactgtccactctatcataacttgatttgccaacttcttgtggattatagcttgcagcatattctgttttatcttgcttattatctgcaaaaactggggaaagaaccagcactttaactatataaaaatataactactggaagacagatattgtgcataaagttaaacccaattaccattaaattgatgtggatcatccaagttactaaatgttgatttgccaaggtctgtcttgtagccaacagtaaaatctggtttagccttctgagtatctgcaaacaggcaaacagcagccttactacctaaagatacatagggagtagtaggacatagaactaagtgtttatgatatcatgttcaattaccatgaaattttagtgtatcaatcatgttagtatgtattgatttggcaaccgttggcctgttgaaaccattactaccttgtaatctactcttttgaaaatctgaaaatttgtagagacaaatgaattattacattaaagtatgtcataagcagcaaagtactaatgtgtggaactctgtgatcacatacgattgaacttcagtggactgacaaattttggagatttgtttctcccatctgtcctgtcagttgtattatgtccattcgctgatccagtttgactcaaaaccacctctgaagggtgtttagactctacatctgcacaccaattaatgcagtaaaataagatgtgatatagaaaaaaaaggaatatatgtttaaaaactacatttgaatattttcagagtatcgtaagctacagagtggacacaaatgaaaactaaccattcttttgttttcttatctcacaaacttcgataagataattaggcaactggtatttcatcccgctttcaacagattcacctgacttgagatatctgctgccaagcactccaccatcttcatccagcagaacaatctgaacatccaattattaaaaaactataacaccattctacaactagcaaaatatcacagcatttcattacatagcatctagcagtgacatcgaaaacagcaatcatatattgccaaaccttgcactagaaacttctcagtgttgatattaataagcatgaaactaacggattgaatgctaattgctaacctgctttgcatgcgaaccaacttgcacaagctttatcacaccatcatggtacttctttgccttctgtgttagttgggtggtatataaggcactccattctacaaagaatgtacattcactattagctttgaaatatatcaataatttacaatttgtacatatcgcaaatatctgacatatacagagagaacacatgaacctttaaattcagagtctgttgaacccataatgcttcctgagctaccagcatccacaactccaatctttgaagtttctggcttacttgaaccagcagtatttgatgatttactgtcctcaagatctatacttgtagagacaaacatttcgcactgtgatatgttggacaaggacaatcatagctaactgatgtttaacattaattcattaaatcaatcttaaaaaaaaacattatacccatgtaccatgaaatttctgtggactggtaaatttgagtggtttactcgttggacctgatcctgttttgttacttgtattctccccactccttggtcttgtttgcaccataggttcctccgaggaattagtttgtaaacctgcgtattggcaatgcagaaataacaacctttcaatatgtgggcaaaggaaaaaaggaactccaattaggcacagcaaaaatgttgacgtctcacaacgcacaggtccaaagattagatacagaaatcgtcaatatattggaaaatgcacaaaaccaacctttgtttacactcttcgcctcacaaatctcaataagatagttagggaaatgacatttcttcccagtttccaaagattcccctgacttgaggtacctggtggctagcactccgccctcttcatccagcaaaattatctggacgagtaatccaaaacaacatatcacatcatttttccccagtccactaccacagcattctaagataaactggtctcatgaggatcaagtaacctaccaccaatctatcatccattagctacccaacaatcagaatatgccgtataccaaattaccaactacgaaatgcgcattctgcttacctgcttcgcgtgcgaactgacctgcgcgagcctgacgacaccatcatggaacttcttcgccttctgagtcagctgggtggtgtacagtgcggtccactctgcaatcaaaagcacacccgattcattcatcagattacgcccattctgttcagcgatcaaacaccttgtgagcatacgcagagcaggcggctcgcaaaccttggaaactcgaacccacggcttcatccttgccaccgccaccgccaccccccttcgtgttagggtccgcgaacgcacggggaggccgcgagttcaccgcgctgggacgcgccctggcgcttgcgccgccgcggtggacgcctcgggaagcgggggatgcggcggcggaggaggaccccgacccggggtggggctcgggctcgccgacgtcgacgaggtggcgctggaacgcgagcgaggcgccggggaacacctcctcgccggtgcggagcgtcctgcactcgacggtgccgcccgcgtcgtcgaggaggacgaggttgacggaggcgcggtggaggacgatggcgccgtcctggtacgccttgcgcttctgcttcacgtgcttcgtgtacgtcgccgcccaccgccgcggctccgcctccgcctccgccgccatcggagacggcgagctcgatcgatgggtgggggaattgagttttcgcggagagaattcgaaaatggagagaagagggaagctgcaaaggggaaatttattgggcttgatttgggcctggaatggtaagcccggcccagtactaattctgggcccatctagatcgtgggccatacggaaatcacaggaattggttttgggagtttttttcgtttttagattttttttaatatttacagaaataatctatcaacaaaaaaaaattgctaaaatagaccctgccgccccaatggtgggcgacaagctgacgtggcagacggtgggtcgatcgcgccgtctgccgccgtcggccaaaattg

SEQ ID NO: 13889 - DNA, 34433 bp, Oryza sativa
atcgcaattttggccgcccataaagagcttgcggccgtactttttgcatctggatcccttgccgccccaatagggacccagatgtaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttacattgtggttaaatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctatattgctctagtaattcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttagacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtattttcggatgcgaaataccagcgaccttcttgtaaacaagtggttaggtcgagaatgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacaccccgacgtctagccattgacaaaagccggtaggatttgtaatgaagcaagtggggaagagagtactgaatgtgactgagttctgaaagattgtgaggcctcactcgttaaggcgacttatataggcgcaaaaaatcgagtgatacccctgacatgtgaacatggtggggtatggtgggtacgcctgattggcgccgaaagttacagcctgatcggcgccgaaagttacattggtcgtatgcgccaaatggcgggcaaatactcgtatcgcacgcgaataaaggaggctgcatcggtgcggcagaaagtagtcgtgcatgcgccgaaaggtatcgtgcacatataacaacaacgtagtcattacacaagtatacagtactggaaagtgaagcaaataaaaaaagagaagactgctctactggccctgccccgcgccgcgaccacgcttggtcctccgggcctgtgctcgcacgtggtcctgggagtaggtgaaacgatccggtggcacagcacgggtagcacgagtgtctggcggaggagaggcctgcgcctggtcctgcgtatgcaccggcggtgcgcctcccagctgtgaggggccgatgacgtcctctgtcgagcctgaagcgaagtcgaagtcagtgatgtcgaagagcaaggtggaaggcagcaagcggtccgataaggtcctagcatggtccagtggtggaccctgactcgacatgccgggtgcctgtgacgaagtcccggtgtactgccagaactgcactacgggtaccggaatccccgcgcctaaacgttggattgtcgttgaaccgtcaacgacgacccggttgatgtcgtcgacctgcatggttaatttgttcgtacatattcgtaaaatttcacgaagagaaagacatgaaaacataaaggaatgatgcgatgcaaggtactcacagcacgagcgaagtcctgggcgcagtgcctggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaagtagtaatataaaacaaaagataacttgcaaaattatgaaatattaataaaatcatgagaataattatgtacaacaagagtacaggctatttaaatatagcaaacgttactaatggtacataacgatgacgtgcaatttaacatatatgtagagttcgataatataacataacattacgtgtcgaagtccaacatacatcagcatacctaaagatgttaggcgccttagtctgatgttacatcacgagacctaaagacatgacatgccgaagtctgacattacacgacgaaacataaacacatcgataagttcgaaacgaattacaagcaaagccacatgccaacatagaacataagaactacaccacatagctagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatggtcaggaatattgagtacttgtcacgcccataaatttagcccaaatttctagactattttgtgtattaaatccctgtccatgaccagccagggtacacaaaacgacaagtaatatacagttccaaacgtaaataaagcgtaaaatacttacagaagaagcacttagtcctcgcaccgaaacgaaagcagcagcagcggaaaaagacgatcctagcggggcttcagctccactccacaggcaaaactcaactggggtctgagccttggtcttctaacttcgtcttcagctcagaagcactacacttctgaaaagggggaataatagcaaagctgagtacaaccaccgtactcagcaagccacaccaacgatgcagacgtgcaaggggatacaaggatggtttgtggctatttgcataaaggcggttgcaaaacattttattgagcaaaacagtaaaactgttgagtaattaaagtaacattaaatctccactgatcaacgctacaccacgttgaacaggcccaaccaacccacctgaactacagtgtactgggtcgatttattaaggtaggactaatcacggtgaatctagtcgaccgcccataaccgcgggcacggctattcgaatagttttactctgatcagaggtgtacaactgtacccacaagacacagccccacgacatgtttccgtgcgccgatatgccaccacgacataccggaaagaggccgtgacaggacccttcgcataaccccctctaacagatcgcaccacaccttagggttcgcccccgtccccagcaggcaacgggcagcccccctttcgtgccgcagtgaatccggaagccgatcaaccggacaccccggccgacccaactccatcacgcccaccctcgcctgggtacgtcggctagagaaaagctacactacaagcccagccgttgcccacgctggcttgtggtaagtacgaggaattctttcagggtttcccgtgaaccggtccttaattgccatgggagcgactagcaaaaccatgcacccacagcccaccattcactcgcattttagttggataattacgaccatgaagcatggccagatgtctcaagcacgcagctcattctgatactaaaaaggtctaatactgtaattatcccatcatctgagctagtggtaattaagcatggctaagcatatagttctagctaggtcacataagtaacacgagctagtcgatttataacccaaacttgacaaaggacagatatcaagtaaacatggcacaagcgagcagataggtaaaaccctgaccccatgtaattagcaaaacatgcatatttatttgcaaacagtaaaacatttataaattgggatcaacatgctcaaggggaatgtgttacttgccttgcttcttcactttgatcttccgaactcttttcctcgcgaccgcggacttccgaaacgacggattctacacgctggcacgcaaaacgaggaaaaactctaataaaaaccaagaaaacagtacataaaaactaaacaaacatgtagagctcaattttagatgaattttgcaagttgaatggctcaattcggagttctaatgaattagatatgaattttagaagttttgagccatttaaatgaatttctagaattattaacgaattattgtgtaattattatttatttttacaaaggaaaagatcatcgctgacgtcagcaaggggcggctggcgccgacatgtgggccccatcggtcagcgacacaagggcgtcggtccaccgtggaccgggaccaccgaggtggtccaccgccggtccacgggaaccgacggcccggatcggcccaaagccgatcgggcggccacgaggcggcgcagccgggacacgggcacgacacaaagccgacccgatcgaacgacggcgcgtggcggcgtgcggccagacgaccgccggcgacggcagcgcgtcgcgacagcgggcacgcggagcggcggaggaggggaaaaaggaggaggcggagggagagctcaccgagggctgcggcggcgagacaaccacagggaggcgaccggcggcggaaaggatggcggcggccggcgcgggaggcgacgggaacggcgttccgacgacgcccgaccacaacgaagccgcggccgagggccggcaagaccttgattttggaaaagcggctcccgtgaggttctggacggagtggagcggcagccagggtgcggtggagcgcggcgacgctgcgcggcgacggctagagcggcgagaggtggcggctggaggtggtatagttgaggcggctcgggtggacagtggaggtggaatttcggtgcgagattggggaaaagaggtgtaggacggggtggagctcggcgcggctatgccgacggtggcgacggcacggcacggcggtggctgaagcggcgagaagcggcggctggagccggcggatggcaatggcggctcgggttcgcggtgggaggatggctgcagcgatgggatggggaaacggagcggaggccggggtgcggcagggcgaggcgaagccgaaggaaccaacggcgtggcgtggcgtggcggtggctacggcgacggcggcgtgtagccggagttcgccggcgggcggcgtcgcgcggagcggcgtggggagcacgggagagggcacgaggagctcggggaggagggggaaacggaagaggagagcacgagggtgctttttataggctcggggaggaggaatcgtggccgggcgtggcggatttgaagcggcaacggccggcaacgtgggcgacatcgtgggcaaagtagggctcgatttgacgccaaaaattggggaaaagtgggggatttggtggaggaggtggtggggaaccgattttactcggtttgggcgcgagggcgcgagcgggagggcgccggatttggcgggacatgggcggcaaccgccggccatggcggcttcggcctgggaagccgaaggtaggaggagggcctgacgggtagggtcgccgggcccacctgtcggggaggaagagagggaggagaacctagggggttatttaaactttgcgtgaggggaaggggaaacgggccgacggcccaagagaggagaggggaggccggccgaggaagggagagaaggagggctttgggccgaaagtggcccaaagtgaaggaggggagatttttaattgtttttctttttatgtaattggttaaaatgaactttgtgcttttaaaattatttcttgagttccgaaaattcatggaaaaatccggagagtgttttagggcaaaaagaatattacaaaatattctcggccaatgatttttaagggaaaattttaattttcccaataattcacttgattaaattgattaacttttatttaatttttagaaaatgcattatttaatgatttttaatcccgaacgaaaatcggggcgttacagtacttcatcgttagtctctgtgaactccccagctatgccgaacccataaatctcgccgctccatgtatgatatattgcttgcttactgaagtactgtgacacatatactgcatctggtatgccacactctgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtactttgcactagagctcgatgtttcatggcctttttacgcaactcctctagctttttctgcatgaaagttccaaacaaaatgttgttgttcggcatagagggaagaactgcctagaaccgatccctaaaatacctgcatgtcccatgtaaaatgaactccactatgccaactagtggcagtccatggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccattgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccagggtatcctcattccatactcccaaactgcaactcttctatcgcttgcagaatgccagcgtgcctatcatgtatcaggcacacatttgccctcataccaacaacttttgttttaaccaatttcaggaaccagtaccagctgtcggtattctcactctcaacaaaagcaaataccaagggcaatacctgattgttcccatctacccctattgctgttagtatctggccccgatactttcctgtcaagaatgtcccatcaatgcagagaacaggacgacagttcacgaatgtcatcttgcatgcatgtagagctaagaacgccctatgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcacatacatctcacatgcaacaaatgcacatgtaatgttcctgtggtatttctgaacaccaggtagaaaacatgtatgcttggtaatgactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcgtctgacgaatcaccttcctctacacgctcattgtcagaatcctccctctccatttcatccacaatggcaccgacagcctccccctcgtcggccactccacctggttgaatgcccagtggagctactacgcccccgtcctctcgtgcattgacctcctccacagaagtctcatttacttcagcacttggtccctcgccatcatccatgttcatctgcacacctggatccttcgggtgaacaaacagaaccaaagctagaggccacccgcgttgcaatgcattttccaaataccatctccacactcgagagttttgaattggcattaattcccaataaaaaccctcagttgcccgacttactataacattgattgttatgtcacttgtctgtggatcaactctcaagcccctcattaaccatccttttataaaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagtagatctacgtagttaccgatatctacaatacgcacttctagattagtacaactaaaaccctaaaaatataatgcatttattcaaacaaatttttaaaaaatacacactatttatctcaatagtcacatataggatctatgaatattacctgaaatcggcgtctgaatccgacagggcttcgccccttcttctcttctcctcccctctcttcttttttttttcactggatttgaggggggaggaatgagggctgggggctgggcggcaagccttttataggcagcgaggcctgccacccggctagagggcggcaagggaccgcctgcagaatggccagccccgactggcttttttgcattcgggccccttgctgccccaccagagggcggcaagggttttcctgcaaaaaaccctccctccatcaacgcctgttcctcccccgtttgccacgttagcttgccgccccagaggtgggcgacagggtttatttttgtaatttttttggccgatagattatttatgtaaatatttaaaaaaaatctaaaaccgaaaaaaattcttggttttggtagctgcgtgtgctctcagctggggactcctagctagcgcgtgctcgctgctagcgagcactcctcccctattaactacctctgttaacactattagttaatatacttaactatctctattaattaatatacttaacactaataatagtaattaggaaagattatggagattttttttactaacagattaaaaaaattttaagttagatttgaaaattttcgatttaaattttaaagtcaaattttaaaaactttcaactcagatttgaaaactttcaactcaaattcgaaaactttcaagtcgagattcgaaaactttcaagtacagatttgaaaattttgaaaactttcaatttgagatttgaaaacttttaactcgagattcgaaaactttcaagtccagatttgaaaattttcaaatcgagatttgaaaactttcaactcgatattcgaaaactttcagtccagatttgaaattttgaaaactttcaaattgagatttgaaaactttcaactcgagattcaaaaactttcaagtccagatttgaaaatttttaaaactttcaaatcgagatttgaaaactttcaagttaagatttaaaaactttcaagttcaaatttgaaaattttcaactcaaaatttaaaactttcaaactcaaaacatgctaaaaattaaaaaaataatcagaaaaaaggaaaaagcgaaaaaaaatgggtaaagaaaaacgaaaaaaaaaagagtgggaggcgcgcgccggcggcgggccggaaacgtgcgcgcgcggattagcaatcgcgctctcagctttgagagattccgcagaaaaccgttcaaaattccgtatcaacgaaaggttcacatgttcatgttgtaaatatgaatctaacgtggaccggaggattcttctaaaatggcatgatataattacagcttctgcaaaatgaaacgaactcacacgagcctgatttatacactgccactttgcaaacttctgcacagcagacaacttgatcgtgtgttgacagaaaccttttcaaatctgcaggatgtagaaggccatcagggcatcaggcatggatggagctatggaagtagccaaggtaaaaaaaaaaaaaaaaaggaatggcagcaactgcagaccatgcaccacaatccacacacactcaagctacatcctttgtcgttgatctcgcaatggacaaaggccactaatgctgttgcaggtcaatttgtgttggcaataatccatagatgaatcttaaaactgcctgcctcttgagtaacactgcagaaatttcacaatatgaacatgcaatgctttactactgacttttctcccggactcaccgaagtttcgccagttaagattcagagatattcattctgatcatcctcaggttcctcttcatcctcactgatgtaagtttgcaggtaggcctcctctccttcatcctgcaacaacagaagctacctgtcaaccactagcgatgtgccggcatttgaaggtgatcacaacaccaccaaacaccgcgagctataagtgtgtattaacaaaatgtaatttgcagcagtgcttttgaactcagcatttttcatgcatgattacctctattttatcgtcatctttagacaaatcagcctcaactgtttgaagtaactccgcatctggtttttccccagcaacttgcattcgtacctgatggtcatgacataggaagagaacatcatcaagaaatgtttactactataagaaaatataagtcatactgtcatagagaactcgtgtataaatgacttacaagttgagacttcagcttccagatcttgtctcgcagatttgagatatgatgatttaatccctagattattttagaccatgtaattgattaaatacatatacaacttacatagagttcaaaaaataaaataatggaaaaagaaaatcagattttgcacttgaattacctcccgcctttggagctctatagaccgtgccaatgcttttctccttgacaataggtttcgaggcttcaaaatttggggcgtcttgtagttcttaccccggtacaaaatgattgcatatccttttgtcgtcttatcaactgaaatgagcactcctccactttcagcttccagagatattgcaatatgttttacttgtggaaagctcttcccctttacaagaaccttgactaattctcgatgcttccaatgcaagtgcatgttctgtactgttccatcaaaaacttctcgtcttcctgagaaaattttaatgcatatagacaagtcataaaacaccacatgcattttatatcacaactgttaagtgagaagtgccagttgtaccaagcattagaaaggccttcattttcaggccaattctgcgaagtaagaagcgttcctcatctgtaacagtttccaaatcagttggaagctctgctggagagagaaattcttgaactttagccaaggccttttctgcttttatgacctttgtttttgcctgcacaggagtagatattacacaaataatcacaaagatatctttgtgcaatggaggaaaaagtagctaaaatgctacttacaaatgagtaatgaaattaaaatactaaacttttgtttctagagatgcattttgaagagcataccaaaatcaattttctcttcaagttcctcaaaagagaggtatgttttgtaagaatcatgtgattcttctcctttttcctgagctcagcattaatggaatctccccatcgagattttgcctctctagtttccgcgagagtgccagcaactgggggatttttaaatactttgggtttgacactgatcgaggctgatgctttaagccgagccaattcttcctcatcctgccaagtgattgcttgctcttgcttctccaccaagacttgccttactttaggtgttatgaaatcattgcccctgtagaagacaatgtactccttgttcctcgatagaagcactcctcctgttaatttctgcaagtgttccgttacacagattcaaaacatgcataggctgcagtgtgcaagagaaactaatacaatgatcatatttcaaggttaaccatcagtcatgcatcgaatcaagaaaagaaggcattcaatacgtcacaagaacaagcaggcgaagaggtaaattagtatggaagtgcagaggagaagaaagcaaagtccattagtggatttcttaagcgttctttgtcagattgttactctcagctttctcagaaatttgacatttcaaggattcaaaaagtgtgaattaagcaaaagaactaattaaggcagcaaaatagctacttatcaagcaatgccatgtttatttgattcaacacatacataacactgtggagacaggaatgcaaacaggcaaactactgataatagttatcatgatcttttaccctgatttcttctgccattctgtcattgcatgtatttggaacccccctcttgatggcaatctttgcaatagaacttttctcccacaatttaacgatagcagtagctaatccttggtgttccctgtttctccctaaaccacacggtacgcatgaagtgtgaaaagaaggaaattaattgacaaattgaatactatgcggtagatgaaaagctactcagataagttcactgaaatacctagagcaaaatgaggagcagtttgccttgcaagtctacgcagagccgtcatttccttattccgaagggtacttttaaccatgtaaggaagtagtctaaatggtgtcttgtaaccaggaacaacaccaggaagcaagtcagcatccacaggaatagggccacgaccagaccaatctttataccgcggtcccaactgatccaagaagctatcgatatcaaatgtctctgtaggtttttcagaggaattgacaatatatgctgagcgattcagtccatctgcacctgacttctgaaatttatgttcaacatggataggttcaacactattactactaactcttttatcaaaattaacctctgtagtttgtgtatacgactgcacacatcgaaggttgtagttcattcccctatataaaacaactgatctccctgacctccatattacaattcctccagtcctctcctgatagataagagcaagataacaaagtaactatcagatttcacgccacgaaaaaattgtgaatgaacaaaacatgagacagcaaaaggtaaccgcacctctagtatatcatgagttctcttcatgttcaggcttggaggtccttcaaatctcagcttgaccacctcttccaccctccatttctgatgaatgctctccacaatgagctgagtgacccctcctggaccaaccctcatcctctccttcatcctcaatgccacatctctaagcctccgcagctcgtgctctgggatagtcctctcagccagctccgtgttgctgcgctttctcggcctatcgacatccccctccctctcccatgggaggagcacaggaccgagcttctggacaaaatcctcggtctcgggacactcaatcgcagcatttctactactttcctccatcgaattcctcattgtgttaacaattgaatttacgctactccgcctagtacctctataaaacccaccacctgaagaaacatggtccagtaccgaatccatcatagaagaagaatttgcggccggtgctgcataatcctcggagaattccccgtctgagctctcacttagcgtctcctcctcactccccaaatcttcgtcttcgtctccgtctccatcaactaaacccatctcatcctcggaagcaccatccccatccaacccttcctcgtcagaaaccaattggttcgtcatgggctcttcttccccgtgcatccacggcgctgacaccggccggctcccgagaaggaagctcggctcgggacgcggcccatcctcctgggcctcggccgcttcgccgccgaccacgacgccatcgccatcgccatcgccatcaccatccgaggaatcgtagtcgaagtcgaagtaatccacgatggactgcagcgtggagctcccactccaaccggattcctgatcgcccgcggcctcaccctcacctccgcccggctgctgctgctgctgctgctgctgccaggggaaggaggcgcgctgggacggcgccctcgcggaccagcggcggatggcctgcttctcgaagctcggcttcagggacctcctcttcttaccacccctcttcccgctggcgacgtccagcgccggggccttctccggcgaggaggtcgagggggaagaggaggagactccggccccggcggcggcggcggcggcggtggcgcggcggagacgcagtgacctcgtggagcggagagtggaggggaaggggggtttgggggagagcgcgtggggtggtggtgggaagagcagcgccattggaggcgaggagaggagctccgatgagagaggtgggagatgatggtcgaggagatatgagcggccatgagaagtgggccttgggccataatttttctctgggctagttcttgggccgtcaatcttttagttttgggctttaatgtttgggtctgcacccacaatatttataggaaaaagtacaccagaggtccctcatcttatcaccaaattataaaatcatccctcaacctaaaaaccagatatataacatcccttaacttataaaacctggtcactctaggtccctaggcggtttttgccccggttttgtcatacgtggcagatgagtcagcgtggggcccacgtgggacccacgtgtcaatgactacttccttttctctctctacctctcttcctctctcttcttggcaaccggccgcgcggaaggactgaggagcgcggctgacgacgggcggggagaggagcggagggggagatggacgcggcggcggtgccaccggcaagggcgaggcgacggcctcgccctcgccgtcgcctcgctctccctctgcttgacgggaggcgactccagcgctcggccacgcgtccccctgggtgctgcgccctccaccgctcccaacccggcggcggcggctctcattggcgggatgctgagtcgagagctgctactgattgacaagaaagaatcaactagcgtctcgcgtgttacttgccaagtttcagtacgcagcgaggtaacgaacaataatcaactcgatttgatcgagcttcgctcccagctgatcccatgggggactgtttcggctccgaggaggctgaagctgctgcgaccgtgagggcaccaacataaggccaccatggacgctggcaaggtattcaaatgcttgtggcatttcttctcccttggttcttgacaacatattctaatcaaatttcaaacctcgcagcagaagcagccgctccagcaaataggcgtagtcccatcatggcactacacaacgtgtttgcttccataagcagcgccaccgggcatcacgtcggaaggtcgagctcgtccatgagcagcatcaccaagcagcagcagtagcagcaacaatatgcccctgggagcagcaggcggcgcagtcatcggcgtcgccggggcgctctacccggagccggaggggaggatcctggaggtccccaacctctgaatcttcatgttcgcagagctcagggcggcgacgaggaacttcaagccggacagcgtactcggcgagggtgggtttgggcgagcgctggagttgcttctcgtcaagcagagcggagagcgaggcgacggcgaggccatcgccggtggcgccccgccgcatccgtctccacctccgctcctctccccgcccgtcgtcagccgcgctcctcagtcctcccgcatggccggttgccaagaagagagagaggaagagaggtagagaagaagagagagaggaaagaggtagagagaggggaaagaaagtagtcattgacatgtgggacccatgtgggtcccacgctgactcagttgccacgtaagataaaaccgggttcaaaatcacctaaagacctaaagtgactcggttttgtaagttaagagatgttatatatctggattttgggttgagggatgattttgtaattcagtgacaagatgagggacctccggtgtactttttccatatttatatgggctcggcttttgtgcccacggttgtttttgggcttttggcttcggctcacaatcgccttgggcccacagcaaacgaaatgatgtcatcggcaagtttcttcgagatcgctacctcgcgcatgcgctagcttgttgctggcgcacgtgtacgtttctatttttaatttaaaatttataactcaaatttaaaaaattttaacacaaaatttaaaactttcccctcaaattttacactttatcataattttggaaacttttaactcatctcttctctactattataaatattaaatatgtttttgccggtattttggtacgtcgtccgtgtttaagtaggttttaagattgattgcttttggaagtacatatccgtgtttgagttatattttaagcttgtttgcttttggaaataaaaaaaagtcgtataaaagttagattttaagctcttttgcttttggaaatacaggagtcgtataaaagttggattttaaacacgtttgcttttgaaaatacaaaggagtcgtataagaaattacttttaaaaaactctcatgctaacttgagatgacggactcctaattccacctcatgattttctaaaaacaaaatccaagcgaattcccacagtgaattttaccctaactaaacccaataacaataataatattaaaatagcattcacccattgcagcgcacgggcatttttctagtttattaaaacattcaacttataaattttaaaactttctatttcaaatttaaaactttcaacttatatgtgaaaactctcaactcaaattttgaaacatcctattccaaactaaaaactttcaaccattttaaaaactttcaactcatgtaaatctttcagttgaaatttaaaactttcaaatccaaactaaaaactttcaacctatattttagaattttcaaatcaatttgtatattattattattattttactattaagaatcagtaaaaacagtaagaagtaggattattgctagttacgtaggcttagcatggggttgcacgagattcgctcgcggcgtgtacaatagattagctctaatccacagccatgtactagagatgaactttattttatttaccatattgggcccaccatctccttctttcatgtattgattgggagagaatgcaggtggggtccaccctgcatcgtactgtgcgcctgctgtcgacgctaatttagtcgcccactctgattctctctcctcttctttatcttccaactcatccaaagatctgacatggcatgtatatagcctgctgatattgctaactagtggccgctagtttcttttcttaagacatccacttgtgatttcctaaatattagattgagaaaacagagaaataagaaaaatataagatttagacaataatacaaatataaaatagagaattgtaaaacattggaaaaaatacataaatgaacgtttgatggaccgcggaaaaacccgtatgaattgaattgaatgacgaagatacattcaaagtaaactttccagtaggttggactcatgttaaaaacacccaaaacttgccacgtgttcctttgaagcgtagaaataggaaaaagacaagatctgacaggaatgcaagtatatgattgcaaaacacaagataaccatatgaataaccgtttgattagaccgcgaaaaaaatataggaatttgagaagagataaagattcaaaggaaacttttcatgaatttctaccctatgttaaatctcctcaaaaatttgcataacatgagacattccacataaatttcttaagatttaattgtgtctattcatttgattcaaagggctatctaggaaatcctttagaaatgaaatcctccaaaattcctacaacttttcttggaatcaaaggggttctatagcaacattacttaggaatttcataggattctataattttcaatcatttgtttcaaacggtcatatatgtgaaaaatcatataagattggaattctacaatttttttatgtttttccttcaaatgaagggccttaacattatctaaaaaaaaatgaagggccttaaaagttaaaattgttgttactataaaaggaacttctaaaaatatcttcttcgacctaaatttggatggctctggatgacttggcagcatgtggcatcatagttagcaattttaaataaattatatatagggttaggggaaaagacaaaggaaaaaaaacaagattgacatttattattcattgtattttgctgtcgttactcttcaatcacgttgactccatgtagacgccagttcatcgaataacataagacccatgataaaatgtgagtggttttcaaagttagctaggtttcgtagttgagagtccaaagttataacattctttttttaagtaaaaagtacactcctggtaaaaaaaaacttggtatgtaggtgtaatttagttaaaaaaatttagaaattgaatgtctaagtataataagttagtgagtatattccagtacaagaaaatgtgtgtaacaacttgactagttacatgttgtttggttaacgagtgctagatgagttttctcatgatgtcaaattgtcaatgcgacgtaacaatcatgcaaatattaccctacaatcttggattaaatctataaagaattgaatcaatttgcatcaccggtttagaatttatcttcacattctcatatctcaacagaaatacacaattttctacatggtaaaatctaattgacttttagtgactatattttaaaaaataagtatgcttatataaatctgcgcaagtgtgttgacacaatatgttgttgtatcaatataccaaaattgtacccaccttgcaagtcatccacatgctaagttattatattagcacgctcactttgtaagttcttgaactaagttattgtattagcacgctcactttgtaagttcttaaactaaattgcactcacatatcaccttgcaagtcattcacccagtacgttactcgcttcgttactcgcttagtaaattcgtgaattgcattcatatcaccttgcaagatatccatttgctaagttaattattgcattagcacgctcactttgtaagtgaactaaattgcacagtatatcaagttgatgtcccatgaatacagtttacttctttttttttttggttttttttgtcttttcatccggtcagttataaatggcgtaccattcatttgtgaaaaatatagatatatataaattgcttttatcaaatcaggactagcctattgcaaaacacagaaaatgttggtcaaatgaaaaaaaaactgtagattgaatatgacagacgaataaatatatagtgattgagcgaaagggcctgtaacctagtggttacaagaggctcagtagtacctgaggtcctggcttcgactccccatgggagcgaattttccaggatttaacggcgttgtgctttcagtggtagacgacgtacccatcgacagcgaagagatgctcataggggtagtcacagtacatccgttctttgccagcagtgaaggaacttgcgggttgtgaccattcccaacccaaaacattagatatgggttgtgaccattcccaacccaaaacattagatatagtttccataaacttactagtcactactcttccagtcgtggtgacttcgtcaatcggtccagtcttcgaaggttgtgaccattcccaacccaaaacattagatatagtttccataaacttactagtcactactcttccagtcgtggtgacttcgtcaatcggtccagtcttcgaagatgctcataggggtagagatgctcataggggtagtcacgcgggttgtgaccattcccaacccaaaacactagatatagtttccgtaaacttactagtcactactcttccagtcgtggtgacttcgtcaatcggtccagtcttcgaagatgctcataggggtagtctgcattgtactgtataatagacgaataatacgaaataaatttatatccgttctttgccagcagtgaaggaacttgtgggttgtgaccattcccaacccaaaacactaatatagtttccataaactccaaatcaataaactagtactagtcactactcttccaatgcaaacatcactattccatacttaaatttagtgctacttatctcacataatgtcttcgatgttgtgtagaaatcatatctcatgcaagatatgttttccttctctttcctcatttattcacttgccatatcatttttcatcctaggtggcaagacatggttttcttctctttcctcatttattcacttgccatatcattttttatcctaggtcgcaacttatttaatactatggacactatcctagtcattgggatgggaatggcctaacatcaattccattgcaatttagtcggtgctccaaaagatgcggtaagagttcaattcaggagataaagacaaagaagagaacattacatgctacccatgactgcaactgtgcaagatgaacgagtaaaaaaataaaggaggtaaaacaaagtatcaatagcacgacagaacagtgttccactgaaaaatgggcaccattgtcgccatcatcatcatcaaccaacagcatctcagtacagcctgcgagagcaatcaggcgaaccacagaagcaaggtttaaccttctccttgccattcttatcctcgactttaccgtaattgtaatcgtaagtaagctcttgcagcggcggtatgttctcggtggcaaagaacatgatgtgcggtttcttcatgtcatcatgatcccagagaacattttgagcatacagattaggcgagcagctgtggttgatgaatcttccaacattgctgcactttgatgcatcgatagtactgccttcagtatcctccgttgttttactgccttcagtatcctccgttgtcttggacgtagaagattctagacccaaaatgccttcaaatttaggatcctcccaaacttcatcatgatagtgatgaccaatatcaaaaaggtactcatcagtctctacatgttcatctccattttcttgcagcacctcacctgcatactcacatacgaaactgcctgaagagatagagctcagagatcttacaccccaacctttgttccccgtcttgaatatttccagcggaattttgataccatgctgactcaccctgttgtggcatgttggagggcacctgcacatagttttgaacattagattagctagattagctccctgctttagaacagaacttctacttccggtttaacttgatattccaatacaaacaaataaattctattgtaaaaactaattaacttgacgtgaattggttgcttctgtaatcaatatgttggtttgagcatttggtatttcacagctttcaaacagaatttacaatttgggtttaatctaataataattctggcgcgaaaaacaattaacttcaggcaaacaatgcatattagcattagttagctcaaagcatcggaacagaacttgtagtttcaaattaacctaattgtgcaatgtgaatgagtagttctgatatgcaaacctaccaatttaaggtgaatgaaccaatttcgctgttatgataatatgtctagctctctgattgagaatatattttattattcccttcaacctaatgatctgctgtaaatgaatagttctggtgtgaaaacctacagacttaaggtgaaaatggttggttttatgagaaattttaaactatgccaccaacaattttatgttccttgtgtgttgcagggtgtttcactgacaaatgaatctgcaaccaaatgtcagcccttgttgaaagggtaaaaatttcagaagcaatgagaaatatttcctggttctgtgaatctactttggtattatcagaatatgatgcaaatgttactcctatttagttattgttattattttggattgctaagcttttgcacgtcatacctgcatgatgggccacactcatatacgagaggttttgcctcaacaatagcaccattggaattgaaagggatttcacctccattcttcactgcacaggcacatctattagagtctgagcaaccattcgtgcaatcacagcctttcagaggttcttttgcataggaatgtggatatatgacttccgtagtgtacttaaatgctgttggctgcgtatcgtcaattgtgttgatcgcaggtatgggaatcctctcccttccttgagatatatcaggcacacaaacaccttcgcgaactttggacttcctcgttgccttgattatgtgtaatgctaactcgggttgacctgggatcctttgcaacttgtacttgtagaccatcgagccctctgggccttctttccaataatccaccaccatgtacagcccatcataaatatatgttgagatttgcttggatttagaatggctagcttcacctttactatgacctttgaatccatgaatcactcggaccggagtcttagtttcaatagaattcttcaaagctagattaccacgctcaagcttttgatctccagctgccttattcccgatggcctttcctccagaacccgtatatatgagttcatcggagctagacaattcatcatgataacctccggaagcaacaatacttatagcaacgaggattccattcacctttgtactgtcaatacctccttgatatgggcgatggagtccaacaaatgacaattcgattctaaaattaaactcatctccaacttcaactcccgcaacattgccaacaataggtccgggcttaataaaaccgttttgttttagggctttaccagcctcgatgtcaattcttccaatattacctttatgttgttcctcaacttgcacaagctttcggcatgccgcatggaattttatgagtaaattccttattttgcttcggggatctgtgccaaaaggagccgaaggagggagtgtaacacataactccttctttcctccacaaacaactagtgcctttcctccacgcactagctccttagagttgccttcaacatccgagtaagaagccttagagttgccttcatcctcaaagtaagaatcctccttgtcctctatggcctcatgcttgatcgctttacaagaggcaacttccggggaaacttcttcccttggagtagtatctttcaattctttccttggcctaccaaactttttcttaagcttaggagtacgagactcggaggaaccaccaatagacttccttcttcgtgtccacgggcatttgtctggggccattagtgcttgtacaattatcctgtcactgacaaggtctctatcatcattttcttcaattccattagtcgtagcatgcttcccagatgtagcctcctttatgaggctattcacgccgcccttgcatttgcctgtggcatcaaccttacgagcaatatcaccttgcttcaagctcatatccgagcgcaccacacctctctgagtgcttgaagccttcgttttcatcttaccatctccagaggatctagcgtcattttgcaatgccccattcatcttatcactctttaatatcttcttttttgcctttacatcgacaagatctctcatacgagtctcgggagtacctttttgtaatctctcttcatatttgcttaccatcttgccatccccagcacttcgtgctacaagcttcttttcttgttgtgatccctttccattcaccctctcaacaaaaccatggctaggagaaggtttggcaatagaatcatttgggtgtgtactaccattcttggctccttcaaaatcatctagggcaacatttgtggcaacttggaactcttggatcctattttctaccttgctagattcatcatcttcaattgtcttgccatctattgcctcactagaatggtctagaccgcacaccaaagaagcaccctggactgaaataggggttctcgccaaggaatcctccatagaggcaccaccggtagctacactaataggtgttgcttctaaaggcaactcctccatagaggcaccactttccgcaagagtagaagcagccctcccacagtcacgtggaaatttgcgtatggctgagatcgcccttcttttgggtggaggattcagaactgacatcaaccacctcttttttctgccaccatcatgtacatcatttgtcctctctaattgaccaacacctactctactttccgtctctcggccatcccgatcgctagtaacttcctttctctcgaattcacagccccacttgcctccctccctgtccatcaacaaactggccacatccctaacattctccgcagaaccgttagagacattagcaccacaactaactggtgcagctactgccaaaggcatcacatcaagcacctcgcccattccctgatcatctgacaaccgagcatctgtatcattaggtagctgcgcctctccggtctcccgcccctctccctcatccacctccatcctctctgcctccggctgagacgggccgtgcgagagggcaccaatgcatgcggccgaggaaaccacagccgaggcaacctgctcctcctcattgccctcggtgacaccatggacacccttatctccaacatctcctctgccctcgacactgttatccccaacattacctgctatgatagacggcggcggcggcggcagcgaagaagcggcggttgggccgcctgatagcggcacggaacggtcaggtgagacagccaccccctccgctccgccctggttggcgacaacgccctcgacgcccttacttccatcgtcaccggccacgggagcagtcggcggcggcggcggcggggcggggaagcggccgcagagggggggccaggagcgcttggcggagaccgccctccgcttcaccccacgcgccaccagccacgccgccagccccgccggcgccggagccggtggcggcggcggttccacgccacccatcaccaccaacaccacaaaaaaaatacaaaccctacaaacatagtacagatcggaatcagaccaccacgcgcacaccgcccgcctcaccaaatcaaaccaaaccgaggaactacaaatccaatccccctcccctcccccaaaacaaaattccccacccccaaaccgtaaaatccgaaacggcgctaccgcggcgacgaagagggggagggacgaggagctcacctccgcggcggagacgggcggcggcggcgacggtgaggggatcgaaatgtggtaggcagggcggatgagtcggctgggtgtgctctgctgctccgcgcgcagacctcggactgggcgtgtggccgccgcgtgtgggggttgctaaaaataggccgtctctctctcttcggctcttctgctcttcctctcgctcgagtctcgaatgttgaatccgcccccgtggattcgggacggtgggggctacagggactgatctggtcgccgcgtgtatatttgggagggatttgtggatttgttttttttttttttttttttactttccttcgagtggaaatgggtggggcagttgaatgttttctcccttttgtgagttagtcccttgtgatgtttgtggaaatttttaatcttaaataaacttggaaacaaaacattggctatggtggcattggatgctttatttattatagatatttggcggggtgatacagctgctagctgcggatgcgccacagtcatggaagacagtagttatagtaatttattgtcagaaataaatttagggaaaacattggctgttgtgtaattgggcgtattattatagagcatataatgggcatgtttagctgtgtggtacaactgctagttgcggatgcactatagccacggaaggcaaacagctaggtacaacgcattcgctatcaagtgaagcggaacatgattaatatattaatggtaaatttatgcgatacgtagatggaaagtcatggcttttaggaagtgcttaattcgtcctccgtccaaaaaaaaaaagataaaccccgaatataaatatggacataatgtattttcaagatttatatccaggatttatcttttttttttaacggagggagtatgggtttaaaaaattagatagtaataatacgaggcatcaaagtataatccaacactgtaaaaaaaggggtgatgatttggttttatatagtggcttattgataggaattactttgttggtcagatggtggttggcgtggtgtcaccaacaaaatttatcaactgaataacaattatcatttttttcagctggtgcttgcacagtatagcaataattataccgagctgtttttcaggagataagttttggttggtgacaccacgccaactctctttaacgtcttgtttggattcttctagttttcatttgtcacatatatataagaattttttgcacttgttatgtgaggtggttttatccaactgcagcggccgaacttcaaactagggccctacgatggcagacacttggggaaacttatcacgtgcgcgtgcgctagtagataaagtcacttacatacctatggaacttattcgatctgtcttttctctcgttgagaacttttaattttaacttgatttaaaaaatttctagtcaaagatttgaaattgtcgagggtggatatcccgaccacggtatttatagagtatggggatcattagaaccaaggtatatacgatacaacagacaatttataccggtttgagccttcaagatgagtaataaccctagtccagtttatatgaattatagacgaaaatagcacaaaagagtacaataggtacaatagggaataagaagattggactcacctgactagacgctgttgagaaaaaggtccgacgagatctatctttggctccctcggatttccgacttgcaactcgatgcccctccctccttgtactgagggtgggggacttatatttatagcgtagatcatcttcttctgcaagtagatctcaaagagataagaccggatacaagccccaggttactttatctttcctgaacaggactttaacaccttatattccaggaagataatttccttctttatttgtcgtatttccttaattaaagtatacctactcgtatagtatatggtattgacgtattccataaatccatgtataggaactatgccttatctttaacactgataaaaactttcaactcagatttaaaaacttttaaatcaagatttaaagttttcaactcaaatttgtaaactttcaacttaacattggaactttcaatttagacttgaaaactataaagtcaagatttgaaaactttcaacccaaattcggaagctttaatctcaaaatttaaaacattcgactcaaaattcaaaaactttcaactcaaaattcaaaactttcaactaaaacttaaagaaactttcatctcaaaaatcaagttgaaagttttcaatagaatattttaaaatttgaaatgaaaaattcaaattgtaaattacaaaaaatcacaaaaaaaatcaagtgcgtgtgggctcgtgaaaaaaagtcgcatgtgggcgcagacactaacaatggagctggcgcgtcgggctgaataggattctcgcagatactcgtgggtgcaacaatggagtgtccatcacttgtagtcactcatgtccactagaaacagtggaatagcctgcatgcatattatgcttacccaagctgtatgaaccttttggctctaccactattcaaggtgatttacacctaacagttgtttcagtcaacaatacaaagagagggattagctcttgatatagaatctttaggtcctctttaaaacacaaaattgagaaaacagacaatatgattatatgaaaaacacataattttaatagaatacagtgtaaaacaaattattataaaacatacaaaaatacaaaaatggtcgttttaattggacggcaagaaaaaacacagggatttaaggagagatgaagactcaaaagaaactttccatgaggttgggcctcatgttaaatttcttttgaaacttgcatggaataagacatttcataggattcaatagtatccaatcatttgtttcaaatgactatatagaaaaaagtttataggattagaatcctataaaattcctatgttgtttccttaaaaccaaaggagccttaaaggtaactacagaaacaatccttgttagtttagattatgataaaatccatatgatagagtctgatttgagcataaaactttttatgcccaaaaagaagttgtacttaacgatatatttaaaaaggaaatagtaattaaataaaaaatgcttatctacaaatcacattaaaataacaccaccggaagcgtgtgcgtgtccaagactttgtaagaattataaatgtctgtacatatgcctgaacatacatacgagagattgacaatacataacgacacttcttgaattatgacttcataaacagggcaacaatgagctgctatgttgaaagaagcatgtgggattttctcaaaaaaaaaaaaagaagcatgtgggatactaaggaaagacttagcatccattattgataaagaataaatggtaagaaaaccttgcatccaggaggaattatttgaactcaagctgacggcatactcctacatgtttttctcacaatgagctgctatgacaatgtatgctttggcgaaagttggcatcacagcaaatgcatcaaattctggaggcatcaaatcagagtttgatgagaagatcatgcacagtctgagcaagctcagcttcacccctgatgccatcaacccaccttgcgctgatccgcacattctccaggctctgctttagtgccctcttaaacccgggcttagtgcgggttgcgaagaactgggagatctctgcttccttctctttagaggtgaactgccaagaaacaaggatcagcaatggcccgatcagaataacatatacggaattggggaatagaaaagtgcagatgtatgataccaatgtgacaatagatttgacataatccgataagattgcgcttgctgcaaatgtcttcgtgatacgatcccagttttcctgcattcacataatagggcatgtaagcaaaatgttttgaatatcccactgttggcttatagtataatagctctttgtaaggaaatagaaagaacacgaggttaacaaaacgtgaaatttaattcctgaacaagggcatcccactcgatttttcattcaaaggtttttctttaagaggcaacttgcgtatagtttcatagtaactaagactgacttttaaaaagtcatgatttatttttcaaaagtatttcatacatacggtaagcgatcatctattatcatattccctctggtcaaagtacttgaagtttgagtttttcacggtatttgagttacgactttggccacaattttctgtaacagaacaagttcttaaaatccaataggtttacgagattatgaaatacttctgaagacatcgatattttgacataaatattaaccagatcttgtccaaaatatcaagtaattatgatcagaggagggcacacacaatttcacttagcttgtataacaagagagcaaacagagattcaatataatgaagcacttcagcagatagtagatattccctactagtgtggttggggggtaaattgatgagaacaaaaattaagtgcttcagcggatagtagggaagtatttttttttcctttacaaatataatcaccaccttagcgtacgtatctatggagtattatttcagcattgaagtgcgcaatgaatttagctatttactataatttggaatgtagaagcatgcataatatttgatgatttatagaagaataaacatgcaaaattcttaagtgaatcacgtcacaatttttatgtggcgataacacatctatccctacccctatactaaattgggcactgagcctccaagggagcttctatgttaaccaaaaagacggtcattgattaggtggatcctattatcataaccctagattataggagagttcatgttagataagaacacttataaaattgtggactctctagtttttccagaatttagaattaataaatacgaagctgtacttatcttggactctcgatttttatttatttctgaaattcgaaattaatagttagaaagttgtttctaacatggacttttatttttatctgattttaatatatatagttaaaactttaatatttataatatcaacaataatatataatgcaacacactgataccttcaaccaggaccatgcagtttcacgtgcgtcaataataacacttcgaaggacaagatatgcatcttgattgcgcacctgacaagcaagataagcaaatgagatatgtatataacttacaggtagttagcatagaactacaaattcgtccatgaccttccaatggaatcatgaaagaagaaacaatcaatagcttatacctcatctgtgaaaataaaattcaacgattcaagaacaatatccttatcctggcaagaagatagtatgcctataaaaagggacacaaaaccttcagggaagaaacccaaaatatcattctttgttaacctaagaagattgaaaagtacgaacctaatacatttaacctttcctccacttcagttgattccctatatatctttagaagagcatcatagccagatctgtttgtgctactaacattatgcatcacagagaggtatgcagcctgatcaatgcaaaaactacagatagatgagtctattaaaagggcagaagaccaggtaaaataatatggctaaaaggtagtacctttctagtatctggaggaagggaagtattgcgatcatcaaagaagatttggaaacgcctaactccctcacttatagtcttatcatgcccaagctgaactaggccaaccaagagcactggtctaagcattgcatccaggtggctttcactgttcttagggtcccaccctaattttctgcaaataaacatggccatacaagaagcatatctaaacaaacatacccatacaaaaggaatgtatcttgggaaataatatattgagagttaaagggcaggaaaatactcagcagtagggagaagaagcttgataaaaagttgtttgatttcaccagccaattcaggagtagcatcaattgatattttagctacactagaagttacctgacaagccaaaataaaatatgtagacaaataagcgccaaagaataaccggacatcgtggaataatcaattggtcatgaaatacacatacagaatttatgtgtgaaagaacactgaaatcatcctcgtcacggcaagcatacagtaaatgtagtaacgacgacaatgtttgcttgccagcaatagaaagagcatgtgcatcttccacgatgcctgtaataatagtgttataataccagttaccaaatcactgtaaattgtaatcgagactaattgtgccatgttgtgtttgtgtctaccgattttgtccattagggagagcttcttcatctgcaatgcatttcgaagtgcagttgtaagttcatcatcatatttgactctataaaatcctgtttcatcaatattcagcttaatccagaagtttccactattctgtcggtcttggtcatcgtactgtgaattgatgccctttatgtcgctgaatttatgtttcagtaagaatcttttctgcatatcatgtgaattgcatcctaaagtaatagggacaatccacatgccagaatcagaggatccatctaataaaaactggtcctgcaacaaaaaaaaaagggtcagcaattcatcatagcaaaatttatcattttgttgctgaattttgcatgtatggataatgttgagttatgtatgtgttggcccatgaggcccatatactactcatatgtacatgtatatagcagagttagagaaatgaaaaaagtagtgaagcttctagagaaaaattcccaaaacttcatggtatcagagccaatcggctggtggctggcgacgggcgacggctaaaccctagcctcgccggagcttgtcgaggcgtgcagagaggtgctgagggagctgcgctggcagagctgcgcgtgtacgcggcgcaggagcgtgtggagctccaggtgaggaaggaaacgctggtgctggagctcccggcgaggacgcagcggcgtcaacggcggcaggcagagccaacggcggccgcgcgcggagggagctgctggttgtgaggacggcactgctggtgctggtgtgaggatttggtgagctgctattgctgttctgttgctgaggcagagaagatcgagctgaggatttggtagtgtgctgttgctgctgaaaggaaaaggggaacacaaatttggtaagtgtgttgttgctgttgctgttgagcgagcagaggaattgtttgccggttgtgctattggtgtggcttgtgtgtgctgcggcaaggaggtgagcttgtgagtattgtactgctgtgtgtggttgagaaaggaagaaaaagaagggagtattgctgctggatctgttggtggtgtcgtgtgtgctgaagattacaggtgcagagagcaatagcaggtgaggaaagctgtagctagcttcatctagaagggaagaagcggctttggtgttggaaattaattattgtcaagaagtaaggcaacaggttgtgcaaggtgaatgtgaagttagtgcttcagattggcaggcaaccaaccaaaattcgtgtatgcgagaacacagtccaagcctcggcagtcacagagagggagaggggtgctgctgtgtcgagttccctgatcaggaggaaagaaaaccaggggacgttgtcttcaaggtgttagaatagagtgagtttgtaaaaaaaaaaaaaaaaaaaaggaatggagggaagtcaaggaattgaacaactgcttgcgaaaatggctgtagaaatacaagaaataagggaaagaatacggaaggagagggagaaaacaacagttcttggcaaccttgtcaacctcgcgcatcccatgcagatgcaggtacctcactcaacctggatattagactctggagcatctagacatgtaacaggtatgccaagtgagtttgtgtcatttactccatatccacccacatataaagaaactgttcagactgccgatggtacttcacagcctatcaaaggtgtgggaagagtacagtgcactccatccattacattatcatcagtgttatatgctccctcctttccagttaatttggtatcaataagttctttggttgaccatatggattgtcgggttactcttgatcgagaaaattgcctaatagaagagagaagaacaggaaggaagcttgggattggcattaggcagaacggattgtggtacttagatagaagcggaacaaataaagcactatgtagtgcattggcagttggtacaagtgaagaggaagctagattgattctccagcattgtcgattgggccatatgtgttttgaaactatgaggaagatatatcctgatgagatgagtaaggtg

SEQ ID NO: 13890 - DNA, 9173 bp, Oryza sativa
gggaaagagtatgtgaacaacgaatttggtagttttctttcgatagaagggatactacatcaaacttcttgtcctgacacaccaccgcagaatggggtggctgagagaaagaatcgccatatcttggaggtggcacgttcactcatgtatactatgaatgtaccaaagttcctctggagtgaggcggtcatgacagctacatatcttatcaatcgtacaccatcaagaatacttgggatgaaggctccatatgagatggtatttggatgtaatgaatttattgttccaccaaaggtgtttggatgcgtatgctttgttcgagatcatagaccttctgtgggaaaattggatcccagagctatcaagtgcatatttataggttactcatctggtcagaaaggatacaaatgttggagtccatctgagaggcaaacatttgtaagtatggatgtcacctttagagagtctattcctttctatggagaaatgacagatttgagttatttgttttctgatcttgacaatccaatcatgagtgaagttaggtatgaaggggtgaatgaatcactaggaatggaagaaggggatgaatcaaagaggacgaaggttgttattgggtcaatcccatgccctatgggcaaactcccacatgagcagaattggaggaaaccacatgaagaagaaaatctacaggtttacacaaggagaaagccaaggtccttggagacacaacaggtagaacaacaacctctaacaattgataggaatgagatggtggaacaacatcaacaacctctagtcattgatgaaataaatgatcaatcttcttatcagtcagatcctatacaagagaataccgagacagggggagaggagagtgaaatatcaggagaggaatctaacttgcctattgctaataggaaagggataagaagcacggcaggaaagccccctataagatatggctttgaggaggttgaggaggaaaatgggaatgacatagctaattatgtgtcatattcatctttatctcctgcctatagggcttttattgcatcattacaatccatagtgatcccaaaggattggagagaagcgaagaatgatccaaagtggcatgaggcaatgatggaggagatgtcagcacttgagaagaacaagacctgggagcttgtaccttttccaacaggtaagaaggtggttagttgcaagtgggtgtatgctgtaaaacaagatccacttgggaaagtagaaaggtacaaggcaaggcttgtggcaaaagggtacagtcaaacatatggaatcgattatgatgaaacctttgcacctgttgcaaagatgagcacagtgagaaccttgatatcatgtgcagctaactttgattggccactataccaactagatgttaagaatgcatttttgcatggagatcttcaagaggaagtttatatggagattccaccgggtttttccacctctcaaactaaaggaaaggtattgagattgaagaaatccttgtatggccttaagcagtcaccaagggcttggtttgatagatttagacgtgcaatgtgtggcatgggctacaaacagtgcaatggagaccatacattgttttatcgtcaccgtggaaagaagattgccatcctggctgtatatgtggatgacataattattacaggagatgacactcaagaaatagctcagttaaaagagaatataagcaaagaatttgaagtcaaagatcttggtcagctcaaatattttttgggcattgagattgcaagatctcctagagggatagttctttcacaacgaaagtatgtattggatctactttgtgacacaggtatgctcggttgccgacctgcctctacaccaattgagcaaaatcataagttatgtgctgaattaggagatccagtgaataaagaaagatatcaaagacttgtgggacgactgatatatttgtgtcataccagacctgacataacttatgctgtgactgttgttagtcgatacatgcatgaccctcgaagtggtcacatggacgcagtatatagaatcctgagatatttaaaagggagcccaggaaaaggcttatggttcaagaaaaatggacatctaggtgtggagggctactgtgatgcggactgggctagcagccttgatgataggaggtcaacctctggttactgcgtatttgttggtggcaatttggtctcttggaggagcaagaaacaaccggtagtgtctcgctcaactgctgaggcagaatacagggcaatgtcagtgagtttaagtgagctgttatggttgagaaatcttctttctgagttaaagttgctaatgaatattcccatgaagttgtggtgtgacaataagtcggctattagcatcgctaacaatccagttcagcatgatcgaacaaaacatgtggagatagatcgtttttttatcaaggaaaaactagatgaagggattttgaagctaggttttgttatgtcgggggaacaagtagctgactgtttaacaaaagctttaagtgttggggagtgtacttcatcgtgtaacaagatgggcatgatagatatctatcgcccatcttgagggggagtgttgagttatgtatgtgttggcccatgaggcccatatactactcatatgtacatgtatatagcagagttagagaaatgaaaaaagtagtgaagcttctagagaaaaattcccaaaacttcagataagattataagaactgctacattgcggatcttgtgcagcatgccctctttgaggactaggaaaattttccaaccagcttattatatcttcttaactagcaggtaacaaatattaaacccagataaagttgtcaaaaattttcaacatggggttttgtcataaataataagcagaggattttaagtatggaattctgactacctaaccacactaacaaaaatataaaggcagagcaaactatatgtgcataatgaatttacgtattgggtggtttgcatgtaaatgaatgtaatccattgaatgatcatattcttttcgataattcattacctgttcaagttccacgtcatgccctttaagcttcacaccaataacaggataaccttgtttcttcgtccatgtagtcatcaaattcttaacaggttcaccagatacctcttcaagaacagcccacaggtcctcggttttagcattcgagtaggcatatttttttatatatgaagctaatgctttctgaaagagcaacagttccacaagtttagtacaagatgacggagccatacattagttgaagaaaagtagagtagtggacaaaagaggcaagagttggccttaaataagtatgtaactagctaattgaacctttaattattgagtgtgcgatttgctaggtttacgatgtggtaaaaatttatccctccattctctctcacttgtacgtggtggtttatgttgtgatgtttgatcatgactactaaaaaagatcattatgctgaaaattggatacaaattgaggtgttttaacaatgctctctactagtaatagaactaatctggaccatttatttttttttctaattcaatggatcatatccatttatactaccacatcaactaatggtagtagaatatttttttctactggtagtagaactcataaatgtcaacagttaagattatttctaagatgataacacttgtagtagactacaaccattagagaacattgtaaaagtactctaccaattaatagggcccaaggatattgacaccttacactcaaagggataataatgtatttgctcatagaagttgagtgtgtcctttatttaccctcatgaaactacctctcttattgttatcattcccaacttttcccccttctttgcttctcccaatgcacttctactcagtttttcaggaaattcccatcttatctccacatagggcagtcatgggcccaggatcatggtaacagcgcataccaaggagattagggacatgacaacgtgtagtgtagttttagtcaaggatgagatggggatgtacgggtaaaggagctggttgattgcgctagtgaagccatgggagattgcgatagagtggaagagtagcaagtcaagagacacaactgtttgttcataaaataactaaataggggaataaaatgaagtgtcatttctccctccaacagcaaggaaggaaggaaatggttcgaggtaatttcacacacttctaacttcgaataagccgtaaagttatgcaaatgatacccagagtgaataaaagaatgacaagtataaaacctgaaaacgctctgcaccaaggtaactttgcagcatacgaataacagaagcacccttgtcatagcttatggaatcaaaaatcgagtctatctcactggcatggtgtatttcgacctgtagaaaacagtaacacatagtgaggaaaatcgctaaccagcatttagacaagtgaaaatgtttgatgccaccagctgatgctttgtaattgtgctggtgtggtgcatcgtgtgaatttgacatccaaattaacatttgagactaaaaagattaaatcatcaatttaaatatcgcgtattcattgtccagattcagtgaggaatcaaccaacggatgtgataagaatgtaaccaaaattatgcatcaccgttacttaccatcgtcaaatttgcagttcaaaatacgctctctgttttatacaggataaagtgcgtagtatttatggttttagaaaaaaaaaatggtgaacaccgtatgaaatgcatcaattttttgaacgactgcactagaccatggcatgtatcaaacagttattacctcaataggatgagactcagctagagagtccaattttagagcagaggtggtactgtcaagaaattgggtccagatattccactcagggaaaaaggaatctactgccaaatagctcatctgttcaaacaaaaggtccaagcactcagttggtagtattttgatatcaaatttctaaaaatcagtgttgtataattgattacccatgtagcaaaaccctcgtttagccacaagtgagtccaccattccatggttacaagattgccgaaccattgatgagccaattcatgcgcgacagtaattgctacctaaacagaacagatgtggacagagatttacatataaactacttgatcacccaaggaaaatatctcaatatgaaatcattcttaaaaactgtaatgtaaatttctttatagaattggtggatcatagtgacaatatattctcagtgttatgatatatacattatgtttgagaactgtttaagaactgaactataagtaatgcatcactgtttaagaactgaactgtaaataatgaaaaaaaaacatgtagctgaatattctcagtgttatgatatatacattctgtttggtggatgctgatgaagactgctcatcaaaaagcaaatatatttcccggtaagtgaccaatccatagttctccatggctccatttgtaaaatcggggatagcaaccatatccaacttaggtagtggataaggggtatcaaagaatctacagcattcaaagaatgaaattttggtcaatgactctttcaagcaacaaccttgggtaaataggatatatattaacatgaatcattttttttctttagaaaccaatttagaagaaatgataggtcgcgcgcatactctttatagagattcaatgacttcactccaacatctaatgcaaacttcccttgattactcttaccaacttgagtgtacacacgaactttgttgcctgaatacaattaaaaacaataaaaaaaacaatggaaagtaaaaggaaaagaatggcacctacagaactacttcaatgtgagaaactatgaagtatgctggattactggtacgtaccttccgatgttacaccttctatataatcaaacaaaccaacaactattgccactaaataagttgacataacgggtgattcctcatactcgacagtcttgataggaccagcaattttctcattaactataggcatgttcgacaaagctaccagctcagatggaacttcaagtgttaacttgaacttcgcctgaaattttaaatatgaagaggggaaacattagagagatagatccggcgatgttctaacacatagtgcatcaaacctctggatgagaaaattctgattggtgaacaggttttgctaccgtaataattaattaaccttgaaagaaggctcatcccagcaagggaagcaccgtcgagcatccacggactcaaactgtgtcactgccatgttttttgtctcccccttgtattcatatttactgcaataaaatggcagtttctcatatgaaaaggtcacatgagtcgtacccagaaatcatcaaaatactctctccgtttccatttaagtgtcactgttgaccgctgctgtttcaactttgaccataataatttaatttttaaatttcaatgttttgatgaaaaaagggtatgaacttatttagcatgcatcgagctttcataatatagtatatttcgaaaatatttataaatttgttgctaaaatgtgagcggtcaaactttggatgcgaataatatccagcgacaactattcattgctggagagggtaaatcctagtccacaggttcataagaacttcccaaccacatcaatcaactgatgatcagttcaaatttgtaacgatgatcatgagttctcgaggggatgtcccctaacataacttttttctctcaaattcaatgcaagtggttgtgaaaatttgcaaaacaaattagcaaatatagagtaacatctaatactccgccaaaaatcatattcaaattcgatctacacgttgagaaacgaaaaaaacaagtcacatacgaatagtagcaatttatactcaaaaaaggcaaccaccttaccaagtatagtattttttttatttactacctacgtcatcatgttttgtaccaaccatgtattttaatgttataagataatccctctaaatatatgattctatcataattcatctgtacaatatatcatctataggtacaaaattgtcccaaaaacctcactattggtttgttttgattcgtggcaaagcacaggtatttggctagtactatgtgaacttagttttgacttgattagttcatatataaggtatgaacattgtcaaaacaaatttagaatttataacaactatttggatgaagtttgaacaaacgagggcacatctccttgaggggtttagaccaatttatctttgaaaatatagaattcccaagagattaaagcgcaaatttagcctctgcgaggctacgatcaccacgaattttttttcaaatgcaaagtttaccttctgtagaatcccctcatctgatcgttgagcgtgccgttgaacctcatggcgagcacgccctcgccgagcggcagctccccggcgaactccagcaccaggatctcgtcctcctcgaacaccgacacctccgccggcgccaagccctgcaaccaaccacggcgagatcgatcgatcgacggcgagcgaggaggaggaggagaaggtcaggtcggtctacttacctggaagcggatggaggcgcggtcgacggcgaggtcggcggcgttgaggacgaggaagcgggtgggcgcggagacgtcgacggccacggacgcctcgccggagaacacgcaggcggcgaggtccggccggagccggagctcgtaccgccgcggcgccgcgaaccgcggcagccgcgcctgcccgcggaactccgccgccgccgccgccatcaccgcctccgcctccgccgctttgagattcgcgcgcgcgtgatcgaaaaggtttgaacaaattatttagccgcgaaaagaacccgagcaaattaaaagcgaagccgcgaggggtgggtttatttatagccttgtttagttacttttcaaaaataaaaattaaatatacgtacacacatttgaaatattaaacgtagactaataacaaaataaactgtgagatgaatctattaagcctaattaatctgtcattagcaaatgtttactgtagcaccatattgtcaaatcatgacgtaattaggctcaaaagattcgtctcgcaatttacatgcaaactgagtaattaattttttttcgtccacagttaatgcttcatatatatgtcaaaatatttgatgtggtggaatttttggaagttcgaagggaactaaacgcagccatatatctggatcggtatgaacttgcgaaggcccaagtagctaatggctgacgtcgcaagaaccaaaaaaaaatgacggtgattgccggcggcgagtcgaatagtggtaagaagaaataataattttttgaccggcattagccgccggccggccgaatttgttcaggggaggtttgatccgacgagtccatgatgatatcctaaacaagcagtaatcggaaggttcgatcatatatccggatgatcataatcattgagcgtctctcagacatgagtgagtttttttttaaaagaatgatacacacacatactaggacctccctcgtacatcgttgacttttcgtatcattcgtgttattcaaaaatttattataaatatgtacaagtataagttaagattatattttattttatgataaaacaagtcacaacaaaataaataatatttatataattcttttagtaagatgaacaatcatatgttataaaaaaatcaatgatgtaatatatttttaaaatggagcgagtatttatgtaagatttctaatgatacggacacggtgacggagccaagaaatttgtagagcccaatttgtgtacgtgacgatgcatcagcccttgtcgttctcgggtttgttacagataagttttatatggataacaaagaatagaaattgaggagtaggtgcccttttaataatgactaatgagcaaggaatattcatctttctgctcggtttcattatttaaacaggaggttttcagttccattttggagattgagggtttaagaattaagactgcttgtaatggtttcttgttttctgtttatagcatgataaagtgacaaacaagatactccatccgtttcacaatgtaag

SEQ ID NO: 13891 - DNA, 17641 bp, Oryza sativa
cttacattgtgaaacggatggagtacgtttttaccgtgcttggttattttaagaatgaaatgaaaaaaaaaacaggggaaaggggagagctctcttaaattatcacgattttttttcctggaggtactaaccgctttgtgatcagtccgctagttcatgcaaatctgacttaggccgtgttcggtacgcaaaacgaagttcgttttattgcatgattaattaagtattaagtatttttttaaaaaaaatagattaatatggtttttttaaacaactttcatatagaaagtttttacataaatcacaccgtttagcagtttgaaaaacgtgcgcgcggaaaacgagaggtgggttgggaaaatgggggagaagaacacagcctaagttatcatggccaaggagaacaatcgcccgacaaatagttgagctcggtctgatacagaatgctgaaaggtaaaatcttattcactcggacacttcaaagctacagtagaattgtgcgacaactcttgaatcatatgcatggctcctgggcacaagctgtacacaacctatgaagagaaacggtaagcactatatatccctttgcctcgtatgcagcctatgcttcatgacttataaacagagagcaacaatgtgctgggatgctgctgctacgacaaatgcttcgcctaaagttggcacttcatagcagggaatgcagctcccgggggggagggatcacaccggatacagatcagggtttgtgaagaagctcatggacagtctgagcaagcttagcttcacccctgatgccttcgatccacctggcgttgatcagcaccctctcgaggctctgcttcagtgtcctctcgtacccgggcttagtgcgggtcgcgaagaactgggagatctctgcttccttctctttcgaggtgaactaccggcaaacaaagaagcagcatgtttcagcaaatggcatgatgagagataactcgtgcggaattgaacagagaatgcagatgagtaataccagtgtaacaatagatcttatgaaatccgatatgagggaacttcctgaaaatgcctccgagatacgatcccagttttcctgcatccgaacgaaacaacatttgtaagctcaacattttctattacttcattgcatgtttaatactccctccgtccccaaatataagggagtctaggttgtttcggagaaattaaggatagaggaaaaatactatgagcccatcattaaataatgaggggtgtgtagggagtgggagggtggttggggcaatatggggagaaatttgaatcacgggtggttggagggattagcaggactctatgacaccttgtttgcgaggacaaattttgaatgtgtgaatctcttatatttggggacgaagggggtattttgtaaggaaatggatagaagcaagataaacaagagtggaagttactaattctcaaacaagggtaacccatttgatttatcattcaaagtgttcttcggagaggctacttgcataggttcatagcaataaagactgattttcaaaagtcatggaaattttcgagaataattagtaatatagcatatgcggtaatctaccatcctacaaaatttctttgtaaaacatgacttgtacaaggaggcaaaaaaagacaatatcatcagggagtgaagtgactttaaaagaaggattcaatgggtaaggtaacatgaaaataatatagtgtaaaatagtccagcaaagtagctaaggaaactataattgtccttttctcttacaaatataacccccatttgacgtatctacacaattcgattacttgaaggaaatgctacttgaagaaagcacgaaatttagctatttacttataattttgaatgtagaaaatttgcataattttgatgctttctagggcagaaaaaacatccaataagtggatatttcattatatttaaagatcctaggagaatcacatgcttcaaaggtccagatatcacaaattttatgttgcggtaacgcatagaggtaactggactttttgtaccttcaaccaggaccatgcagtttcacgtgcctctattatgacacctccaagcacacgatatgcatcttgattgcgaacctataagcaagagaaacaaatgagacctgtatataacttacaggtagctaatgtaaaagtataagttcaatcaggtccttccaatggagtcatggaagaaaaaaaccatttagcaatttacctcatctgtgaaaattaaattcaatgattcaagaacaatatccttatcctggcaagaagaaagtgtgcctacagataaggagacagagccctcaggaagtctggataacccaaaatatcagcaagcattgttaacacaagatggctgagaagatatcaacctaagacacgtaacttttcctccccttcagctgatttcctgtagacctttagaagagcatcataaccagatctgtttgtgctactaacattatgcatcacagagaggtatgcagcctgaaaaaaaaatgcaaaatatacagagatgaattcgtcttcaaatagaagatatacagatatcaattcatttttgtaaaaaaagatacagatgagtcaaaaaagaaagaggaccatgtaaagtaggggtaaaagaaggacctttctagtatctggagtaagaagggaagtgttgcgatcatcaaagaagatttggaaacgcctgaatccctcatttatagtcttatcatgcccaagctgaacaagggcaaccaaaagcattggtctgagcattgcattcaggtggctttcaccatctttagggtcccaacctaattttctgcaaataaaatttatgtcatcgtgtatgcatggccacaaaggaaggcatgtttaacaaacatacacatagtatgaacatacaatgggaaataatatattgagaactaaaaagcagcaaacatggtaaacatacttagcaggcgggagaagaagcttgataaaaagttgcttgatgtcaccagccaggtcaggagtagcatcaattgatattttcgcaacacttgaagttacctgacaagccaaagtaaaagatatatacaaatcattgccaacgaataactgaatatcctggaatttaattcaacataaaatacacatacagaatttatgtgtgaaagaacactgtaatcagcctcgtcacggaacgcatacagcaagtggagcaacgatgacaatgtttgcttgcaggcaatagaaagggcatgtgcatcgtccacaatgcctgtaatatagtgttataacacctttaatcgctgcaatagcgcccaggaaaaaaaacattgcaatagaaatttaatagtgccacaggttgtgtttaccaatttcgtccattagagagagcttcttggcctgcaatgcatttcgaagtgcagctgtaagctcatcatcatatttaaccctataaaatcctgtttcatcaatgttcaacttaatccaaaagtttccacccttctgtcggctatcacattgcgaaacaatggcctttatgttatcatgtttatgtttcaacaataatcttttctgtttatcatgtgaacagcatcctaaagttatagggacaatccagatgccagcaccagaggttccatttaacaaaaattggtcctgtgacaaaaaagagagagagagagagcgtcagaaatgcgtcaaaacagaatttgacccgtgtgccgttgaaattttgatattatgggaactacttgtggaacttgtcttgcactgaaagggcaacgtaaattctagtcagccaattacatcttcataaatagcaggcacaaaaattaaactaagatgaagttctgtcataatttttttatgtaatatttgtcataaacatttcatacaggattttaatttaggaattgtacctcactaatcatacctcggcaaaatagaaaggaaaagcaaaccatatgcataatgaatttacatataggtggttcagaagtagatgaatgtgcagtacattggaatgacgctactcttttcgataatttattacctgttcaagttccaagtcgtgccctttaagcttcacgctgataacaggataaccttgttgcttcgtccacgtagtcatcaaatccttgacaggttcaccagatacctcttcaagaacagcccacaagtcctcggttttagcatttgagtaggcatacttttttatatatgaagttaatgctttctgaaagagtaacagttccacaagtttagtacaagaggatgcattaggagaatttgtggagtcacacagcaataatgaagaaacaagataaagaagtaagcaagaattgaccttcgataaatatgtaattaacaaaaatggagctttatcatattagtgggtttacaatttgttcatatttatgatatgatcaacaaaaaaagggcaaagatagctccaactcctgtaacttgtacatggtgttacaggttgtaaattgttacccaccctagagaagtacacaagatggccatcaaacccttattgaagttgtgcctctctctacaggattaatattttcatctgttgaatcttgcttctttatatcatttgagtatatgtccaaaagtaccatgcaagtacgtgcaatgaagtattaatggttgactcgtcatcgataacagggtactcgttaaacaaaagcaagatgattaggggggaaatggtaatatttgccctaaaaaatataggaagcttttaaaaaaagaatttcacttacaaaatcactaacaaaagaacattaacaccaattgtatcgcctaaggatcattcacgcatttaaaatattggaaacttggaatatccaaaggtccacttgacgtttttcaactaaatgaatagtggacagactaaagggtcaatgcttcctccgagagcaaagaaagaaaatggtttggggtaattttcatacgcttctaagcaatacagttgagcaaaaggtgctcactacagataagaataacacgattctgaagaatttcaaggagagccagtatgaaacctgaaaacgctctgcacctaggtaactttgtagcatacgaataacagaagcacccttgtcatagctaatggcatcgaaaatctcatctacctcactggcatggtgtatttcaacctgagtaaacagcaacaaatattgaaacaaatcactagtcagcattgaaacaaaatgttaaagtgccaccagctgaagtgtaattgtattggtgcacttattaatttgacctcaaaattaacatttccatcttattaccacatagaaaagtcaagattcaacagtgaattagctagtggatatttaagaatgtaaccagcatattatgcatcagcgtcacttatcatggtcaaaatttgcacaacaatatattctctactttctacagcgatataatgcatagcatttacggttttagacaaatttggtgtacaccataagaaatgcatcaatgttttgaaccattgaaccagagtaccagaccatggcatgtatcaaacagctattacctcaataggatgggactcagcttgtgaatccaatttgaagcagaggttgtactatcaagaaactgtgtccagatattccattgagggaaaaaagaatctactgacaaatggctcatctgtcgaaataaaaggtccaaccattcagtatacagtagtatcctgatattaaatttctaaaattcagtgttgtataattgattacccatgtagcaaaaccctcgtttagccacaagtgagtccaccattccatggttacaagattaccaaaccattgatgagccagttcatgtgccacggtaattgcaacctaaaaagaacagttgcttacactgaaggaatttggacgtcccaaagaaaatgtctaataaataataatgcatcactatttacaaagtgaaccataaatgatgaaatatgtaactaaaaagaatctgagttatgatatatacattctgtttgaaagatgctgatgaagactgctcatcaaaaagcaaagaaacttcccggtaagtgaccaatccatagttctccatggccccagcagcgaaatcaggaatagcaaccatgtccaacttagggagtggatatggagtatcaaagtagctagagcacagaaggaatgaactattggttaatgatttaattcaagcaacaaccttgggcacatagaatatgcattagctgaattattatagttgtttagaaactaattagaaagcaatacaggtacaggttgtgatcatactctttgtagaaattcaatgacttcactccaatatctagtgcaaacttcccttgactactcttaccaacttgagtgtacacacggactttgttgcctgaacacaattaaacacactaatgaaatggaatgtaaaagggaaaaaatggctcctaaagcaccttcaatgtgagaaactatgaaccatcaacaatgttgaattactgggacgagaataaagatggttaccttccgatgttacaccttctacataatcaaacaaaccaacaactatggccaccaaataagttgacataagcggcgattcttcgtagtggatggtcttgataggaccagcaattgtctcacaagctactggcatgttggacaatgctactagctcagatggaacttcaagtgttaacttgaactttgcctgaaaatattaaatatgaagaggggaaacaacagaaaaaatagatatgatatgtcaacacatattgcatcaaacatctggacaagaaaattatgattattgaacaagtcgtgctatcataagaattaaccttgaatgcaggctcatcccagcaggggaagcaccgtcgagcatccacagcctcaaactgtgtcaccgccatgttttttgtctcccctttatactcatatttactgcaacgaatggcattttctcatatgaaaatgtagatgatacacacaacttgtcgaaatagacccaaagcacagattcataactactttccaaccacatgcttgcataaaaagccctcagcatctatagaaaagtattcttgcaactgatttgtgaatcacaatcaatataagtgcaaagtaggcagaccatcagactatatatttatcagttatctcctttgcctacaactccacgattttgcactgacgattccgagcatttcaacagaggttcacggaataaagcagaaatttcaacaaacgaaagtgccagctttcaggctgtgaacttgccactgccattggtgatttaaatgcattaaaaattaccttcggtaaaatcccctcatctgatcgttgagcgtgccgttgaagtccatggcgagcacgccctcgccgagcggcagctccccgtcgaactccagcaccaggatctcgtcgtcctcgaacagcgacacctccgtcggcgccaacccctgcaaccaaccccaaccacggcgagtgagactgcggcgcggcgaggaggaggaggaggaggagaaggtgcagagaggtctatatatctactacctggaagcggatggaggcgcggtcgacggcgaggtcggcggcgttgaggacgaggaagcgggtgggcgcggagacgtcgacgaccacggacgcgtcgccggtgaagacgcatgcgtcgaggtcgggccggaggcggagctcgtaccgccgcggcgccgcgaaccgcggcagcctcgcctgcccgcggaactggtcggccgagcccgccggagccggagccggcgccatcgccgccggtgaaggggaaggagccggggccgctttgagattcgtgcactgcgcgcgggattaagagaaaagattcgggtttagttaaggccgagagagagagaagaagggaagacgcggcgagcaaaggcgaagcgtgcggggtttggttttataatctatcggaagtaggagtattaacgtctagccaacgactgacagtgacagtcaaattatcatcacagcaaaaaaaaaaaaaagtcagtttcatccgaatctactccacatgtttcatactcctacttatatagcggaagttttctttttacacacacgcacacaccactacacacgtaacaccccactaatatgtcccctaacacatgctctaagagacggaaactagcgacacatcactgatctcactaaaatcatgttcgaaagttcatttgcatatacgtaatattcgtgggcaccagaatttaaattatggtgggtaaaattatacacccacaactctaccacgcatcactggtgcttctactagcagaagtttttataatgaatgaagcatttgtgaacatacgcacactaatacgtttctaacccacattaaaagaaatggagaccgttctaattgaataatgatgctatggaaatgactaggacggtattttagtcagaactaaaccgttctatttatagaatcatgaagttagtttaagtccagattaaacgtctttcagagttcattgctcgacgaatatggtagcacataggctcgtaaaagaagttgtttctctagctgttttacagggtatttgttcctaagggttttattctatcttctcaagaggacgattgtacaaatgtgacttaaatagagttactacttactccctccgtccaaaaataaataaatctgggactggatgtgacatatcctagtacaacgaatctggacagatgtatgtccagattcattgtattaggatgtgtcatatctagtattagattggttttttatgggatggatgaagtacgcagtttctcaaaaaaaaaaagaagaaaataaatactccctccttcaaaaaaaaatatgagacatatttcattcttcgatttctcaaaaaatatgagtcctgtgtgctaaattaaattgttgattgaaaaccaagaagccattctaatacttattggttacatgttcattggttttgctatatggtgagtgagttaattgctttttggttttgatgttttgatgaaaaaggaataggccttatatttttggaaggagggagtagagaccagcagcaactcccaataccatcaataaatcccactgaaaacgtccttattgtgtacttaatatacgtggacaacgaattttaaacccagatgagttaccctcctttattgtgaactcatttaaacccttaatatacgtctattaattgtgaactcatttttagctccaaatgttacactcgaaattctaaaacatttccaagttcaaaccatggttatgtgaaatttataacgtgcaaaggatcaaacaaaacctgcaggatcgatgattactgttttataccgtgtttgttgctggcgttgtaactatggatcattattctagatttcaccaacgatgtttactgctcccttggttttaaaatataggatgtaggactttggccaacaagtaatatttatataacacgaaaaatataattataaaaaagtatttttgaatacgaatcgagtggtatcattttttttcaaaaggatacatttaatgaagtaactgttggtcaagactttaaaaaacaaaatacatcctgtaacttaaaacgaagcgagtacaatattaaattgttaaccatacatatcgaatcttatatagtttggtcaccaatacttgatgctccacgaatttaaataaattttgatgcataatactccctccatctcataattattttgacacaattaactttaccaataaagttggaccagtcatcttattaaaataatcgtgtaaatgctatttattttgtcatcatttgttttgttatcaatgatattttaagtgtgacttatatatttttcatatttgcatataatttttaaataaaacgagcgatcaaactacatcagtcgcgtcaaatatttatgatgagagggagctagtgcttttctattttgccgttgtttctttttgaaatattttgccgagatatttttatttgctgttcttaatataagatcgatgtcatcttttatgggccacgtggaacataattgctccctcaaagtgaaggtgtgtcacactgtcactctacattaatcacccaatattttcgattttcatactgaaacgcagcacgtgccttgaacagcttaaacacggggcccagggtgatcaggatattataaaatgatatccaaattctgtagcgcatattttgtttgttcttgagctgctctcatgcgcatgtctgtgaatggatcataaacaaatgagcatgtgcactgcgttggttcattttttttttctattttaacacatgggagcatatccaattattgtcgctgatgtttgagagaaatataatcgaaaaaggatcacatgatgaagtaatgataattcgattgaaagcataatttttattaattcaaatcagcttcataatgaatggtgccactttatgaaaaatgggaatggcaacggcaccgacaagcgcaataatgcaaaagggcgtttcagttattatcgtatcctattatcattaatgagtttttttaaagatgccttgatcgagcaattatatgcagctccaacatatatgacaaattcctatcgataagcgtcacgcactattctactatgggcgaataagcttgttaattagagttgattcaggggattaatcaggatgaagaagctttgttgtcggttgtcacattacgaatccactgcactttgaacagcagacgaaattggaattagagcagagtgggtgcagtagactaacttagtggactataaaatatgctatgtcattctaatttctatatatgtggagaaagaactaaaggaaaataaagtgggcgactcatcgtcagttgatagcacaatctatcgcactccgtaacagacgtgcagtcggtgctgatcttttttaaaaaaaagaaaaaaaaacatgtgttttgtgcagccgtaagggtgttcacaatgcacacacatgacatgtggcaaagtctatccaactatgcacaatgtccgtgtggaggagagaaggaggtgggacccatgtaaaaactaggttcgtgtggcttgttttggctccgagaacctcaactaaatttgtcagagaaaaagcatgccacacacagagcaggagagagagggaagaagctcgccggagaagccacttccacgccgaagaagctcgccggagagggagaggagtaggagcgccgctgccgccgccgttgtccgtggctctgtgcctgcgccccgccgtcatccacagtgccgcggccgtgagatccgctgcgccgcttgacgccgttttcgtcttctgccacgccactcaaaggtgccgcggccgctcgacgccgccgccgtcatccgccgtgccgagctccaccgaagacggcgagatgaggggagagagagaggaccggacgagaggcgacgaggaggaggtgaacgagaaggcacctagccgccccgccgctgccgcttaggaagaggagaggggggttggatctcgccaccccgccgctccgccgggccgccctcgatccgccaccgccgtcgccgccgctcgggccgtcccggcgctcgcgcctcgcgccgccctcgatccgccgcgggcgacatcgctgctcgcgccgaggaagacgcggacgaggtggcgggggcacgcaagaggagacgtggccaagtctgccgccgccgtcgggcgccgagcccgtgggatgccgttcgccaccgccaccgccattgaacactgaggcgggtaggggagggaggcaggcgccgatggggttgcccgaagatggagaggaatctgttgggaggggatggatgggaaaggtaaagaggagagagagagataggtgaaagatgaaaaagtgatgttggtggagccatttcaattagcttgcactgtgggttaagttgcttggtacaagttccatccaatgtgacatccccaggcagaacaaataatgtgacgcattgctcttgtcctaacaagcccatcctgccctagtgaattagcgatcttccctccccgtgcactccttttaacttgctcttaggcattttccatcatacttaagttggtcacgcgtgtataataattctgttgacgagactatgattaaattgtctgtcctctcttaccgatttaagcaacgtatcgatgggtacgtcacctaccattaaaagaataattaaatagaatcagagacggatctagaaagaactaacaggagggctgaacaaactatacaaaactatagtccactcttctaatagatatatgtcaaaaaaatttagtagtgagtggggattcaagaccccatagctgcatggcatatctgccactgaccataataataattagtcgtaaatgcgagcacctatgtcaagtttaggacttgaacccgggtggattattttcaccacaagaaatttaactagttgatatacgttcaattcgtagctagaggtctaaatttaagccctagtaaacacaacttaaaaaggttgcaatatgcttgttctttaagctgatcccaaagaagcttccatgcggggaaagaatcatgctgctctaatcattttccttatagcgcataaaccatacaacaacaaataaaataaataaataaataaataatatgtaaatctaacataaaaatataccacgatgaaaggacttcaaaatttggttgtggctgataataagttaacaagaagacgatgagaagcacaagaggaaaaaaaaaactctcatggaataggtatcacccggcccggcccggcccagggtgaatggaagtgggcctcaaagattaatggccctactttactgaacgtacagcccagcatgttgacggtccaaaggctgcatgaaagcagcagaagcaggagacctgaacctcaacagctggtgccctactactggtcactgcggatagcattcatggcgcagctaacatacagtaacatgcagtgatccacccttgcatgcgcacgctacaaccaccagtctacacagatctgggtatgaccgtgaatacgacacaactaacctagcccgtgattccacgagcattaattagtcaatgccaaatatgttagtactcccaacctacagtagacaatccagaacgtattctaacatgctttgatttagagaaaaaacatagcagtattttagaggatttcaattctactatataaaaaatttctataaatacttttgaatcaaagaaatgaatcctatccaatcatttgaaactcctatggaatagacaatcctatagagattttggaggaaatttagcaagagctcaaagctcttggaaattttgctttgggtctatctccctcatccgatttttgagtttttcctacggtttaaacggttatttatgtgtgtttttctatattttgcaatcatttgttttacattttaattcctgttagaatcctgtgttttttctatttcttcgtttttttatttctgcgattcaaagggatcctaactattacgaatgtccttatactatattactcaatttctaggacgccctctttcgataatatgcagtgatatagcatatatagaattgaacttaatttctaaaaaaggttttgaatgtcactttggtaaacgtaattttctattcggagatatttacagaacctgctggtaaattaaggattagtattgtagtatttttgagaatatatatacttgttagtattatattatcctttatccaatttgatcatcggatatacttcctctctctttaatattataagttatttgattttttcttagttataattttttgggtttaactaaatttatagaaaaaatagcaccatttacaacaccaaattagtttaattaaatatagcattaaatatattttgataatatatttgtttgtattgaaaatgttattactataatttttctataaatttagtcacattaaataagtttgaagtagaaaaaaaaatcaaattaaacgacttataatatgaaaggagagagtatatatgtatagtaagtatggacggtgtacatccagtttaaacatagagtctggatattaatcaaaattttaaaaatatttatgcacgtgtacatccagtttaaatatagagtccggatttgaatcaagattttaaaaatatttatgcacaaggaaatatatgttcctgtgaccatgccgtaaagatacttacgagataagttggcaacgcaacaccacttaaatctattcgccattgacatttccacgtatatacgcctacaatagtagagttataaacccagtcacttacctgcgtggaagcgcccccgccgccaccgccgccgccgccgcagtgccgccccagcctccgcccgcgttccccgccgccgtacctcatctcctccgccgccgccgccgccgcggcagcgacgacgacgacgacgagcggcaggagcagcagcgccgccgcagtggcggctcgagccatggagaacgaaatcaaaagcccggccccttcttcttctctctcacttctcactcactcactcacgcacgcacgcacgccgccggcgacctaagcacacggtggtttccccctctctccggcgaggtggtctcctcctccaattctcctcggcgagtgcgtgcgtgcgcgggcggtggcgcgcataagtagggctaggcttggactggagcgcgcgcggttgcgccggctacgttgaccggggaagttgtaagcttagctctatctcgtctcgtctctctctgctagtagcagccagtcaagcgatgcgatcgatatgattcaaacctgaaaaaaatcgatgtcacttctcccggatcgatccgtcgatatcgatcgataacgacggcgaaagacgccaacaaggaaaacaaattaaccaaccactcagcttgtactgtctactacttcccgtccaaaacaatcgaattttagctattaattgcaagttaaaattttaactatatgtatttaatggatggttattgtgttatttggattgaaatgtaatgtgatcgaccaacattaaaccagactagtctacaatctacaagtctatatcctccgtctaaaaaaaagacaacttttacctatgtaattaagtatctagacgttggctatatctagatacatagtcaaaaattgtttttttaaggataggagtaccgattagcatcaccaaggttcccgtaacatcctctcaagtccaaaattagagacttttaggtgatacaatccctccaacaaatcttctaaccacctactgctgtgtctggaaatataactagtcttaggccctgtttgtttcagttaagattattgtaactagattattaaatcagattactataagctggattataataagctgacagaataagctgcgagttgtttgtttctctggattattagaggcatataagggtagtgggtctttagccactcaataatctagaaaaagctcctatagaggagtttattggattatactaatctagcttatagattataataatctacttgtttgttttagcttactactaataatccagattataataatcctaagctgaatcaaatagggccttagattagactactacaaatttagatagactgactaaatttatagtaagataaactgtctagatttgtataattaggatacactgtctaaatttacctgacagcgaatgtagaccgtttatcctagtctaggaatctagttttagaatctctgggttaaaacctagttttggaagttggaaatagtgacaacgacatcttatatgttgtgaccttcttggaggagtcgcattgggggttctctgatgacgtggtgtccttggtagcaatgctctcgtcaaactggatttgatggctatgatggtggcgagatttggctgaatgattaatttacaactcatttactttccgacgttttttttttatttttggttcaacgttggttatcgaatgtgagtgaaatccaatcagcacaatgatcaaccgttgattacagagattatgtattctattttaaggtagacaaaaactaaatgcatcttataagccgctggggagaaacaaacggttatactcttaccaatcacatttcaatggtagagaaaccagctttggtcggttgtccaaaatctacaataatctcggtttgaataagaaccgatgatctttagtcccggttgaaaaagctgacgtcactttttgatctttagtcccggttggtagtcccggttcgaaagaaggcaggctgtgtcagacccctctatgaccaaccgggactaaagatctatttttaatcccggttgcttataacaaccgagacaaaagaaaaacgaaaaaaaaatcgcaccgcgcctcctcgagaggaccaacagccttatcctctcatcctctcatctctcctcctctcccttatcttctccaatcttcttctcccttctcatcttctcatctccttcttctcttcttcccccttcctccccttcccctctcctccccctcccctgcggccacggcagatccctccccgacataggcgcggtcgcgcgcggcagatgcagttgtggcggcgcaggcaacggcgggcggcagaagcgccgcggcggcggcgggcggcggatgcagctgcggcggcgcaggcggcggtcgcgcgtggcgagcggcggatgcagccgcggcagcggctgggctgcggcgcgtgcgctgcggccgtgcggcctggcggagggtggcggccaggtgacagcggtgaagcgaccagtggatttgtttttttcccatggagttgtgatgaatttgcttttgagaatttgtgatgtatttgatctgtgcgatgtaaatatgtgatgtatttgtgatgtttctttttagaatttgtaatgtatttgttttgaatatttgtgatgtatttggatatggtggatttgtagatgatcgatttgggatttggagatgatattttgttccgtgattttggggatgatttggggatgtggtgaaatcaatattcaaagtaaaaaacaataaaagaaaaaagaaaatactaaccggatctggcttcatttttactccggttagtaataccaaccggggttaaaaatggctccatctttaatcccggttggtgttactaaccgggaccaaagatcgatttccgggactaaagatagcgatctttagtcccggattcgtagtcccggttggaaaaccgggactaagggggttgcaaaccgggagtaaaaatcgtttctccaccggtgtttgaaagtttagccatgtgtatctctgtctttaggtggtattttaaagtagacttcttatttttaatcaagccatgattttatatttcattgttgtttacactgcaacctctatatgtaataattgcattttaagcaaatattagaataaagtttattactaaaaaaatatctacatcacaaaaggtgagtatgctcactaaaaagagtcaatgaagaagaagatagtactaccatgtactttctccgtcctaaaataagtgcag

SEQ ID NO: 13892 - DNA, 2160 bp, Oryza sativa
aaaaaataaaaatatttagtcgcacataaagtactattcatgttttatcatctaatagcaataaaaatactaatcataaaaaaaaatttaaataagacgaacgcttaaacgttaaatgtgaatcatgcaaaactacatttattcattttagaatggagggagtaccaactaggcaactactactagttctaaaaaaagtactaccaactactaccaagcgatggatggatcatggatgcatggatggtggatggctgtcgctctggctcatcctcggacgaatcactttgcagtcaacattaattccagctagtagtactaatattcagttaattgacctgatcaagtgacttctccctgccggtggtttcaattagatggagtgtagaagtagaactgtacatatatatgttcgccaatcgccacgaaagacgtgcagccagtggccaggattcgattattttatatcagcggccagcgttttagttgcgcaccattgaaatggtcctccgtcctcgtaaaaatttactatggattgagattcagtaacatgacctcgtggttgatttactatggattttattgagtaatgagttgtttattcttaaaaacaggaatctaccaactgatgatgtaatcttgtaataaattgtggtaaaaaatacatgcatatttgatttagaggccggacgtgtgtttcccttattatcagaaaaaacatgtgcgccctccgttcttcttaactactagctagtatgagatccttgcccactttcatttgtaagaaaaataattttaatcttataaaaaaaaatcctactatagtatttgaaataaagggttgaatcatattctttactttaaaattcttatgaaatggacacacttataaagattacggagacatgttaggaagagcttgaaccgattggaaaattttgactctatatatctctcatccaatttccatgttttttctatggtctatatatttaaaagattatttctatattttataatcttttattttgtacttacattcctgttaacattatgtattcttttttattcctctctttttttaatcatgtgtttcgagggagtgtatctatatagtctttaactttatagataatcatgaaatatataacctcaccaagaatattttatatttcctccattctaagatataaatattatggggttgtttggttctttatcctaccaaataatctatagtagtaccaattttttggcatattttggtaccaatatttcagtaggtagagatgtattaaatatattagtattgatactaagtaccggtctaaaccacgtagctatttgtcaacatttatctttgattggtggcatgctgccatgagcccataattggagaacgtgtgtatacaatgtttaatttgctaatggctctagagatgaggagttatagaggtggaggtagagatgtcgcaaatatacacctgttgtgaaacaatgttgatatgttttgtgttgaacgggtatcacactacaagaaaaggcattttccccgacgtgggggttttattttcgtagtcggacatgattctgggaaccaaatgaccgcctaaaaaaaatataaatcggcatgaagttcgctgtccgcctgttttcgcaggcggaccacttaagcgacgcctgcgaaaatagattttcgtaggcgcaccttacgtggtccgtctgcaaaaatagtacctaccaaaaaaaaatctagtcatcctcatccttatcctctccaccaccatctttatcctctcctctccaccactcatttccctccccctcctctctctctccccccacacttggaaaagttgccctgctccctcctctcccactcccgcgagccgccgcatccctcctcgccgccggcggcctccctcctcgacgacgacgaccgcaacaccgccgacggctccctccgctccagatccacgcgccgccggctccctcctctcccacgtccgcgccgccagcgccctccacgacgacgtccacgcgccgccgcatccctcctcgccgccggcggcgtcggcggcccccctcctcgacgccgctgacggctccctccgctctagatccgcgcgccgtcggctccctcgtctcccacgtccgcgc

SEQ ID NO: 13893 - DNA, 16536 bp, Oryza sativa
  unsure (1)..(16536): unsure at all n locations
ttggatttctgtgaatttctatggactcgtgcaacgatccgatccggttagtgtgtttggagatgggagacggaaatttgtgtgattgtgaatggaaatttgtgactgtaaattggtgatgtaaatttatgtggatttgtggatcgatgagtggatttgggattaatttgaactggcgttgacggaggcggacggagcggtgttgctccgtcattttttttagcctcggcaagtattaacattggcagctggtatagtctaccgcctgtgaaaattcattttcactggtggctagcttacaaaaacagctagagaaaatggattggtgctggcggttggctaccgccagcgaaaacactgtattatcactggcctttactcactggcggtggcgttggccgtcagcaaaaactcattttggccgccagcaaaaatagtttttctagtagtgtcggcagcacagcggctgtagtgcaggttccttcccctctctttccctcttctttctcttctcccctcatgtctcttccctctcctgtccatgagattttgaccaccggtggctcttgctacagacaagggtgacggtggaggcgtgaggaagcaagcccccatccctccccccctcccccaagccccaaacggtgtcccctcctcaaacacctagaaatcccccaattttttctttcaaaggtgcatgatttctgtgggatggatttatttttcggggtacattgaatcacagcaggtgttttgttctctatttctctttcaaggtgagatgataatgtctgtaggtgggttgggttgtatgcttgatttattacaagttgtttccacggttctatgacattatttcagattgatgcatatacttgtatttaaggaaaacatgatgtatccaaggatgtattttgtgatgacctagtcgttcgtattacaggataatgtattttgtggtcctgctacccgttattatttctaaacatttttattattacatatatgtcatgcaacaactaaaattttatcaattttactttaatagaaaaaatacccatgtgttgcaacgggtaaaaatattttttcagtgatacaacaactattaagaattgagcaataaattgcatgcctctctttgacttagcccacaagtgaagccacaggcccagctcgcacatacggtgcgtagctcgcacatatggcatcttcaacctacgagagacaatcacgtgcccgtatgccagagccgatcctccctatcaaattgggctgaatctttctcgatattccaaaattggctgagggtgtttgatccgctcgatccctttttatattttttttctcaaaatcggagtaaatccataacactcgggataaaaatggttaggggaagtcaccggtcggccatcattggcgaattgagattaaatctgaataatttaaagtccaattgaaagggaaaacgcgaggaaaataatgaaagataagtgtggaatcgattttttaattaattgaaggagaaaacatacggtgatacaaaccgacgggacagcgggacggaaaaaataatacggcggtaaaaaaacaacgaaaaaatggcgatgagaaaaaccggaggaaggctgatcgggaaaccagcgacaaaaaaataatacgagacagaaaaaaaaacaaaagttttatgtattttttaattagttatatatagatatgaattataaaaaaccaactaaaaatcgactcagaaacggatgacgtacgaagatcctgataaaaatattttcaatttttataatagtagagattaaattttaaccttccatacttatagcgttcaaatcattaataacaataacaactattaatcctacatcaaataaatagaaaaataacaagggtagcattttccatcaccctgggctagccaaacacttttagggctcctttggcagcccgggatcccaccgggatcccagcccattccctgggagaaaggcccgcgggggaaattgtcacgggttttattccatgtccatttggaagcccacgaggcagggatttcccggcccaatccgctaggaaaccctagggaaaggtccccgacctccggaggtcaggaatttttcctctctcgatccgccgctgcttctcgctcgcgcaaccggagtcgcttctctctcgcgcgaacaacagcgggcgccgccgcgcctccttctccggcgagacggccaccgccgggactcctcctccggcgagaagggtaagcccttctccttattcccctcctctcctcctcctgggtttccattctcctcctcctctagggtttccgcctcctctagttagctcccaatctcgctctccggtctcagcgcttgcatcgcaggcaccgacgcgtgggcgcggcgggtggcaccacggcagccggtgcaacgacgacgaagcggcgagccgacagcgcgggcacacggctccaagcaggcggggacaggggggatccaaggcagcgcgactcaccagcagaggaggcgctgaggcgcagatccgccttctcctcctcgctgcgcgacgcccgccggtggttgcccggctaggtttgtgcgtgcccttgtagctgctgcttgattcttgggggttcgttcagtacttcagttttcttggtgtatgtatggcatgtttcttgatttggtttgggagagttataatctgttctcctattctttctaatacattgtagtattgtaccctgcagtagcatttcattttgttatggaagcgattcagaaggggatatgggtgggcgtgtggtgctcttgttttagatcatgaatgagttttggtaagatgatgttctaatttgatggagtaggttgtgctctggttttttctgcagtgtaattatcatgcttagtgcagtctaaatatgtgagatcaatgtgccagtcccaagaaatgaggaattatcacacatgcagtgaggatcattcaactagtgaggtatatgagaaattttagtctgcaaaccagtaacagtttttttctagttaattagagatgcagttcttttagttagatgctgtcagctctgttaacctagaggtagatctcagtactggttgagctgctagcatcaagttttttgttttttctggaggtattttttagtctgatccattcttgtagtctctgtcagggaactgtagaattagtggtcaatttagcatgcatgttgggactaaataaatggtaacaatcatatttttgataggaactcatacttactacaaaataaagtcttttatgctctatacttatacattagtccaaactttagtttcatgtcatgtatcaccagcagaaaatgagcaaggtggcattgtgcattcaaaaaacacaagctttggcagcaacctatatacaaagacacgcacacacagatgtttcaatctcctctctctcactcgctgcacaatacactggccaaacaaagtgacctagtagtactgattaattaaaacaacaactactactactactttttttccttatcatgtccataatgataattcataattgtgctcttgcattcttcctcttgccaggattcaatttgaattgcatgctcaacttactttcaaatatggacttgaaatagagtattgttggaaaactatcaatacaaaaacatggacttcaaatgcgtttgatttaaaaataatggtgtgtatctgcatgtagggtgtttgataccaagagtttgtttacgctgatgtagctgacaattgcaatatgttggttgatgtgcatgcatttttttacctaagctagtatcaatggccgtccttcaaatttgattgctgaagtatcactattttatatttattacttaaatttcagattatctttttcatcctggcagatttattagaatatatgaagatttgttgaagagatgatgaagaagatagaagagataaagatttaaatggacccatgtctcattcttgatcaagacatttgtggatataaatatgatgtacagttctatatttgtggatgcaaggatgattccaaagattttaaattttgtatgatatggatgattctaaagtttaacttatgtcatgtcacgaagttggtttccacataaactcacctatatttctttgtatttttctgaatttctaatacttgttgattttttatgtttttatatttttttctggaatttttgtaggttgtttcctatttatatggattttctatattctttctatttttcttgaaatttctataatatttctagagacatattttgttgttcaaacactgtttagcagtttgcctgtctaaatcccccttcccccatcaaccccctcaccctactcccaaatggtatcagggaaaattcccctaacaggagtgattcccctggaggtggaaggggatcggttagtgcaggggaaaatctctgtacgggactttttcccgggggtttcctccccctgcatccaaaggagcccttagggataaagctagctcccactagagctagtgtttgaggggaattaactatttgccacttatccaaatggtatttttagatttgccttttttttttgcccttttaaggtgatggcttcttaacaattttaccacttttgtttacgtggcgtgccaacgtggcttgcaaccttaaaaagcagagcgggacccacaaatcagcctctcccctagctttatcttccttctcgttcatcctccagcttgccgacagggaggagctcgctcccaatccggcatccctccctgcctccctccgagcccagcaccggcgagctccctacccccctccaagcctggtgccaacaagctcccttcctccctccaagcctggctccggcgcgtcggaccagttgtgcaagtctacgaagatcgggaccgtcgggttcgtggctcatcgcgcggcggcccttggggcatgctgccatgaggttgcagagcgcggcgagcacgtggtccaccgccataggcgatggagaggttcgacggcgacaagcgacggcgctggcccgatggatagcaggtgtgacgcgcccgctggcgcgatggagaggttcaggagcgtgcgcagcggcgcagggcgtcgtgccgcgcttgctccgtcggcacggcctcgcccaccggagctacgcacgggtggccctccccttagcggcatatctcctcggtggcgggcgtgtggaggtgggcggccgtcctctcagcggcggtgccggagctcggggacaccgggcatggagcgggcttgtccccattggcaagctggaggatgagtgaggaggaagatgaagtgaaggggagagactggcttgtgggtcccactctgctttttaggttacaagtcacgttggcacgccacgtaggtaaaaatggcaaattgttaagaactcatcatcttataagggcaagaaaataagagcaaatttaagaggggtatttggataaatggcaaatgcaatagtgacaaatagttaaattcccaagagtttgaagctagaatttgagttcgagcccttccaaacatgctactccttccatcccaaaataagtgcagttttagcactgttcatgttcaacatttgaccgttcgtcttatttgaaaaacaattatgattagtatttttattattgttagatgataatacatgaatagtactttatgtgactaatatttttaattttttataaattttttaaataagacagatggtcaaaacgctggagacgaatatctatagctgcacttattttgggactggagatagtaggagctatctgaaggagactacgtcgagacagagacaaaacgattacgtaaagcttgatttccgccttcaggggtttctgaacgagagagagacagacggcggcgggcggcggcggcggcggcgagggagccgaagcctgagaggatggtgtttggccggagcaagtcgtcctcgtcgacggcgtctcctccccctgctgcggcggcttcctcggcggccgcggcggcgtgctcggagctgcgtgcggcgtaccacgagtgcttcaaccgctggtacgcggagaagttcgccaaggggcaatggcacaaggacgactgcgtcggcgagtggcacaagtaccgcgcctgcctcgaggtcactcccttctcgccgcctccgaattcgatcacagcatcactgatttattaccgatcccctcaatttgttgcaaagacgactgccctagggattgctcttgtgttttcgcagtttaggatggggtttcatttaagtaggtttttagtttatatggcaagaaatcgagttgttttctagtgtgttggttgctagatcaagttgataaagtggcttatgtaatggtgatggctaaagcctaaaggggattcttctttgaagaatcatctgatttggagctcctagttagacctctgtctgtttgttggtcatgattcaggctaggcggcgcatgcgctgcgctggcctgttgaattcctccgttacaaatgtgtgagattagtgctgcttgattcgctggtgctgattgttcatttttttcgcacttgaagtatggaaacacacacggatctttagggatttagtccaaatcgactatgcaactgtttgggtgagaagtggggctctttgacattcagacattcagagtggagttgtactatatggcagcatagtggctgcaatagagttttgagggaatcgcctttccgtcacttgacagcccttttgtagattgtctatactgtctctttgttatttgatctcataaatcttgatgaaattcatcaggtcaatctttgggctggcctgtcttaagaaaaaaattttgtgctgctgtgtgcaattagaaattcagaaacctttctgaaactagcaatacaggcatctattttccattcttgaacagaagttacacaacggtgtagttgtccttgcatttggtttattggtttatggaaaacagttggggaagaatattctggtattgttgtattgctaactggcatctgaatgctttccaaaccattttcctacatggtgaattcgcaccattgtatcagcttctagccaattgtagttagtgtattgctgactgagaatttgcactagggctagcccagtgtgttggaggttggcaacccagcctgaagatagcccatttgtagcaaaattcaatgttcttgatgagttttgtttcttatagtactaagttatcagaataacgtgaatattcatgttttggggattgagcgcatcaattttctgaaatctgacaaaagagtgatcatgttgtggtattcatcataacatatttgtctgagtatttcccaggatttcttcaatttaacataaatcatgcctcccatcaccattgtttcacttgtgacaggcctctgggtaaattatgttcctcctatgaatatgatgcttgtttttcgctaaacgaatctatggatgttccatgtttttattacttgcaggaacatctggaagacaagaatctcaggcaaatcctattggaatcagaaacatctgcctactatgcccagtttgatgctgattcttcttctcgaaaaggtggcacctcgacgaagtgacaacctagggctaaccacatatgatcaagtttcgcttgactcaacctggattaggagaccctcatagatgaacgaaaaaggtgtttgtattttacatattagatgcatgttcatgctgttgcatcgcgctgcagttcagcagctgagatgtaagcttttccaagatcatattgaactcaaacctacaactttgatgtaccctgaaatttgcagcagtttctcttcctgaatctgggagaacagcttcagctatatgtaaacttaaaaaatattctccaacccaccaattttgtgctgcatcgatgcaaattttcaatacctcctatatgccatcttccaaagtcctttgagcatagttctggtagcgtgacagtgacttgcagtcttggaggctcttgtgttgtccgaatcagatgccttgactttgttgtctattatgatggattcattcaacaaagcttattgtttgtcacataggcctgatcctctctgatgtggtggcaaacaagcagtgaaagctaccagtctaccactcactcagggaagcttcgtagcaaagcaaagcatcagccttcaccttgtccagagcccagagaaaagggatccccttcaagctgctgttcttcatggccaagaaaggcaagaacaactctaccagaagagcctctgcttcttcttcttcttcctctgccgcagccgatggcgatggatcgccatggctgcggctgacggccttcgccgtgctcaccctccactcggctttctctgcatatctggctagagatgacgcgaggctggtcgccctcgtcgtcgtcggctacctcctgatgctggtgctgctgttctatggcctggccgtgcctgtccaacagaagagagactaaggtgaggcttcagcaatcagtcctcaagcatgaacctgccttgtttttttttcctttttgctggtttggttttcttgcatggtttgatcttggtattgaactatggatgttatgtacaaccctgtacatgctgatcaaatgtgtatctgtatgtttaattattgatgttaccaaagaatcacatgtataatataagtaattcgaaagagccacacactatggagttcagtgtacacttgcacaactgcactgagctgttagagttattgtacatatactgatctagatcaatgcttttatttgaatacttgtaccatttgcaactttgatcaggattgtctgctcgagtttgtactttagcggttgcatatattggaggcgtgtgattgatcagaaatgtctagttttgtatacaaatacaagcacttgaacaagaaaatcctttgaagttcacgtcagggaaaaaaaaaagcaatcttcttcacatcaaacaaaaactccctggaaacagtgtaaaagacaatagcatgaaagtcggggatatgcttctgaccatcatcacaccggcagtaaaaaatatcagaaattttgtgttgtagattttcttagtatatgacaatgaagttttttttttttgaacgaaccattcagatgctacattgattattattttaaaaatattcccaccagatcctaaaaaatatgaaaattcaattaaacaaaccaatgatttttaaaaataatctctgaaatctcaattcaaatcaccgtccccatgttttaagcctcttgcaagcaaatatgtagttcttcatactgtaaaaactttgcgatcgaactaataatagttggaaatgggatgcgttaggattttaaaccaaaatacagtacatcgcagcaaatcatcataagttaaatcagatgcctgagatgatttggcgcaagctcgtcccattcaaaagacttgggctgtgtttagatccaaagtttggatccaaacttcagtccttttccatcacatcaacttgtcatacacacacaacttttcagtcacatcattttcaattttaaccaaaatccaaactttggatccaactaaacacagccttggtaacttcaacaatactgtccctagaataaaataaaatgatatgacactagaacagagaatagcttagtactaactacccggctcttaggataaatcgtattgactatacatgtttttcttacttttccaacaagtgctgacctaatcccaacagcaaactcactttcaggctttcagctattcccaaataaattttctgaataaagtcatagacatgacaagataacgttcacagatcaccacaaataaactttcatttcaaccaaaaagaatgcataaatcccatttgtatatgttaccatgaaagagaacataatgatagtactggtaacagatactatgattttgtatgaactgacatgcctcttctcttcagtgggcaatgtcagtcaggctgcaatggtcaacacagagaatcaatgatttgtggtcaatcacaaacaaagagaataatccaagaaccaaatcctaaatcctgcagctaaaactgaacttactagttattacaggtgtaattaagtttccaaagggccttgctgggacaatcatctcatcacagatcatctgtaaatcagaacatcctccttggttgaatagagctgcattagacatgttttcctttcccacaaaaatgttctgtcaagcaagcactatgaacagaaacaaactagtctgtcaggaaggatcaggatcatgcagcaaaagaccaaaagtagttattccggtgaaacagttgcttcggctattcagaacatttgcataagatgaacattagcgatgtaagatacaatgtgtctctcaacttacaaaaacgatatacgagaggttttatgacagtaataatgcccaattttaactattatagcgagttgactgtagtcaacccagccgagtcaacgtagaactcacgcaggatccacactttggcagccaacctttcttcttcctcttttcccctcctccatctctctaggccgggaggcaggcggcatgcctaatttagatgggtctaatttgggccgctaccattggtagagtccaaaaatataggtgggccggatttagtagtcgcgaagtaaattttagcgggcctacatggactaggcttggctagctatctgtctgatagattagatattttgctaggtgggtgctgacgtgttcacctttctctcaaccacacgatatctcatagtcttttactccgaaagttggaggttacacgtgtgctacaaaaaagtttcgagtcacctgtatgccatgacacaaattttcgtttacctatgtgtcattccatccaccttctgttagagaatgagctctgatatatgagacccacatatgaaaatgaccaaattacccttgaagcattttcatctctactactcctctcccgtgcaatgccctagcctagccgccgcctctcctcgccggcacgccaccgcctctctagccgccgccgccgccggtcgtcgccggcacgccgccggtcgcagccgccgccgatttctcttccaaatgttccaaatagagcaagggcaaaatagatctttcaaacctccgttagtctccgttagtgttattccatccaaagtggcgcacaggtaaacgaaagtttatgtaatggcatacagatgactcgaaacttttttgtggcacacgcgtaaccttcaattttattaatggcgtaggggtaaaagactcacgatctcaaattcccaatcgaacggcggacacgaaaccaacgatccagtttaccctcgccgtcgccgccgccgccgccgccggagattccgccggcgttcacgcgtggaagctgcggacctgctcctccgcccccatccgatctccctggagcgaccgccacctccagagtccagaagctcagcttcgccgcccgagctcgatcgccgtcgcgcagcgtcgcagctcgagtgcccccccccccccccccccccgcctccgcttcgtcggcggcgaggggcgacgagctaccggatgcattaccagaatcagcagccaatcgagctcgccgtcgcccgcccacatccacaccagaatctgcagccagccatgtatcagaggtagtattatcttacctgcaatcctgcattatatttttgtatggttttcccgcacgatttgatctttggtactccctccgtttcacagtgtaagtcattctagcattttccacattcatattgatgttaaaagatctatccatctagatttattaacatcaatataaatataggaaatgttagaatgacttacatcgtgaaacggaggaagtatatgtgtagtaacaatcagtctgtatgctcataaaatggtgtgtttatatatatttatttattttaagaatcaaatgtataagcgattcgaaagaagctaacaaactatgaggttcaatatatacttgcacaactgcactaactgaataattaacaatttattgtacatatagcctttgtactcttcgcaacttttatcttcgtcgccttcttggatttatgcttcagcggctgcgtatgtaggaggtgtttgattgatcggaaacataattggtatgcaagcacttgaacaagacaatcctttgaagttcatggcaggaaaaaaaaaagcaaatcttcttcacaacaaaacaaaaactccctgcaaaaaattgtgcacaagacgtcaggaccttcagtggaaaggatatacttttgaaaatcgtcatacttgtagtaactagtaagtataaaaaaaatgcttgttctgaataccaaaaatatcagaaattttatgttctttgagatgatttttttcctgaactaaccgttcagatgctgcattgattaataaccttaaaacttctgcgtccgtgtttcaaaaaatatgaaaattttcaactgaataaaccatgggatataaacaagtgtttgtttgagaagtagattactgtcaaatggataagaaagaactagaaaagtaatctatgaatatgtgatgacttactagttacaattcaaatcactgttcccatattttcagcctcttgcaagcaaatatgttgttcttgatactgcagtaactttgcaaactgaaaataattggaaatgggatgcattagcatttaaaaaaaaagaaatatagcagtaatccatcatgagttagaccaataatacctgagatgctttgaggtcaagctcatcccattcaaaggatggatttgtaccttcaacaattccggcaccagcataaactaaagtgctatgaccctagaacaaacaacagcttggtaactaattggcccttaggatatggtaacaacatggacatatttgacaaaaaaacatcacatcccaattatatgatcaatcgtactgactacatttttttcttacttttcctagtagtgctgatctaatcccaacagcgaactcactttcagctcctccaaaccaaccaacaggtccagcatacattccacggtcaaaaatttctgatggacataacaatagaacattcactgatcaccataaataaaccttactttcatcaaaaaatcttttatcgtcaattttatttgtaattatgaaaataacaatatagttgcaatagattatagaggcacataccataatcttgtatgaattggcgtgcctcttcagtgggcagaccacaaacggctgggctcggatgaagagtatttaggatgtcaaactgcaatggccaggccaacacaaagaatcagatcgggtgtggtcatttttttgacaatatggtaaattaaaatccaaaattcttcttgcaagtaaacccccaaaaattctgaaaattccaatataaaagactgaagaaagccctgaatcatagactacctcatcgtcttcattcctcattcttgcagctaactgagctgacaggtgttgtactcttggaagtttccgaagggccttgctgggatggacaaccacatcatcgcagatcatctgtaaaatataataaattccttggttgaataaaactgcactggccatgttttcccccaataatattcttgcaactaggaacaaaacaaactatgtcagtatcatactaaaaaaaatcagtcagtgtaaaactcaacttgcctccagcttcttctttatgctgtcccgtactatagtaaattcattatcctctttgctactgcaagaaagttttatattaggacctccttttattttcttcacggacggtgttgatatcgccttaaatcatctggagataggttcattatatgtttatgaatcgaagaagggaaaggtaccttagtagcaaatcttgaccaatttgaaagtcatcagcccttgttttcccccttgctcgtgtaccagctaaagcctcgctggaaatgtttaagtatttccgatgaaataattgctctggctattcagaatatttgcataaaatgaacattagttagaacttaggtcattgttatttaacatgagaaggccaaaataagaaaaaacatccaagttcatgtaaatatagtaagagatattctaataaatcatttggagtaaaatcgatacaagagatcacacagaagatgtgatgaaggaatttgtttttcagaatagaattgacatacactatttccaacaaatgcaggagcatcaggtggctgtatacagaactgataagcattttggccctcaacctgtatattcagtgtcagaaagatctaattgttttaacagcaatacaagagatgcaatatacctttaaacatgccaacagttcaacagggtcaatgcaagtatcagtaatatatctgctacaccttgccagtacgacctgcagaaaatatcgatgcaagcttatttcaaaataatgatcacaacatgacttgtctagatttttttttcttttggggaataaacttgtctagattttttctttagcaaacagtaaatgaaatgaataatttacctttactaattctctttgcttccctttaatcatctggagagctttagtaacggcaagatcccaggatgcctttgtggggacatgattaagatttagtatggttgtttgcagggtggaattgttcactttaattggactggatgatatctgcagaaagcacaacaaggttactatcttccacagttccacatgactgacagaattggaagaaagagaaatgcataccttctgcaaagttgattggagctccttcacagcattttgccatgtccaagaaagtgaatcatcccatgcaatcgtcgttgcgagaaccgagctctcttcaagctcattgtactcaacctacaccaagtatcagaaacacttcaaaggagtcagtatcacattccatctattccaatccataactggggtgatcctggtaattaagtaaggacttacttgaggaacaatgaagtaaaatgatccaaattcctcccattcaactgaatgatcgctcgtggcatcgaagcggatagcaccataagcacgaatcagtgggcaatcccttggaagaaatctttatggacataaatcaagtcattgggtcagcaccagcatgaacctcattggaataaaaaaaaataaaagcaatcatgaagcaacaatcaagaaattcaaagataataaaggatcatgtgaatagttcaccatcaccaacaacacagtaggagaccatgtgaagtgttcactgacacagtatgggccaagaccagcatgaagctcattgaaataaataaataaataaatttataaaaacaatcaaggaattcaaagataattcaagatcatataaagaattcactaacacagtgcaagatcatgtggtttttttttctcttgaacacacgcaaaagttttgtgcttcatgataaaggagcaccagagaaaagtgtcttaaaccaatacacaaagcacttccaagtgagcatttatcccttctatttatttttcaggaagaaatcgccgtaaatttcttattaatccaactgaaatttatcaaaaaaattactagcaactagctgttcatttacttcttaaatttgctacgcatggttagtttctactattgtaatctctctatttttttaaaaaaagttaataacatcatatactaccccatcctaaaatataagtatttttattttttgaatagtgtaaatcaaacatttttaactttgactcttaatagcaaaagaataaaaagaaatatgttcaaaatcaataaacggagtatggtgagaaacgtccagggtctacagctaactctatagagtggtgagttagacaacctaagtttgaagcttcaccccttctaataatttgatattaggtcatttcctaatattcatgtctttttagtaggaacatatcctatgcatacaaactttttgtgcacactccgtgcacaataactagcaaatgtcacgaaaaattctataaaaaattgtacacatacttcaaacagtattacatctatatgtaaaattttatcttcaaatttattatattttagccgtaataaaaaatataaaattctgacagatttttacccttaaaactgtcagatttttcatcttttgttactgctaaaatttaatgaatttgaatacgaaactttgcatatatgtgtaatactaataggagtaaatgtctaattttttgtagaacttttcgtgaaatttgctagttagtgagcacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13894 - DNA, 445 bp, Oryza sativa
ctgcgaaaatcatcgattttcacagtcggggcaacggcccgcctgcgaaaatgcaaaaaaaaaaacgaacaaaaaaaatcgccgcacgcggctcaccgccgccaccctcccccggccggatctgagaggggaggggaggggagccgccgccgccgtcgtcaccgccaccgccgccgtcgtcgtcgccgccgccgctccacgccatcgttgctgccggcggcctcccccctctctccttcggccagatctgcgagggagggagggaggggagacgccgccggccgccccgcgcgcatcgtagccgccgtcgcccccaccggctttcccccttcctcctccggccagatgtaggagggagggggcgaggggagccgccgccgtcgcccccgctggcctccccctccctcctccggccagatctgtgaggaagggatggaggggagac

SEQ ID NO: 13895 - DNA, 13663 bp, Oryza sativa
  unsure (1)..(13663): unsure at all n locations
nnnnnnnnnnnnnnnnnnnnnnnnnnnnnnnnnnnggtgttggcgacggcgtttctcctttaagttcagctaattccttctgtagacggtacaccttgctctccaacttgcaaatcttgcctcgattccagttttccctgtcatgagctgctttgtctcgctccacacttactgcatccatagcactaagcatatgcaccgcatgcatcagagtggcactttcttcatcatcaggacaggtataggttccatagtcttgaccatgaggtttgtgaggatgatactggaaagctgatgaatccaactcttcttcaaaacgttgacgcaactctccaatggccaccaaagctgcttcttgacaagcatggctgtacgatcttcctccagcttcgaacttaatggacggaaggtcttcacgatcactagccaacgtcacacgaacacgacacttctcctcgttggggtcatgggaaatctggcgatactcgggagcaacttcatagcctacctcaaaagccatcaacctcagctccctgacgaatcctaacacctcgatcaaatttctcggtgaatggggcggcatctaaagaaacatagaagagaagaattaaagcattctttaagttagctgcaccatctagacttaactgatttttgaccaaaaaggtagaaaataatagaaaagacacatacaaagctattttataaatatatttttagaatttaactttttggacagggacaaataaattttttttgacaaataacaaaaataaaactaaaatacttatgatctattataagcacggtacagtgtcaccataagaaagatgagtagtactagtgctatcatgattgtatcgataccataataaatgtacagtgccgactaatcaataagatttggtgaagtgaaaaaaaaacattttgagaagaataactttttgcttttaaaagaaaagaaattgaattaaataaattttgtgcataaccttgcatgtgctgccaacttaattaatttataagagaatagagaagagcagttctatttttttcaaaatattttgaaggctacttaaggtttaccatttggcttatcctaaggtcaaggtggctctaataccaacttgtcacgcccggaatttctatccaaaattccaaacgcttacatgtgtgttaaaccctcgtccaggaattaaccgaggcacacaatgacaaattaataatagagtactatttaatattcgcaaataaaaagattacagaggtagatagttcctctcaaaaaaaaacattctacgcagcggaaaaataaaactataacaaactacggaacagctatggctactccactccacaggcatcttaaccaagaacaagcctaatcctccagatcatcactttcactgagatactcctcttctgatgaatgaatattgcaagaatgagcatatgacatactcaacaagtcacacagcaaatatgcatgtgcacaggataacaaaggatggcataatatagctcatttgcagaaaacagcatttaataaatatttaagagaatagtaaaacagttgaataattaatcaatattaaataacaccatacaacacacccatgttgcataggcccaaccacatttgaacaaccaaccccagttgaacaaattaaatctccaaaccaggaattacccattccaaaccaggaatcaaattaattatcacattattaacattgatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagtcgtgacaatacccctcgcacaacataacccattacagcgcacctttcctggatcataatcacccccttataaacaaggcatggactccccagcgacccccatggacttctcgccacttctcagtctggcgcactataatgaatcacgctatacaaaagataaagccgttgcccacgctagcttgtggttggcacgataaatgtttcacaacagtagctcgcgaaccggtccttaaatgtcatgagcacaaccatcaaaaccatatgctcacaacccaccttaaccaggttttaattaccaattaattaacatcacacgattaaccatcgtgaaccaccattgaatataaccatcattaataataataataataatataatataatttatatttaacccctttagttagctaatgtttctaagcatggctaagcaaacttacatatagcatttagctgaaccaatccaatatataaggttcacgctaatcaaattataacccataggaaaataaagtcatcttcggccattatttaattgggaaaggttcaccacccgatgtcattcaaaaacaatgcatagttgaaataaaataatagctttaaacgggttcaacatgctcaaagggttgtttgggatctatgtgacttgccttgggcttccgcaaacgcttcggaaccttcctcaaaggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccgaagttttaatctattagaaaatcgggaaaaagataaactgatgacatcagcatgacgtcatcaatggccggccggctcggatggcgacctcgccggagctagggcggtcggccggggatttggaggacatgtacacgtagaggatgacgagacgaacccaacggtactcaccctcgagcctaacgacgaacgacgacggccggcgacgagaaggacggcggcggcggctcggtcgggcggcggtgaaggggctccggtggccggcgacaaagaagaatgggcggccgggcttcctcacctccgggcacacctaacggcggcgacggcaagcggcggcgacggcggagacggcgcggcggcgtggccgaagacggccggcggcggcggcgagctaggcgcgcgcggcggcggcgctacggagcacgggagaggacgggagttggggcaaacgaaagagggcgacgagctgatcctatatatagccttggattgaagagatcggactcctcccgtgagaaatcgactcgggaaatcaaaaactcggttttggagataaactcgaaaacgagtttgattcggataaaatacccaacgatttgctccgattcttggggggaaaggtagaggagaacgagaggatcaaaaccccccaaaaaaacgaaagaaacggggtcggattagagcggatttgagaggagaagggggctcggtcgggctcggcatggcagccggccggaggttgaagatgaccccgacaggtggggtccacctgtcggcggctggggaggggagggcggctcggcggctgctgggccggcttgggccggcttgcccgcgggagagaggagagatgttgggccaaaaacggcccaacggtttaaaggaggggttttagaacttttcaataaaaataatttgtgaactattgtttcatttgttaaaaatacttcccttgctcaaataattcccagaaaattctagaaaatagaggagcaagtatagtatttaataaaattttatctagctcatttttatgttgaaaattttcctataaaattagggtttagcttgtaggcttttaatttaatttctaaaaatgatttaaacaatgcattttaaatttaggcgatttttagggcgtgacagtatacagacggaagacgtgacatagtttccaacccatcctagccatagacaaaagtaccgacccaatcccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagactggtccttatatggccgaggtgctactatcaaaaccatgcaccccgagcccagcctaaaaccattttggggattttgaatagagggggaggtgtgaatccaattccacaataatccaacaattccatagtgtccaggtgatatgaatattcccaaagtctagagttgtaaaaccacctaatgttacctagttaaatagcgaagcatctacctaaaatcatactagtggtaccatgagtagagtgtccactagttggggttttgtttaatctagggtgaacaaggtaataataacaataacaataataaggtcataacaaaggtaaataggcatggctagataaaacagtgataacgcgggaattttaaataaagcgataatgcaataatttaaagcaacataattttataaactgggattcaatatgttcaaagatcatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcaaaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaatggatttattgcgtcagccgaggggaggggcgcgcggaccgggtccacgggagtggggcccacgcggcagcctcaaggtccacggtggaccgggcgcacccgggctcacaccggccggcgccgtgggtcccacgcgtcaaccgcacccgagggcgccggcggctgacagccaggccccacgcgacacccgctcggtgcgcccgaagacggccacgccggcgcagcggcgggagacggcgcgcccgcgcccctatggtcgccggcggcggccataggcacggcggagcagcggccgagagaggggaagggaagggggaaacgaatcggcggtccacggctcaccccgggtcgacggcgacgacgggaacggcgaccggagcggaggaaggcggcggcgcggctcgggtggacggggtcggcggtgctccggcggtcggcgagcgaaacggaggggtggacgaggtcggcgaggatgcggcgaagccgaaggaggcggcgccgaggcgggaaatggtccggagcgacgacggcggcggaccggagttcggcggcgacggcggagagagagagcgacggcgcgagctcgattccggcggggagagagggcggcgggtggcggaaacggtggagggaggcacggggaaggtttatatagggttgggagggggagagagctgccggacgagggggaaacgggcgcagaagatccggcctccattgatggcgccggcgaggttaggggagaggtttccaaacgaatccgagggagagagggagggaaaaatggggggaaagagggagggaatcacggggaatatttcccccctcttgattgcacgcggggcggacgggggcggcgggattcacggcggcggcggcggcgctagggcgcgggcggggcggcgggagcggcgggaggaaggggatgacgggtgggccccacccgtcagcgagggtggcaggcgggcccgcccgtcagcggcgcgcgcgcggggagaggccggatgggccgcggggagaggagagggagggggagggagctgggccggatcggcccaagagggagcgggggagggaaagggaactttttagggtttttcttttttgtaaaaccatttcaactttgtttatttcttaataattattatttgtgctctgaaaatttcactaaaatttatttacgcattttaggcttttaggaaatatacaaaaatcctccaagccttatttgacttttaactttgcacattttaattgttggaggctttcacatggattttaattattctaggcataatttagaggatgtattttagagtcgttttgggacgcgacacaatgtacccaagttagtgttttcattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttggcaaataataatgtatagttctagaatcgtgtttacaaaatagctttgagcaactaagtgtcttttaatgctgtttactgcaaccctaaccctttatgttataactcccttgtactcccttgcatctattctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccactgtttcccgtttgtctttgtgtgtgctgggcctccgctgcccatgtaataatttaactatttacgcttccgcttgttaaactctgaattgtatcaactcttggtgtaccttgcctcctgggacaaggaataatacacgcacgtaaggaacgcccgttgggttaattccggtcgtgacaaaatggtactgtttacacgaatgattcctgttataaaaagggggtccacactccgggcgctcgtctccttcctcttcctcggcccgaggccgaaacgatcatgtttcgcgccgtcggccatcgtcacagcgccctcccctgcagtggtagtgcatcctctccgttctccttcctcgctccatctcctccccttagactcgggtagtagcatgagtagaccccccgtagctagctggcgccgccccaagccttgtcgccgctcgctatgtgcacgccgacgtcgccgcccgagctcggtagcgcctctcgtcgccggcctcgctcggcgtagctccgcccaatccgacgctagaaacggactccggtggccgcgtagatgctctggtccggaggaatcgaactcccgtcgcgccgtcaccgtttcccccttttctcgccgccggatgccgccgccgcaatccgccgccatcgagcatcccccggcgaatccgagccgttggctcgtctcccctcatcccgtgcaacctcccggtgcactcgcccttgcttgcatcgctgtagatcgccccgccgctcgccgccgccatccgccgtccgttccggccgacgtcgtcgtcttcctcacgccggcccacgtggctgccacgaaggcgccacgtcggcgccacctcggccgcgaccgggtcaagctgaccccggtccgccgctcccctctgccctgctcacgcgcgcggtccaccgtgagccgtcaggctgcgcgtaggcccgccgcatccgcacccacagcgagccgtgcgcgtgcaccgcgtccctcccgcaaaccctagcgcgcgccgcgtgctcgctccgtacggtgaactgtgtcaccgacaagcgggtcccactcgggaccacgcgaggtgagcccggtccaccggctccctctctcctccccacccacgcgccctactgggccgagtcctcttgggccggccggcccattagctcggccgagccgcgcttcttctctcgggccgcgccctagccgcccgagggaagtctactcctcctccctctttcttttcttttcaaaagggtttaaataaatcctttttcctttagataaaaaatccaataatcttagaaattcaatatcttctcaatcgtacatccgattgactccgttcaacttccaaaattcctcaaatctcgagatctatctaatggcacgcttagaggtcaataatagggctttgttttctctgtttgttgagttgtcccgtttcgcatgtagtttcggagcccgaagacccgcagtgcgaggatttcgaggatcgagctcaagatctcgagcaaggcaagtcacctttgatcatcttgccctataatttaaatctaagtatttcttttccgcaaatattgcatgaatagtttaacacaagtaattcggccgcggcttgtgagatagcctgccggccccaatcctaattgctgcaattaccctccttgaattattgaacacttaaaacctcctttgtcaactgttgtgcttcgatgcacgggccttcgggcacgggcatcggaacacctcccctcaaatttaaaatatccaacgatgggtaaaacttggggttttacaaaagacttggaaaacccgacacctgggttggtgcttgcgaactaaatgaatttccaaaaccgcagaccgggggacgtactgggagtacggtttctagttcttgcacttaaggaccgtttcccttggaatttcatccgaacataagacaagtgcgaccacatgggtgaaatgggacgcccctggctgagtaattagctaatcgggggagccatgatgccaagagacatgtggattcaacggggtggtgccgaggagaacccccgggcttcctgacacagtatggtctgggacctaacctgatatcagtctgggacccctctcgttggcatatggtgaacctgtgtcggctttcgaaatgccttgtcatgaaagcctcaaggtctccagacgtggccgtcttgcacaggctgggtgatccgggttagtaatgtcgtgtgggtaaagtgtaccccctctacagaggttattaaactgttcgaacagccgtgcccacggtcatgggcggatgttaggtgattcctagcgtagttttgtttgactactgctttgtgaaattgttgttgtggaatgggttcgatgtttggaaaatccgcggctgatgggatcagccaggcccaggtggccgtttgaaagctgttggccgggtgtcaaccttgaatcaattcaaagactgatacattgcacatactccgaccggacgagacgcactgtctcatccgtgtcgtttgagaagcactcacttagttgtttcaaaaaggagtttaaataaaatcaattgcaaaaacaacagccttccctttgaagcctgcattaaacacttaattcccatggcttgctgagtactcttgtactcacccttgctctatataaatattcccccccccagttgctgaagaagatgaagtggatcccgctggcgaggagttcttccaggagcaagtcggctacgatgagttttagggtttcggtccagttcccaagtcgcgcctgtgatgattggtccaagtcttggcttccgctttcccttttgtaatgcagttgtgagctcgggatctgtccgcagcccaacatgactgtagtcctactctgtaataaagagacctctgttgctgtgatattctgtcttcctgtgataccagcactgtttcctgggactggtatcgattaacaggttaatttggagcgtcacgggctagttccgttcggggctagttcggggcgtgataatatgttagggtgtgacagttagttatggaactgctgtgagaaagtgagctacccatggaatcataagcacgataaatcttgaattgcttggtgatttaatttattagactattatccttttagaccttttgtttgtagctaattggaggtatgtatgaattacacacttctaaaaatacgatttctccagaaactttctatgttagtattgattagataacctttttataagctacttgtaattttatatctttaatatttaactaatccatgtatatattaatttatcggctaaccagctagctgtttcgaaccggtaggtgacaacaggtatcctgccctttcatcgtttttttgcatcggtaggtaacagctggttttatgtattactcgactttgtataaataggagagcatgcatgtttcatcaatcagttatcttgtagctagctacctgatcgaactcgggaaaattatttaagatggcagcacagggtgttacctccgtgctagcggtcgtattggtcatcggagccttcgtgtccatccctacaggtatatatatgcaaaatttgatcaatcatcagtttaattacattaattgaacactagaaaagtatgaagaaatttgatcggtctcttgatttgcatttctcgcacgtatgcacggtgcatgaatataattgatcaacacgtacgtacactagtgcaatccatcggcgtgtgctacggcgtgaaagggaacaacctcccgccgcggagcgaggtggtgcagctgtacaagtccaagggcatcaacgggatgcgcatctactaccccgacaaggaggcgctcaacgccctgcgcaactccggcatcgccctcatcctcgacgtcggcggcttcgacacggtgtcctatctcgccgccagctcctccaacgcggccgcgtgggtccgtgacaacgtcaggccctactacccggccgtcaacatcaggtacatcgccgtcggcaacgaggtggaaggcggcgccacgaatagcatcctcccggccatccgcaacgtcaactccgccctggcctcgtcgggcctcggcgccatcaaggcgtccaccgcggtgaagttcgacgtcatctccaactcctacccaccctccgccggcgtcttcagggacgcctacatgaaggacatcgcgcgctacctggcgagcaccggcgcgccgctgctcgctaacgtgtacccgtacttcgcctacagggggaacccgcgcgacatcagcctcaactacgccacgttccggccgggcaccacggtgagggaccccaacaacgggctcacctacaccaacctgttcgacgccatggtcgacgccgtgtacgccgcgctggagaaggccggcgcggggaacgtgaaggtggtggtgtcggagagcgggtggccgtcggcgggagggttcggggcgagcgtggacaacgcgagggcgtacaaccaggggctgatcgaccacgtcgggcgtggcacgcccaagaggccggggccactggaggcgtacatattcgccatgttcaacgagaaccagaagaacggggatcccaccgagaaaaactttgggctctcctaccctaacaagtcgcccgtgtatcccatccgcttctagtacgtttaattaagctaaaaaagctagctgcacacatagcagtgttctttttaattcccgaataagacacacagggcagtggtaactactcgtctactccaatgaagtactgcgcgacagtactatatatacgtgtgcatgcacacttttcaatgtatactactttaaaaaggctaccaataatgtcctaagttgatattctctttttcgggttgataatacttgtcgtttattttggataagggcacagtctttaaaaattaactttgacaattatgttctgttataatatgtataaaagtgttaacaaatatatgattttattaaattacttttcaagactaatctatccatgtagttacaatatttgaaagataaatattttaaaaagattcataatcaaagattctaaagattgatcttacccttatctaaaacgataaatattatcagcccggaacgagtatataatatataataatgaataaagtgaaggaaatgtctttcctcgttactacctactaggatgtgcattcgatctccacagtcacatgaacttggggtgtacgtgttcggccttcggcgcgaacgattgggaggggccaaccggccgaggacccgacaaacgattggtctggtagcccaaggcggcctagacccgagcaaaaatgtgcaacacgccgcttatgtgcatgggccatttggcgacattacgcaaagaaagaagttcaattagactcccccaactatagttcgaatctgattcttaccgttcaaccataaaaccattataatagctcctccaagtactttaaaaccgcgcagaataactccctcagcagtattgatcagtattgatggtggttttcgctggcgtgactgagtctccgacacgtggcattgaaaacaaaaataaaaaggaaaaaatatattaaacccacatgtaagtgaggtaccattacccctattacccttctttttttatctctactggcgctccttctcaagatgagcggcgggccgagcttgggacgactgttggaagaaagcgattgcggggaggcggcaggaagaaggcgcctaggacggtggaatcgagacggtggggagagagaacttggctttggtaggggaagaagaggaccatgcacaccggtgacggagctccactacattgcatgtgacctcaatcacgctggccagatatgcggtgcagtcgagcttgccgagagggatcttgttggatctgtatccccgacagtccagccaaaactgagcttctccacatcacgacacatcatgctgcttcttctcccctcaccgacggtcaccatgtcatgctgctcctcacctatcggcccatggcccaaggtagtagcagtgggaagccgaaggagcaccaggacagggaccacatcgttgaaagcgccattcccttgtggaagtcactctggcgcagagttgcaagaaaaggcagaggtcaatgatggaggtggcaaggtcatgctcgatggggttcgtcggacgctgcctctcttcctctgcgtctgtctctgtctcttcactaagaaccaaggagctcagaggcagaggtcagtgacggagatggtgaggtcgagctcgatgaggttcatcgactgttgcctctcttcctccgttgcgtaagtctgtctcttcgctaggagctagggagctcggagcacttgagctcaccgatggctcagagaggtcaagctggccatcagtcgatacctcctcgtcgatgcatagaggaggagggagagggcaactagctagctaggggaggaagggggaaaaggaaggagagtgggaggaggaagaagggagggagagaagaagatagcatgtgggatccacgttgtatttgacacatgggtccatagattcttttgaaaaattttttgaaatggttagtgacatgtgagttccattcagtttatttttatttatatttttgttgattgtgattccatgtaagcactacgtaggatgaagaccatgtcaatgtgccgagtaggtgccacatcaatgaaagccaccgttcaatactgtcgaggaagttgttttccactgttttatatttggatgagctgttataccagttttacggttaagggtattgtcagggttatggataccacatacctaatagtagttgactaaatctcggcaggatacaccacataccatgtcttatacgga

SEQ ID NO: 13896 - DNA, 6679 bp, Oryza sativa
caacagttagataggctaccccacatattctactggtgtgattatggtgaataaaaagcaacatcggctccggccaacatgatgtagggctattacctgatagctcaggggcctgaacctgtataaaaatcctcgtctccatctcttttacctcagcgcgtataccctagcaccgacgatccccatactgtccaaataccgtagtcgagacatcaaacgtcgacaggtatgaattcgattcgaactataaattggggacttaaattggactttttgcttacacaaagccctcacggccgaaacgatggccatgtaacccagatggccgaaacaaaaagccttctcacttcatcctggttgggactggatcgaagatgagcgatcatccacttagagcccacaagtatccaaccccgcaagcctcacgcgaaatcctcctgggccaaaagtgccatacttgctgaagagtcaagcctcaagtagccaggcgaactcaaaatcaaataggcaccttatttctttcggttcaattttggttttcctctagatttgaagatgagtagctaacctaattgaaatcgtaaatccgggggaaccaacgggtttcccatgcaatgacgccagtcaagcccaccgattttgagcgagaattagttactgatgatacatgctgtgcagttgtgcccttcgtttgctaattggatcgactcaatgtggtgctatcaagttgcataagactgcaccaattggataaaaatctgcgattacttgcttgttaatgccgaaattaaatgtgaaagggatgttatttaatacttgagtcaactccttaatatcaatattgtaagtttaccattgcattccccggtccacgtgcatcagtgcatgcaatgaacagctagttcagtaggcgttgagcacagcaatgacatacctgcatgctcttcaattgaaaatcgtttcagtttgggataagttcgtgcactgaaaaggaaagtaaacgtacgagagaaagcaactgcaccctacttatgcatgcccacttaacattttttttagttcaaccgattccatttttaatggacaacttcaaaatttcatgtttattcaaaaaaaatattttttatcactgactccgatgtgtttttgctagttttacacgtacatttcatcgctccgaatcacctctagatcaatttcaagatctttgaagatgtgtagcttcagtttgtgccccaaaccatgaacatatttttacacgtcctctctctgaaacaaaggattagtctgatccgcatttttactctgtttatccgcaagaaagtttttacacgtcctcgcaaattgcatgctacataattcctccctttgttttgtaatagataacaccattactaacttatagtaatattatttatttttgttgtgacatatttatcattaaagaaactttaagcatgacttatactttagcatattcacactaatttttggaataatacaaacagtccaacgttgtttcaaaagtcaacaacgtcatttattaaaatatatttttttttcaaaaaaaaatgcatgctaattatagacctgctaggaacttgtataaataggggtgaatgcttttgttacattgcaactgcatgcaaagtccaccaggcttctaacaactagctatagctacttgtgcctgcaaacaaagatatggcaaagcatggtgttgctttcattttaacactggcattggtccttggagtacttgcggtcactcctaaaggtaagtatatatatcacgtgtattagggcctacaccctccattcccaataagaagcaactttcatggatgaatttggataaatagctgtccattcgtttatagaagttgtttttaagagttaggagtgcgtgtaacgtatatattgttcgttctactaatcaacagtggtgcaatccattggcgtgtgctacggcgtgaacggcaacaacctgccgtcgccgagcgacgtcgtgaagctctaccagtcgaaggggatcgactccatgcgcatctacttcccgaggagcgacatcctccaggcactaaccggctcaaacatcgccctcaccatgggcgtcgccaacgagaacctctccgcgttcgcctccgacccctccgccgtggccaattgggtcaagcagaacgtccaggtctacccgggcgtcaacttccgctacatcgccgtcggcaacgaggttgagagcggcaacacgcagaacgtcctcccggccatgcagaacatgaacagcgcgctctccgctgccggcctcagcaacatcaaggtgtccgtgtcggtgtcccagaagggcgtgctcgccgggtacccgccgtccaatggcatgttctcccccgaagcgacctcgtacatgacgcccatcgcgaagtacctggcgagcaccggcgcgccgctgatggccaacgtctacccctacttcgcctacgtgggcaacctgcgggcccagatcgacgacatcaactacgcgctcttcacgtcgccgggcacggtggtgccggacggcagcaaggcttaccagaaccagttcgacgccatcgtcgacacgttctactccgcgctggagagcgccggcgccgggagcgtcccgatcgtggtgtcggagagcgggtggccgtcggccggcggcacggcggcgagcgccagcaacgcgcagacgtacaaccagaacctgatcaaacacgtcgggcaggggacgcccaagaggcccgggagaatcgagacctacattttcgccatgttcaacgagaacgacaagagaggcgacgagacggagaggcacttcggcctcttcaaccctgatcagtcgccggcctacaccattaatttctaaagaacagcacttacaggctccaggctccatacaattaaggagatcgatgaggaaagcaacgactatatagtacgtaagttccagttgaatgtttggatttgatcgaataaattgttacgtacatatacgtaacacttgcatgttttggataggctagctatctgtcttttaatttaagcatgagatgtggtaagcttgtagcccggccggcagatttgttgcataattcctgtgcatgcatgtttcgttttgttgaataattccttttttttagttcatgtatacagcattagctagtgccgagcgtagcgcatggtgtgtcattgtgggcaacgcgtgtgtgcatcgtggtgtacttgtcaaaggtccactgaggccatgtcttgcatgtaatttcttttatcagtatggagagtaaacagaaaagcagcgtttcattggctgcaccaaaattcctcggtgttcactttgtcccaaagctctgtgcatttcgtcgaacacctctggttcatcttctccacagattcttcacggcgaacttgggctcatcgtcaacaagattatcctggtctatatatggtgaattgctcaggctttaataaattcatctccacggccatgcggccatgacagtgttctagctatctagtgtactgggtaaagtgctttcatccttcatcgtctcgtttcttacttgtcacccaactagtcactaaaaaattgacaagctaaattaatatgaaatatatcaatcaacaaaattcaacttctataagttgtaacaaaataacaaatataacatttacattaactattttcagtttaatttattctttttttaacttgtaaaagttgaatttgactttgcatgtttctggaatgatatatttcatattaacctatattgtaatttttttaaaaaatttctaataactatttaggcagcatgcaagaaatccatctccaaaatttctcagggcagtattgtaagttgtgggacgcactgtatcttgtactacggttttattcaaactcaatatcaatatgagggaccttaaagtgaacttattcccaggacaaacgcagcaatccgattgggctcatcagattttggatcggaaccaactctactgaaacatttaggcccagttaggcctgtttgtgtctggaccagtggttgcgatcatttcggcccactacaatttggggcgtttcaatggggccaatctgaaggaaaaagtacatcggaggtccctcatcttgtcatcggattacaaaatcgtcctccaaccacaaaaccagatatttgatatgcctcattttacaaaaccggatcacttttggtcctcaagcggttttgactccgattttatctgacgtggcagctgactcggcgtgggtcccacgtgggccccatgcgtcatcctcatctttccctcccctctccacttttctgtgctctctccttccctctccacgggcggaactgcggagcagctgggtgcgccggcgggcgccggcggcagcgggggagcagctgggtgcggctggtggccggcaggggagcagctaggtgcggccggcggtccacttagagcccacgtaacccaacccggtcaagcgaaatcctcccctctgcgggcctactctgtgggccagtggccttggagagcctaccgctcgtcggcgtaaggcaatgtccataacgtttccttttgctgagccgaaaagcccatactccacagtgctcaagcctcaagtagtgaatttttaagaaactcaaaatcaaatagtcaccttttttttttctttcgattcgatttcggggtcctctatagatttgtactccatccgtccttaaatatttaaggtcattgactttttagcatatgtttaaccgttcatcttattaaaaacatttgtgaaatatgtaaaactatatatatacataaaaatatatttaacaatgaatcaaatgataggaaaaaaaattaataattacttaaattttttaaataagatgaacggtaaaacatattttaaaaagtcaacggcgccaaatatttaagatggagggagtagatgagtagctaattaacctaattgaaatcgtacatccgggaggaccaacgggtttgccatgccatgatgccagtccatgcccaccgattttgagcgagaattagttcctgatgatacatgtgccctttttgctaccaaatcctcgttcactaattggatcgactgcaatgtgatgctatcaaagttacataagaatgcacaaatttgataaaaatcagctcagtacttgcttgttaatgccgaaataaaatctggaattgatgttatttaatccttgagtcagctcctcaatatcaatattgtaagtttaccattgcattccctagtcaccgtgcgtgcattgaacagctagttgagttgaggcgttgagcagagcgatgacatgcatgcatgctcttcaatacaaaatcgttgcgattttggataagttcgtgtacggaaaatgatagtaaacgtacgagacaaagcaacttcaccgtacatatatatcaaatatttggggaaagtaaattcatccctcgagggatatcctcttgtttcgtacaggtcacttaaatagttataaaaaatataagaaaaaattgcaacatagattaatatgaaatatataactccacaaatatgcaagtttaaattaaccttgtacaagttataacaaaaatagcaaatataattacgaatgtgcgataactattttcactttaatttgttatttttgttgtaacttatagaagttgaatttagtctaacatgtttgtggagtgatatatttcgtattaatttatgttgttattttttttaaaaaaattttataactatttagatgacatgcaaacaacgaagggatgtcgagggatgaaaatccacatccaaatatttgtatgcacatttgacattttctagctagtacaaccggtttcatttttaatggagacaaacgtgaagggactagtagcatactgaacattgactgatacagacagttcgaatatggaattacccacaaccttttcgatctctctttataatatgatagattgttcgttcaaaaaacataatatgatagatcattaactttaacatatatttatccatcctgttgtattctccagctcaaaatgtatctgtataaataggggtgccttctcacgttgtacatcaatcaaccatcttgtagcagctacacggtgaagagatggcagggcagggtgttgcctgcgcgctagccgtcgcattgttcatcgggtccctcgtgtccatccctacaggtaatatatatgcagatatattttgatccaccagtttacacgccaggaattaaaccatgcagaacacatactaacacatttgatttgcatggctgcatgcgcgcattgatcgtcgatcaacattcaacagcagtgcgatccatcggcgtgtgcaacggcatattggggaacaacctgccgtcgccggccgacgtggtgaagctctaccagtccaacggcatcgccgcgatgcgtatctactccccgcacgccgccaccctgcgtgcgctcgccggcaccgacatcgccgtcatcgtcgacgagccggccatcgaccaattcctcactctatccgccgcatcagactgggttcagagcaacatcaagccgtaccagggcgtcaacatcaggtacatcgccgtcgggaacgaggtgtccggcgacgccacgcggagcatcctcccgg

SEQ ID NO: 13897 - DNA, 2927 bp, Oryza sativa
ggacgccatgtactcggcgttggagaaggccggggcgccgggggtggccgtcgtcgtgtccgagagcgggtggccgtcggccggcggctccggcgcgagcgcggacaacgcgcggaggtacaaccagggactgatcgaccacgttggcatgggcacgcccaagagggcaggcgccatggaggcgtacatattcgccatgttcaacgagaaccagaaggacggggacgagacggagaggcactatgggttgttcaaccccgacaagtcgccggcgtaccctatcaagttcagaattagttgaaaggtgttctcgtgaaggaaaatcttgaaaaagagctttttaatttcaaatacacatagctgttgccagttaagtatagtatgagtatccggcatcatgtgtgataagctggtagcagtaacccagcaaattatccgctactgttgttcttcaggttttaataaagcagtggctatatgaaattatgaatgtccatgtgttctactagctagtgtgctgctcgtatgatcttcatcgtcagctttgttcttatatgaacgtatatatgatcgtacatatacgttcttatatgttctttcgtcagccttcatatatacgatcatataatataagaacgaagtgtaacaagttgagatcgatcgagatggaaataataccagctccgtgcctccgtcagatggcggaagccccgccgtctccctctcgtcgccgtagctaagttgatatagtttattgtggccatcacgtgcgaatccgcacactggattaacaagctaaactgagacagtagtaccagaatttttttatcgatttctctaagatttctctccgttttctctgttattcccttattccttttcctttttttctagcttttcttacctttttgttacacttcgttcttacgttttttttagtatttctctgccttttcgccgtttggcagcctacttaggaatgttgtatcattttgacccatcattaacgcaataggtagaatctctgtaccttttcagagtaaaaataaccttcacacctggcgtagctccggccgccgccggcggcccgaaaagcgcaaggagcgagaggaggtgagctgcgcgccaacttgaggacattgtaacgacgctatcccgtcgggtttccgtgaaccgtgggatttgaagtttacggtccacaataggaataagtttactgaggttacttgtgaacaaattcgattttcatcattcaaccagaaaaccagatacgacgggtcccttagctatcaagaggacaatctcctcagcatcaggtcgattccggtgctggttgtcttgctgatgttgttcttctccaccatgcttccgcggaaatagtcgcgcggttcatcagcctacttgttgttgcaatgtgatgcagcagcatgcatccgaggctgattgtaacgctccgcttttcgtgaggcattaaaaactaattcggcaaaatcctaattgcgaaaattttcgttctttgtgtgcgagtctaagtcatgccaagatctcatttcaaatcccgttgttccctctcatcgaaatcaaaatcctccacctcaaattcctcttccgattcaagtctccaaatcaaattccgaaattcagtcgcatcctttgaatcctcgctaaacgctcactcccaatttcgaaaaataccaaactctatcttgagccttccttgattcctccctgaaccctcgagttcgaatatcgaatttgaatccaaatacaaactccaattctctccaaatcagccttctctgtgaaagtctattttacctccctctggctcggtgggccgactcttcttccccggcccatctcctctcagcccgctcccctcctcacgtgcgttgcacgtgccctgcctgagagaaagcgcctctctctcccgcgatctctctctctcgttttctctcgctctctctcgcctgcgcttcgcgccgccgctttgtcgttcaaacccgccaccgccttcgctctttcccgcgcgtgcgcgcgtggccgaccggccggtcgctgccgctgtcagccctgccgcgcctgcgccgcgcagctgcccggccccgctcgccttttgccgacgtcgccactgtcatcgcctggctccgatgcccccatgccgcatccttccaaaaccagaagacagagctcgtgctcctctctctcgttctcacatcctccttcctcccaaaatagcaagggagcaaagctcgtttccctcctcttttcacctttttccttagccggcgtcacgcccgtgaccgcctccgccgccgcttggccgctagctccgagcacgaccgccagctgccaccttgaccgccctaaggtcggtttgaaccgacctcccgcgcgaaccgacctcgcctccactataaagccgagtccctcctctcaaatccctcccactttagtctccaccgctacagtgccatcgccgccttgctgccgccatcctcgccttcctccgccgtcacgtgtgccgggaagccggcgtgcgcgcggagccgaagaggactccggtcgccctctctccctccctttccccggcccgagaccgaggtgatcacgcctatgccgtcggacactcttcccagcgatctcccgacgcggtagcccccgttctccctccccactcttcctctcccccctagcttgcgcgattgctagcctagaccttcccaaacacgcgtggacgctgccccgagccccgccgccacccggcatggcctcgccaccattgccgtccgctcccggaggccgccgctcgtcgccggctctcctcggtgctcctctgtcccatccggcgccggaaacggattccttgaaccccggatatgctcccaccccttttaatcgaacccccgttgctccggtgaagtttc

SEQ ID NO: 13898 - DNA, 22417 bp, Oryza sativa
gtgcgcgcggtccacggcaaaccgtgcggctgcacgtgggcccgccgccatccatccacccggtgcaccgctcttaagccacgcgcacccgaaaccctagcgcccgcccccgcgtgcgccgtttccaccgtgcaccgcctcaccgacaagcgggcccgctcgggaccccgcgaggtgagcccggtccacccggctccccttcccccccctctctccccgcgcccctctcttgggccgcctccccgtagcccgcgccggcctaataagctcggccgaaccgcgcaaatcttctcgggccgcgccaagccgctcgggaaagtctgattcctatccctccttccttttcttatccaaagggattactaaatccttttccctttttcataaatcaattccttattccaaaaattccatgaatcatttcctttggtcccgcacatcagtgaccatcaataatattcttgagaatattattccataaaccatttctcgtgttctagaaaaatccaataaatcatttccttgtccagaaattccagttaagattccaaaattcatatctctcgatccgttcattcgattgacttcgttccacttccagtatttccgtaaaattgagatctatttaatggcactattatttagtctaaataggatctttcttttggtcttttgtttaggtttttgattgtttgcgtatagttgcggttaccggattttcgtcgatcgcgggttttctcgaagattcgtgaagctccgtgaagaccttgagctaggcaagtcaccctttgaccaattgctcctataattggaaaatcattattattttgtttgcaacttgcattgttagaatcacacacttaacttgcttggcctcggtttgcgcgctaaaccgacggacctacccagtagtcgcactaattcctgtaggctgtactaccctgactccttgtcactccacctttgtggtacctcggtatccgtgctctctgagcgcgtataccaaatatcccacatacaccgttgtttgtcgaaaacttgggaaatgggtttgtaaagccttgaaaacccaacatgtggtgtagatgtgtttaaaaataaaatgaattgtgaaaactcgcgatgcgggggttgtgcctatgtggaactgtcccgtattcacatattaggaccgattcctatgggaaactcatcgagcataatcaaagtgcaaccacaaggtggaatgagacaccatggctaagtaactagtcggttcagggaaacctcgcatgccaatagttgggaacgccggggcggggttggttggagccaaaccaggttcctggtaagcaaggaagagaagcttgctgaattaccgatcgaggtggttggagtttgatttgtgaaaactaaaatggcctatatttatgtgaggatttgatccttctatgtggcatgaggtaaccctgagttggcttggaaaaggctttgtcgcgaacctctaacaccggccagtgtctggagtaagttcgtgtcttgtgggtaaagtgtacccctctgcagaggttaactaactgttcgaatagccgtacccacggtcatgggcggatgtgaggtggttcccgttgcgtagatttgtttgcctgtgctttgtgaaaagttgttgtggtgtgggaatcgtaaccagaatcagcctatgtggtagatggatgacctgagtggtcagaaacgaatctgtgtgattcgggatgtctacgggcatcatagactaggcttcccgagtggaagcggattgctttgctgctgggcagctggactctgggagtccgcaaaaacgaataaggctctgggagccgcttaatcaagtgaaatggctctgggagccgagaagtaatgatctgacccgggaggtcggtacattaccaattgagctgttgaaaagcatctcttaagtcgatttgagacgcaagtctcttttcgacccaaacttaaagagaaataaatcacttagtgatttcaaaatgatttcaaacaaaagatttgcaaaacaaccttgcctctcttccaagcttgcattaaacacctaagttcacgtgacttgctgagtacgaaagtactcacccttgctctatataaatatatatatagttcctccgccctgaagagaagataaagtgaagtgaagaatagggtttcgtcctagttcccagccgtcgcctgtggtgttgggtgttcgttcgttggttccgctgctattgctgttgttggtgtttcctcgtcagcgtcgtcggttgcattctcgggctgttctgagctgcaacctaagttaaggtaaataagtcctctatttatgttaaggatttgcaatgattcaaatttgtcaccgtgggtaccagcgctatgtcctgggactggtactgagatcgcggtttcgtaggaagcggttcgcgccgtttttcctacgacacgctccagtcaggtgccgttctacggcggtaccagattggggtgtgacactgatggcggtagacggcgcggtaggagggtgcgttgtggttggccttatcgggttggttgtgcgctggtagcccgcgaggtccaaggatgtccacctcttatatttgttgtgcttgggcagttgcagcgtcgtaatagaatcggcgattgggagaaggagcggggagcctttgaggaccatcgctccttctcccgacggccactgcacgccgccccgtctgccgttgtgcctggaagggagatagaggagaaaagagaggataggggagagagacgaagagaggatagaggaggaagaagaatggccgggagagggaggagagagaagaggagggagtgagaatgacacgtaggacccacgtcggccacactatttttaattattatttttattgtcgtgggataaagactgagtcaaactagtcacgtaggcgccacgtcagctaaaaacatcgtccaaaccgccataagacctacattacaccggctttgacagttgagggacctgttgtatctgattttccggttgaaggatgaaaatcagattcgttgataaagttaaggaacctcaagtgaacttagtcctgcacaatataaactgattccggacaagcgcaaagaaccaaataagcccacaaatcgtaactaacactgggccatcagacccataacagttttgtatagaaaccgatcgcagagactcacccgatccaattgggcccattggaatttggatagaagccatcggtataggtggcaaaagtctaattagagtcccttaattgactgagtaaaaccagataaaataagaggaataagttcactttgggtccctctatttacgaaatcgtttaaatgaggtccctcggcggtatttagtccagttttgactgaggtggcgctccttttgactaggtctttgtccaaagtgttgttgacgtagcgtttatgtgacaattagattcgaaaaaataataaaacacgtgggacccacctgtcagtttcacacacaaataacaaaaaaaaattgtggacccacacgtcatgctcactacctcttctctctatccccctctctctctctctccctcttttctctctccagccggcgaagcagggagggcggctcttgccgacgccggagtccctgatgagcaggatcttgaagctgcactcgtgcccaccaccgccgctgctccccgcccccggtggcgcggcccacaacgccggccgttggtcgaaaattccccattccaaaaccccaatcgcgtcgaattgagtgaagccatgaacagtgtgggtgcagcgtccaggctaggtggcgagcctctgcagactgcaggccggcgcggcggtgcttgcccgctcctagtgccgcggtgccacctggcctgcacggctgtgcgcctgcgtgcagcagcccagctctaagccgagcaggcagcaacaccaacaagtcagcaagggcaaggcagcaaagcaactagcccgattcagcacaaatggatagaaaggggaaaggaaaggctttggcatcataaaaatgtaacatttgttgagtatttgacaaatgacaagtgaaaacattgcaatttgcaaaagtataatgaacaatttgtcattgattcacatgtctgtaattttctgtaattttgtttgtagatttgaagagctatttcactaggtagtccagtagttgccgagcagtatgctttcattccacagcgcggcggggggagaagtcgcacgacctcgacggcaccgtcgtcggcgggcccaacggcaacgacgtgttcaccgaccaccggggcgcgtacctacagacggaggcctgcacgtacaacacggcggccatggttggcgtcttctctaagctcatggaggtcgaagtcgagcgcgacgcctctgtccgctccgcttacgtcgccggcgacgcgcaggccgacctcaagaccctggtcgatggcctcgtcgccaacggcaacaccaacatcaaggtggacgccggcacgcacccgcagacggccacaggccacgggcggctcctctgctcccaacggtcggcgccccgcggccctccggccaccgccgcgctgcgacttctcccccgtcggccggccgctccgcccacaacgcgccgcttcacccctcgtctccgcccctctctgcctctgcccctctgctctgccgccgctccgccctgccgtcgcccactccggccgccgcccactccgctccgtcgttggagagagagatggatagagaggatagagagaggggagatagagagaagatggtggtgaggatgacgtgtgggcccacatgggcccacccatttttttattatttgcgtgtgaaactgatatgtgggtcccacgtgttttattattttttccgatctaattgccacataagcgtcacgtcaacgacatgttggacgaagacctggtcaaaaggaccttatttaaatggtttcgttaagttggggacccatcgtacctagttttgcgaacaggggatgaaaatcggactaggcgacaaataaatggatccaaagtgaacttattccaaaataagaagactccctcaactgctgatatgatatcggtttgtttttcctccctgtaacttttttttctggtgatttcatctgacatggcaccacgtagcttgacacgtggcagtggatcccataggttcatcatttttcctactcttttctctttctttctgccaaccttttcttactctgtacgcatatattacaattttacaagggggctcagcttaattatatacagtgtccaccttcattttcctacttggactctttatttgtctgaaataaaactccagcaactacatttcatttacaagtctaggagctcaagctaatatcgctgtgcgttgtcccatcctccatccgtatccatgactgaattgagaagggctgttcagatatctcaataacccttgctcctcttggccagttaccgtagccaccatagcctgtgtgtcgggcaaaacatagccagagtttctcgtgtgggcagcaccaatccaggccgtggttgtgaccaacgaaaattgcctgtaaaatgacaaccaatgatatatgttctctaacaaataaaaagtaagtgtcttctgaattttgacctgtgtatctaagttatctgaagggattcaggggataagaaattctgtatacatgtcaagaaatgttcagatgaaacaaaccttcactgaagccctcttgacaagggcatccatcataccccattcagcttcttgtggtgctacttcttccctgttgatagagccaacacagggttttcttatttcggacttagctttcggcgcaaccttggcatatgccgtacttggaatatgccaaaagattatctctggaatcctgtagaataattacacaacattaattttgagttgcagaagcttgaattttgagtatgtgcaaaattgatacaagtttctgaccttccatttggattaaggaactgagattgactatgaaaccactgaacctgagcactggatatcacttctggataggatccaccaccggagtcaaggaaatacatgagcagagctggatcatctcgcttctgtgatagcacctgcaagacgtagttggaaacagcaggccagaggtccttggggccatttgatgaatatgacaatccattacggataacctcacttgtcatcagttcaagtcgcggtgttcctcggaagctgcagtctgcacatcaagttaaaaacatggttttcttgaaaagttcaaatgaatgattacttttgtttgaaagcatacagtggttgccttctttcttttccttttcttttttctgcgctgaagttcagtgactgaactgaaacaaattcagaaatgaactatcttaagtttacctgaatctgacatgctcggtggtgggcaatgcagcggcggaacgcctgcaggagagaaccactcaggaggccactcgaacggcatgtcgtcgtggttcccgaacaccgtcgcccacgggatccccctgcctctggtcggagaaatcgctctgtcccagtacaggctcgcgttggggatccctagattgttcgcggtcacgaggtcgccgaggtacaccacgaagtctgcgaattccgggagatttcagcgaaaagaactcgcaattttacatttcaggcgaggggacgccgcacgcaccgggcttctcggcgtcgaggacggcggccatgacgcggtcggagccggcgtcctgccgtgggccccagtccgtccaggcgttctcgccgtaatgcaggtcggcgaagagcgccaccttgaaccctcctcccgacgcgaactgcagcggccggcggctgctgctgctggccgtggtgtcagggcgccggtgctccgccaccgccagagcaagcgcggcgcagagggcggcgagcagtgcgccggccgccgccaggcgacgccagcaccgcatcccggcgtacgtgctccgacggttcagtcaatcggagtcggacgcgtgacggatctccggcgacggcggtggcagaagcgtgccggagcagatgctggtggctgcaaatgatgggtagagctgcgattaacgtcagtacgtcactgctgcttgtgcattgattgatgggtcactgtccacaaaagagtaaagacgcggcgctttatttcgttgcgttacgctgattgttagcgtaaatataaataaagtggacacaagataatgggacagtcacgttacgccgaatcatgtcattcatccagaagcagagagagagagagagagagagtatatgcggcgaggagctcaggtagcaagcaagaatatgctctccgaagatggattttaataaaagatgagtaagttgtcgtggctagaaaatgcatctcgacttgtttaatactccctccatactcgtaaagagatcgtttagtacaatatttaagtcaaaccttaaaaatataggtcgaatctaatttatacccctcaaccacaaaacaggatatgacgactcctcaaactattaaaactagtgcaatttgactttctcagcggttttgctgacgtgacgctaatgtggcagtgttgacatggtgttcgtctcacgtggcgcttatgtgatattagaattaaaagaatatctgtgagatccatctgtcatttacacacgcaaaaatatattgtggggtacgaattagattcggcctattttaatgggaatcaaagtggactttttctgttacggaaatgctatataccagtataccgttggacgggatacccttcgtccacctttcccatccaaataggaacgaggctgagcacctaagccgtgaggaggaggtggccatcggcgcctaagccgtgagaaggtggccatcggcgactccggcgcaggctgggaataagacccgctcggggagaagaggacgtggccaccggagacgcggccgccggcaacatggtcgttggattgccgcctggtgctccatccgcgtggccggccggtgcgctctccgccggtgccccaactccatcaccggcgacgtggccatcggcgacgtggccatcggcgacgtggtcgccggatttgccgccgggagctccagcaccgttgcctgccaaccaccacgccgccgttaacgcccacccttggctccatctgcgtggccggccggtccgccctccgccggcgccccaactccgttgcgggccctctccggtcggcgccttcgtcgccggccgtcgatcccgctgtgagtccgggccttcatcctatccatctgctactttgggggagaaaagagacaagacgggggtgcaaagaacttgttaatttggtcatggctggctgtggagtgtggtagaatcatcttctacgtggtaagaattgcatgatacatgagttaagtatcaggacctgatacatcgcaagcatcacccaccacgtgataagaatcgcatgatacctcataggtatcatctgatacctcgcaagtatcatctgatatgtggtagaaacacaagtatcacacgatcctactaaagtatcatctgtgaaacccataggatcttgttactagatatgatacctatgtagtgtcatgcggtactgcataggtatcacacataatgatacttttgaggagtatcatgtgatcctcctaggatatcatttgtgcaaactaatgataccaaacatgatacagatgaggatcatgatacctctcaggtatcacatgatcctcccaaagtatcacctatgaaacctggtgaaaccgaacatgatactaaggaggatcatgatacctcccaggtttaacatgatcctactcaagtatcacttgatacctcgcaactattatcttctacgtggtaagaatcgtatgataccttatatgtatcacctgataattagctggtatcaggtgatacctaccaggtatcatgcgattctaccacgtatcaggtatcagacgattcctatcacgtatcaggcgatactcgtgaggtatcatgtgatacctatcaggtatcgtgtgatttctacgacgtatcggggtgatacttgtgaggtatcatattcatatgatacctactagataccaggagctgggtgtcgaggtgtcgaggcatcgtcgccggcggccgcgtcctcccccatccacgctccacactgaacccgaacctcgtcgccggcagccgcatcctcccccgtccacggtccacatcggagctcgtcgccagcgaccgtgtcctccgtcgggagctcgtcaccggcagacgcgtccgtcgtccacgcctcagccggcggccgcgtcctccacgccggaggtcgtccgcgccgtttgcgtccgcgccgccggcgttagccgcatctgtgctactcccacatctcgcttggcgccatggcctgcgctctcgcgtctgagggaggtggacatggagcgatcctgttgggacagtatcccaacgagataccggtatatagcagcctcctttctgttaacttacgagtctggctatgggagcccacaggctatttgtctctaatgctcaaagcgagagagtctcagccttgctacatgcaaaggatacgtgtgtaacaatgtaccaacactgtaacacatcgatgaagaggtttggtcagaaaaaaatggacaccaaaccgagtcctaattgcaatgagattcaggtgcaacgtaaggcagaaaccaagagctgctgcagccgggaacatatacgaagccgcaccccggcgtcgccgtcggcaggcgatactcccgaggatgcccgtcgtagtactcgaaggacacgaacggccgagcgaagtagaggtggttgcgcagcgcgtcacggccgcctcgcgtcgacacgcacaggctgcggccgccgatccccaccaggatggccacctcgccgagatcctccacggggagccacctcccctcctcgcgctcctcgtagcgggacacctcgtaccgccgggacccgcggaggtagccgtgtcgcgcatggtcttcgtcgtccatggcgccgacgctgctcaccatgagcaggtcgccgccgccgagcgactccacgagtgcggcccacgtgcacttctccggcctcggctccgtgacgcgcgtcgcgtgcaggccgctcgagctcgcgtccggcgcccaggcggtcaccgcggcctcgcggctcgccgtgtagaacgcgcccttgtggtagacgacgtcgacgtacttgtgctgcatccatttcgggaaccacagcgccgtccacgacttggcgccgggccggaggaacgacaggccgttcccgccgccgtggatcagcatcacggcgaaggtgccgacacggcggccgggaaccagctccgccttctggaacatggactcgcccatctggtcgaggtccctggccaccttcttgctgccggacgaggtgatgggaggcagcgggaacgccctgcggtgacggcctcgagcagggacaggccgcactcctcgtcgacggtgacgagccagccgtgggaggacccgatgatgcgggtcactggcgcggcgccgccgtcgctggggatgcggacgattcgttcgcgggtgaggcggagaggacagagctcgatgccattgctccactggtctagtctcacgctgtacgggcggctcggttgttcgagtgtgcggaggcgcgtggttttcagggcgcggcgccacggccggcagacggcggagcacacgacgttgtcgaggggtccggcgcggcgggcgatgtcgtcgagcgcttcaggtggcaggtcagagaagcagacgggcgccatggtgtttggaggtgcagatgtgtaacgacaattcagtgtttagccagcgattgtgatgacgtggtgttcggtgtttatcgttcattcatctgtgttaagatggtgattctacgagattatctctacaaccaacggccaaatatacgtatctgtgataagatggtgattctacgagataatctctacaaccaacggccaaatatacgtagacgttattacttcattttcccccaacgaagctgataaaggatcgatccaatattcccgtgctcgatcgtgccttcgtggcatgtacggaagtatcgtgcaatttggaacggaatactacaggcactttctgtatatttatatgaggtgtccatgaattttgagaggcgaatttgcacaaattcgaaacaaacctgacttgtatttgaagtgcaacttttttgaaagaaaaactttagtttatatccagctttgaagggctaacatattggaagcatctctgcaaaccaaatcagctccttgctattttcttttcagtaaaaggcaacgtacccattaacgacgagacacccgactaacttatagaaattgtatttcaacttgcatatatgtggagtgatatactatattttttttaaaaaaaacataaccatttttttaatatacagtaaacgagtggacatcaatcggttaattagaaaccatctatatatgtgcggacttacccataacaagtaatcctgcggtggtagaacaagccaatttttttatacgaatctagactatttaaatttgtgtaaacaataatttattttgagacagagagagtaaagtagacacgttagtcggtgattcaaaaatacacattaaacatagccgggtctaataccaatggaattcaggtgcaacataaggcgcaaaccaagagccgccgtaatgcggcacaatcaggtaagtacaacccggcgtcgccgtcggcaggcgatactcgtcagggtggaagcagtagtatttgcctgattcgtaggacggccatgcgaaaaagaggcggttgcgcaaatcgtcgtggaagcctcgcgtcgacacgcacaagctgcagctgcttcccaccaagatggcagcctcgccgagatcctccacggggagccacgacgacgtcccctcgcgctcgccgtcgtagcgcgacaccgcgtaccgccggcgcggtagccggtaccattggccatgcgcggcaaagccttcttccacgacgaagctgctcaccatgagcaggtcgtcgccgccgaccgactccacgagggcggcccacgtgcactcctgcgtcggctccgagacgcgccccgcgtgcaggccgctggagctcgcgtccggcgcccaggcggccacctcgccgtcgcggctggcagtgtagaacgcaccgcggtggaacacgatgtccgtgtacttgtgctgcatccgtttcggcacgcgcaccgccgtccacgatttggcatcgggccggaggaacgacaggccgaacccgccgccgtggatcagcatcacggcgaacgcgcccagccggcggccgggagccaacgtcgccttgtagaacatggactggtcgagctccttggccaccttcttgctgccggacgaagtgatgggaggcagcgggaacaccctgccggtgaaggcctcgagcagggacaggccgcactccttgtcgacggtgacgagccagccatgggaggacccgatgatgcgggttggtagcttgtcgccgccgtcaaccatggcgatggggacatagatggttgattcactgctgcagccgaggcgaacggccaggcagagactgatggtgccgttcctccacttgtctagtctcacgctgtacgggcggctaggtcgtttgagtaggcggaggcgcgtggttttcagggcgcggcgccatggccggcagacggcggagcagacgacgttgttgagggcgccagcgcggcgggcgatgtcgtcgagagcttcaggtggcagatcggagaagctgacatgcgccattgttggcgatggaaatgtaacaactatacagtgtttatccagcgatagtgaaggagcgatcctcggtgtttatggttcgttcctctgtttaagatgctgattctacgagattatctctataacaaacagccaaatatagacttacttgacttgcccccaacgaaactgattaaattaagatccatcttccattagcccaatcttccagtgttcgtgacatccatccattcagtctgtactgggaaacaaataacgttttgcagattgtatagaaggtgtccatgcattctgagcggcaaatttgcacaaagttgaaactaccagatttgtatttgaaatcaagaaaacaaaatattgatttgtctagtttcgaagatctaacgttttcttgagaaagtacacagaggtaccatattaagtaccttaaggtacaaaaaattctagcctaaaatttagatacctcaaaatattttctaaagtagtgtaaaatttctctttctgcaagtcaaaaccgttgtagacttctgctcttggacagggtcggccctggggcagcgcggaaggtctgggccctagggcagcgcggaaggtgtgactgtattgggcctccaaaatatgtatacaatgatatcactgtatcaggcctgataggtttagagaaaagatagaagaccgatcgacgatcgagtatatcgtgactgtttgattgtattttaaatttattagtgtgaaattcgttaatgacatgagttttaaaatattatcttgtttttttatgatgaatggggatcttcattttttgttttgcaccgggccaccaaaaagtcagggccggccctgctcttggatatagagtgtccctctcaacttttatctctctttaactatattggaaggctgttgctgcaattacacatgtaaatgagaagaaacaacttgtttggcaatttgagggaatagatttaggagtttagacgagagaattaatgatgatattaacatgaaaatttgattaagagtttagataggagaattgacagtgatattaaccgtgtcgattctaagatttgagtcgtgtataaataggttccaccacaagaattataaccagttgagatacgttcgcttcgtaataacatatgtgactataataagtcaaacaagttatgtatgcatcactttagctgaaactgctaacactactgtagaggaacattaagctaaggaaaacggggcctgattgcaacggaattcagttggaagccatatcccgccgacgccgtcggcagcgagtaggcggtagggtggccgagcgaagtagaggtggttgcgcaacgcgtcgcgggagcctcgcgtcgacacgctcaagctgcagctgctccccaccaagatggccgcctccccgaggtcctccacggcgagccacgccccctcgcgctcgtgcaaccgagacaccatgagcaggtcgccgccgccgatcgacaccacgagggagacctacgcgcactcctgcctcggctccgagacgcgtccggcgtccaggcgctcacctcggcgtcgcggctgaccgtgtagaacgcgccctggtggaacacgacgtcgacgaacttttgcttcatccatttcgggacgcgcaccgccgtccagcatttggcgcctggacggaggaacgacatgccgaacccgccgccgtggatcagcatcacggcgaaggtgcccagccggtggccgggaaccagctcggccttctggaacatggactcgcccatctggtcgaggtccttggccaccttcttgctaccggacgaagtgatgggaggcagcgggtacaacctgccggtgacggcctcgagcagggacaggccgccgtcctcgtcgacggtgacgagccagccgtgggaagaaccgacgatgcgggttactggcgcggcgccgtcgtggttggcgatgcggacggttcgttcgccgttgatgcagcggcggatgggatgaagctcgatgctgccgcaccacagctctaggttgacgctatacggccggttcggttgcttcagtagcccgaggcgcgtggttttcagggcgcgccgccatggcctgcagacggcggagcacacgacgttgttgagggcgccggcgcggcgggcgatgtcgtcgagggcttcaggtggcaggtcggagaagcagacgggcggcgccatggttgatagatttggttggcgttgcaaatgtgtacagtttggtttaccggctaattccactgtttaataaggaggtgattctacgagataatctctgccaccagcaaccaaatatggactttaacttgacttgcccccaacgaaaccgataagaggaatttttacagtactttgagaaagtactaaattttacgctacattcttaaggatgataaaattaaccaacatttaaacctcgatttggcccagcgacacaagaacgaaagtgaaaaccacaacactcgccgtcagagttaagaacatcatcagttgggcacttgcatatgaagtcaaatatttagtttctgtccagttttgaatatttaacgtttgaaatctcgatttggcccagcgacccaagaacgtgaaaaccacaacgcgataaaaatccttgaaaaatttctctgggtaactaaaatcccttgaaatttctgaaatttaagtacacggttttcaaatttgtcatcacttcacctgcgagaaacagcggagggcacaaaccaaacaggatggccgccggcggcgcgccgaaacaccgacatcctggacgccacccccgtcttgacatcgcacacgccgctctcgtaccgcgagcatcccttctcctcctcctcgaaatccgccgcgaacgacttgaccacgtagtacacgcagttgggcttcaggcacgggtactcccgcgtcgacacgcactcgccgtggttgatccccaccagcactgcggcgtcgccgacgtcgtcccgggagcgccactcgcccttgtcctcgtccacgtcgaacaccttgaaccgccgcgcccgcagcgcgttgctgtcgtcgaggatggccacggtgctcaccaccagtagccccccgccgccgtccgcctgcttggccaggtacctcgcgccctcgtagaacgccggctggtggaacgtgtcgctgtggaattccaccagccgcttgaactcccacctcatgaccggccccgtcacgagccgtggcttcagggcgcggccgtccggctcccacgcctccacggcgccgtcgccgcgggtgagcgtgtagaacgcgccgttgtgccagatgacgtccgcgtaccgcgtcaatgcctgggtgggcagcgacgtccagcggtcgtcgccggacctcgcgaatgccagcccggagccgccgctgtggcttaccatcacggcggcgtagctctccttccggtggctccccggggcgatggccgccttctggaagaactcatcgcgcatcgactggaccggcaccaatttgggaggcttccactcgatcttgcgatggccttggagatggtggtgataggcgtgattgtccaccgcgaagtattccgggacgccgtcgccgtcgccaccgacggccgtgacgaagtactcgcagtcgaacgacgtgacgggcggcaggggtacctgcgcgccgtcggtgaagggctcgaggagggaggcgcggcacgcctcgtccacgacgacgagccagccgtgggagcagccgatgatgcggtgggggcgcgcgccgccgctgccgaggtacgccgtcttgacgacgtcgccgtggcgggaggagaagtcgacggcgttggcgccggagcagagcgccacaaggtggagggagtggcggctgaggcgagggcccgccgcgctcgccgcgcgccgccacgacttgcagacggcggcaaacacggcgcggtcgtcgccatggacgcgctgggagatgtcctcgaggatcaccggcagaaggtcggaccagtcgacgagtgcggcgatgccgtccgccgccgccaccgccattatcgcgagttcaccgcgcgccgcgtaccttcacttcacatttaagataagatcgcggcgcgagaatcgaggatgaaatttgaggtcgttcgcttcgcagttaaaatcgcggcctcaacgtggatggaatttgaagacgcaacggatggatttttttggtaacggtcacaaagaaggcaagtcatctagggcctatttggttctctaccctaccaattaattggtagtaccaaaatctaggcaaattttggcactaccaatttcttggtagagcaaagttagctaatctatgtttggtttaataccaatataaagccaaaatttagtatgagagtgaagaagattttagaatgtagccaaattgagcgtgggcactaccaattgtttggcttcaatccaaactagcatgtttactattaaagttatcaaaattttggtagggtcacgttttggcttcaatccaaaacgacccctaatcttgtggaatttgatatattctgtacaacgtctcaaagccgttccatacgtgatacaggttgatgctaaaagttgccatgttttggttccgtatatcagaagctgaaaatttggactagcttgtcaaagccatagtaataatctggaagcaggggcggacgtgcccattaggcggcatggggcgacggccggcccagctatggcccgcgccgccccaccccggcccataccacagttttgctttctcgctaccgcatcgttgcgccaacgcttcgtcttcgcacaaggaccgcgactccgcacaccgtctcgcacttgctcgctaccgccgtcccgcactgccacaccggccaccggcgcacgcgacgatgacgcctagctgccgcccggcgccgagcgacggccgatgactggcccgatgccgctcgcagccggcggccagcagctctctcctcctcgtctcctcctcgcctctcgagcctcctcctgctcggcgccaacgcaacgccgtcgctgtcagcccgaccatcgtcgcctcacgtctgctccggccgacccgctccttggcctggccggcactccgcagcacgggcacaacagcaactagcaggctgcaagctagcgcctagccgcctggcgctagcgagtcagcaacctcagtggtaagccggtaggggcagtagtagcagttggaccattttaatcaaatcatcctcttccttggaccattttattgtagtcaagtaacaaagcaaatttgattgttcttcttgcaaatgatctgttgctgtctagattagttaatcatctgtttaggataatggaaatagttggtactcctagttaacactgttctactgcatgttatttactgtaaaaatggaaggcatgcgcagttacttgcaatcttgcatattaattatttacttgtcctactgcatcttttggtgtatgattaattatatatgacgcaaatattatttctttgtcataaaatggttttgttcgcctcgagtatatctttatgcgattacggtataaatatggtatttgttgcatttaggtgtctttataaagacaacattttcactccatcttatttttaatcttgcgtccgccactgtctggaagtaagcccattgatctgaataaaaagaaataaaaacaacataagtataaattaggaatagtacaaatcgcaggcacacgatgaaaaatacacaatactgacacaataacaaacgtatacacccctctatctccaggctcgtgctatacatgttgacctctcctcgcgttcacaaccaattactgtacagatacgcatacagaagtagtcagcacgtagcacggccgcatacatatgtttcgaccaaccgatggtatgttcagacccgacgggaattctctgcattaccgctgatataggatgagccactattatataggatcaaactactggctgccgctcgtaattgctactgtaccaacagcactgcagaggatccgtgtccgtgtcaaatacgggcatggaagctaatggggtagaccctatcggtgctggggtagaagaggccccaattctgctccacgccggcctccttgaggttctcgttgaacatggcgaacacgtacgtctccgtcttcttcccgggatgccgcggcgtgccattccggacgtgcctcaccaggttctggttgaatgtcatggcgttctccaccgacgcgcccacgccgcccgccgtcggccacccggtctcagacaccaccaccctcacgttctctcccccgagcttcgccaccgccgtgtacagcgcgtccaccgtcgcgtcgaactggttctggtacccgtactccccgtcctgcaccaccgcgccgctcgccgtgaacagcgcgaagctgatgtccatgccccccgggttgtatgagtagatgaagtatgggtacaggttggccagcagcggcgcgtgcgtccgttccaggaatgggatcacgtagctcatgaacggcttcgcctcgtcggtgaactcgccggcggacggcgggatgtggacgccgatggtggcctgggagatcgacgtcgtcaccttgatgtgtcccagcccggccgccgcgagcgcggcgtggacgttctccatggccgggacgaggagctgcgtgtcggcgccggcgacctcgttgcccacgacgacgaaccggaacaggaccgtcgggtaggcctggatgttctcgcggatccaggcggccgcggcggcggtcccgccgtgcgccagggcggggaggtcgtagttgggcgcgccgacgacgacgcggatgcccgtgccgccgagcgccgcgagcgcggcgctgtccggcgcgtagaggcgcacgacggtgaagccgttctcgcggagcatctcggtgaccttgctcgccggcggcaggttgtcgccgctcatgccccagcatactccaaccgctgccgttcctgtctcagattccatttcaacctttgtcaaattaaagcttaagcttctgatttgattttttttgcagtatacgtaggttaatcgctaccgcattttatagtaacccgaactttaatttgtaggcacgcaagcaagaaattaacgtaacgtaggtacgtatgtagcttgcaaagacgcaatgacaaacaaaatcgagaaggcaatcatatatacaccgtacattagcatgcgtggaaggatccctcttgaactttattgctggaattgccgttgtgttgccaacaattaaaatggcactccctccagtcgtcagggatgatcaaacttttaaaaattatagcagtcaatttatattagagtaagtttattaaaacctaacaaatctatatatttgataatgtttttcaagtcaaatcaatttgtactgtttttttaactaagtatttgagaaattgttgacggttgaaattttaatatttgagttcatgtttcgtagaagatgagatgagatggttgaggagcacagacagtgagatcagaccggaaggaccggcaaggagtcaatccaaacctcgttcgacaaattgacttcagcgacatctcggaagaataatttagactcatggaaactgacgtttaactgaaaacgaagatgtagtagtacaactgcactagcacagattcctaatttccgtcgttttttttcccaatcgtaagtgctctctgatggtactcgcaactaacttatgttcgttaaaaacatgcacctaatcgagttagttgacggcaattctgccaaagtgctttacatacattcagagtttcagactcagatacttagtccgtcgagcaccagttaaataaacaaatcaggtggtggagcgtgcaatttgccgaaatttgttagctaccaaagcagagcatgcagttcttgactaattaaagtttcatgcatactagtagcattattatttgtccatatcttacatgtacagacgaactaactaacctctgttctttagaaaggaaaagaaaaaaaaacaataaccaaacaatctggttcacaaaatcacaacctagcaaatttgcccatgcaaacaaagtagctgtcaggtagaaagcgaaggaccacgtacgggaaatggaattgaaaacgtctgttccaacgtctgcagcacgactgttggacagtccaattcgttcgcatgcatgcaggcatgcaaccgtgtccatttcgatagctaacaggattacaggactgcaccagcctgcccgtgatcacggccggcctcgccggtcgcgcttgtttgttaatcaagtgcagaaaagccaaacgatgcaaagaaacttccttttcggcttatggactaatggattgtcaccggcagtcatggtacactttctaagcctctaaacgatgtactccaaaaattttcttcaccagcctttgttagaaacaatttttaaatcaacttttaaattttctaatatttaattactctcaaataactgttacgaactcagtttgtgctatcatccatcaaagggatcgggctgagttctttctccaattttcttaactcatctcccttatttttcacgcgcacgttttttaaattgctaaacggtacgttttttataaaaattttctatatgaaagttgctttaaaaaatcatattaatcgatttttcaaaaaaatgctaatatttaattaatcatgtactaaactgctccattttacgtacgtggaacgaacacagcctagtccatagattttgggcaaatgagttactgacaagctggtacgtgcgtactttcacctctcctgaaggaatcgtaatctagcgtgcagtagtgctggtaaactatcacacatcatgcatcttaatgacgcccctaaaaccaattaattttctaacagaatctagctttgtggtaccatactagtttcttaatacagtagtatgcgtaatcgtgcacgaatttcacaggaacggtgagaattttcccgtgtttcatcaaaccaaacgtttgcattgtatatttccatgcatagcgttcatgctgaagaaagagatgcgtccttgaatctacgctcgattgcttacatgttttgttttcttaccgtgttaccgtttcactaaatgagtatctcgcgtaacgcttgtcatgtagtactaatgtgcaagatagtaactccactacttgaaatcaacaaactcactcgtacgttcggcaatggcttgcacaccaatttcaactttttcacggcacaactcttcacataggacaataaacttttcgcattgcaagctaatacaaaaaacacaagaactaaacagaagcagagtatgctagaagaaaagcaggggaacaaaatcagtgagagagttctgtacctgctaggatggaggcaaagactgcaagtagcaacgccatgtcgagcatggaagcagctgaagacgccattctcaagctcgactcaacctgtgacatctgacctgttgttgcttcttgcagagcctaacggccacgagcagaagcgctactactcccggcttatat

SEQ ID NO: 13899 - DNA, 2195 bp, Oryza sativa
attcctgcagcccaaaattattgcatttttaagaagatttcgctctaattggacttaatttttttatagcaaattttagtttttagttgtttttcagccgtgacacatttttacattgtctttcagtagcccatagcaaaatatgtcttttccttaacatgaatgaacttgaatcaacttgttagagtatatggaagttagagttatattaggatatccttcctcttaattacgccaaagttagaagtttgtatcctttgaaaattattgcatttttaagaagatttcgctctaattggacttaattttttttatagcaaattttagtttttagttgtttttcagccgtgacacatttttacattgtctttcagtagcccatagcaaaatatgtcttttctttaacatgaatgaacttgaatcaacttgttagagtatatggaagttagagttatattaggataggattggtttgtttggattccttccatatctgtaatccttccttatctcttccccatatactcctatatatattgaccccctgaggctcaatacaatgtgtccaatattcgcagtatcctctccccctatactatccaacatggtatcagagcaggcgatctagcgccgctctcacgcttccgccgccgccgcccccgggagtagcgatctcccgagggcggccacccgtttttttttccgttcgtcattcgcatctgcgtcgtcgtcatgagatgatcgatctcgatcttcttggacggcatgtcttcgtcattacgtcgtcttcgtcaagtcgcgccgccgagtagatcgatctcctcggcggggctcgtttttcgtcgagtcaacagcagctacgtcgatctggtgatcttggaagccacggcgtccgtctctgctccagccccgtcgcccgagttccgccggcgcggccccgacggccggatcccgagccgctcggtccatgccgaccgccggatcccgagccgtcgccagcctccaccacctccagatccactcagccggttcgccggctcatcctccgtctcttcaccgcgccgaggtccacagccggcgtcgccgggctccctctgccgtgccgtcttcaccgtcgacacacggacgccatcggcgcgccagggccctgcagccggccggactcatcccggccgcatccctgcaccgccacgccctccgactccgccgcctttcgtctccaccacctgcgccctctcctgacgtcggctgtcagcaccgccgggcctgacacgtgacaccctgtcctgttttttttctcttctgtgaacttgcttgactgcaagggaggagagagagaagtgtagacatggagtttcatggatggctggctctggctgtggaggtctggagaggacagatgtgcatgcgtcattggtgctggtaccgttgaggcagagagattgctggacttggtctatggaccgacaccattgaagaagagatgtggtgttaccgtgttgctgctgctgtacatgtgtgtgtctgtttttttttcctgatcatagatcgggtttgcgtcgcccaccgcctcgtcgacttctacacatctccgacatcggcatcgactctgctttgacttcatcgttcagccccacgcatcttcggcttgatcacccgttcaggctcccggctacaacgacttctgcaaccgatcgtcatcgagcatgcgtctacgccattaagcttcgggttgccgctgcgtcgcccccttgggccgcagtgccaccgcccgtggtccacctccacttgttgttggaacgctgagaggcgccctcctcagcatggcctccctactagtggagttctcgccgctgcatcgacatcaagctgcacctgtgttgcccctatgggtcacgatgttgcccctcgtcgtcttcatcgccgttcgcgcttcgacaccctcgtcatccgcactggtcatcgtcagccgctcagggtcttcttcgtctacttcgagcatcgtcgccgcatctccaagctgccaccgtcgccgctctaggccggtggtccagctacctctacatggttactgacgtcgccatccaggccgttggtcccactacttcgccttcgtcttcgtccagcatgattcatcgccagtgtcgccgtatcttcctcgactacacttcgctcttctccggcaactgcgtgct

SEQ ID NO: 13900 - DNA, 1529 bp, Oryza sativa
ttttgaataagatgaatggtcaaacatgtgagaaaaagtcaacggcgtcatctattaaaaaagaagagagtatgttagaataataatattccactagtattaggttcactaaccttgtgcggagaataatcataaagtggaggagaatcgacatcaacacagacgataaatcaatcggatgatgtcgagaaccagacttatatatgaatggaccaagactcggaattgacacgacaaactgggccaaaattcacaagtctgtggagaagaacaacggaggaggccgccagccgaaattgggctagattgggcaggccccaggttcggctgaaccctcctcagtgccatccgatccagggcttcgcctggaaggtgtggattagcccccaatgacggttagagggtatttccgaccattccaacattcacaacgccattggaaggctataaaaggagttgccattcccacttcactcacacacctcaagtaaagttctctcatattctctcaagtttagtttagtagtatcaagctagtggaataggaatagagtagaaattaggagtccggaagtcttcgaaagagttcgggtatggctttagtagctttcctatcttcttttgtaagctttgtagtattattaaatattcttctttatacatttatggtattggaatactttccgagagtatgaatgccaattttacattatgttcatgttatactgaatatgctgctagcttatctgggagatgctttggtgcgggtataatgtttacttatgcatttactctatgtcatgatgatgatattagagtagtatctggaagtttagacgtggtgtctagattacgtgatatcattatttggggttatatgctgcggatgagaggtgggccgctgatggtgacagctcagtacgggtattcctccgcgcgtgtatatgatcctaagttaattccctggggaggatattcctccgtatttagccccgattgtatggtcatgacgggctgtcataaggaactcgacagttaggggtggcttctcgaagtaccaggagggcatcggatagagagtattagctagtatatcagataactagaatgtatgtatactagaagtataggaatatattttctttctcatttctttccacttagcttagataatatattatgagaatgagtagctattgcttatgtgtcactctacccttggattatcttaacccctgctcaggatatgattatcacaagtaatatataaattattagtcaagttctctctacatgatattctcatgggataaaataaatacgatacccttgggtgaaatactacaatggtatatgcgtgagcttacggataaactctgtaaccataatataccatgaatatttctgcgtcattgttagaaattatatttctagtaatatcgttaaaaaataccaacacctgcatcgcgtgctgccaccttgtcgccgctccacgccgcaccatccacgctatcacgggctgcaggaat

SEQ ID NO: 13901 - DNA, 2668 bp, Oryza sativa
gcggccgctcgccacgcctgcgccgcgctcggccatgcgccgccatcggtctcctcataccgaacccctcgtatcgtcgcgcccccttgagccctagagaatctccccgggacgccgccacggctggccgcctcgccggccgcgtccgcgccgtgccgcccatcccgccgccgcatggccgccatcgcgccgcctctccctcatccgagccgatggatggaaccgccttgagcccctctcgcttccggtgcctgccggcccctccggcttgccgccgctcgccggcggcgttgcgccgctgtgagccgtccgatccaggcgcctcctcctcccctctcgccttgccaccgtggctgcccatgtggcgtttgacccagtccatggtgcccagtcagccgccccctcctctctctccctgctcgtgggcttggcccattggccaaccttcctcctcggcctaaaaaacaaggaaagtctatctttactcccttccccaaacacagtggccaaaagtccataattgctccctccctattcactcctctctcaccatatgttggccccacacgtcaatgagtgactaaaaagaatattcttttccacaaattcaataaatcatttctttaatccagaaaattcaataaatcctttttccgttgttccacaaatattttccttcctcccagaaaattcaaacaaccttcgtaaataatttctcttattcccatcggataagtacatatcctcccttgtccacaaaatttccacaaattgttttccccgctccaaagaatcaaataaatcatttccttgtccagacattcatttaaagcctccaaaaattcatatctcccgatccgtgactccgattgacctcgttccacttccagtaattccgtaaaattgtgatctatctaatggcactattattttagtctaaataggatccttttctatttggtccttgtttagatttttgattgtatgcgcctagttgcggttaccggatatttttcgtcaagcggatttctcgaagattcgtgaagaccctgagcaaggcaagccacctttgaacatcttgagcctatatttgaacttaattatattgattgtaaaatattattcattgataggattgcacttaatatgtttgccccgcctgcgaggcagattggtgggcctacctaacttgttgcatttgatccttccattgttaattgctatatcatgctcccttgtaaccacctggttgcgcctcggtattcatacactctgtgcgagtatcgacggtcgcctttaaaacttaaaatctgagaaacatcttgggtaaaacttggtttacgaaaggattggaaaacccgacgcctgggtcggtgccttgtgaaagaaaatgagttttaaaaataaaactcgcgacacaaggccattcctgggcggaatgcttgtgcggtcacatttaaggaccgattcctttggaattacatccgagcatataacaagtgcgaccacatgggtggaatgggacacccctggctgagtaacaagctaggccagggaagccttgatgccaagagacaagtggattcgccggggtggtgtcggggaggacccctgggcttcatggcacagtatggtctgggacctaacctgttgttggtccgggacccctctcgttggcatatggcaaccctgtgttggctttggaaatgccttgtcgtgaaagccccaagtcaccagacgtgtttgatccgcacgggctaggtgaccaaggctagtaacgtcatgtaggtaaagtgtaccccctctgcagaggttaacaaactgttcgaacagccatgcccacggtcatgggcggatgtgaggtgattccttagcgtagtttttgttttacccagctttgtgaaaagatgttgaggtttgggaaacctgatgtttggataaagcaagcggatgtcagggagacagcgggacagggagtccctgagaatgactggttgtttggagacaaccaaaactctgaaagattggaaaattggtttggtttgggaaaccaactttgaggccaactctgggagttgtgtaaatcttgcaaatcaaatttggttacgtctcgcccccaaccaagctgagacttgtctcgctctgtttgtggaaagcacacacttagattgttgaaaacttgaaaacaaatttgattgctaaaataacagcctttctgacggagctcgtggctcctcaccgggagaccgcgcaggcccccctttgccggttcggccgggggcttagggtgagatctcaagctctctctgtatgtggaaagatcgtctcctcgccagaagaaacgcgagacaccggcgatgtatacaggttcgggccgctgagaagcgtaataccctactcctgtgttttggtggatctgtgtatgaaggagctacaaagtgtgagccgacttctcccctgttctaggctctcaatctccaaaagaatcaacccccctctctatgggcaaggtcctccttttatatttcaaggggataccacatgcacctttctctttccaaactggactgttctttttctctttaatgggcggagatcggtacggtttccatccgggagcccttctgatgggacagcccacacctacccccacctcccccgaagacag

SEQ ID NO: 13902 - DNA, 21174 bp, Oryza sativa
ttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgactgcgtctgcctcaagcctctggtcacgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgagcgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagctttttcttactcattttgttcgtcttctggttttttcttctgcttcagcgatgtcccgtcgcattcctcccgccaccccaagtccggccagtccgaggccgaagatcctgcggccgcggaggagcggaggcgagaatctgaccggcgtgaagccgcagaccgccttcgggaagctgaagaggccgcccgggaggccgcccggattcgccaagcggaggaagctgctcgggaggaggccgcccgggctgaggaagccgctaaggaggaggccgcccgggctcgccaggctgaggcaacagctgctgctggcgcgtcaactgggcccactccttcgggcaaccctcgggcgacagcctccggggaggctcgcgacgaggccgcgggcacatcgcctgggcccacctccccgggcgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctggatgggtttagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagcttgacgccgcccagggagtccttgactccgccgctgcccgagagcggcgggtaacagagactgaggcggcgtcccggcggcgcgaggagtcccttgaggcccgtgctatggcgctggaagaacacgccggcgccgtggagaaaggcttgacgggccgcgaggccgccgctactctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaggaggagcaggcgcgccgcaatcttgaatgcgtccgcgccgagagagccgcactggagcagcgggctgctgacctcgaggcgcgggaaaaggagctggacgcgagggcgcatatcggtggggcggccgcgggcgaaagcgacttagccgcccgcctcgcagctgccgaacacaccgtcgccgatatgcagcgagcgctggactcctccaccggggaggccgaggcccttcgcttggcgggcgagattgggcccgacatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttccctcccgggaccgaggacgacgcgcgcgcgcgggtcggggatgctgccgaccacatcgtcaacggcttcgagggctcggcccctcggctcgcgttcgcccccaactccgacgaggaggggaacgccagcagtgcaagcgacggtggcaacgaggccggcgacccgggcgcgtcagaatgagcccccaggcccccgccaatctccaattttttctttttctttcttctttttgtatagatcaacttaatctgcaatcaaaaatgatgaaaaatttcttatgttaactttattttgctatgcatatgagttgaggatgatttgtgccgtggtccttttgcatcttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagaacgagtgaccttatttcaagttaagattcttcagaaggaaaaacggcacagacacaacctttaggaaattgaaactgcttttattgaaatgctgaaataagaaaagtaaggctgtgcatgtgtgatagcccccggctaaccctgcacacccgaggggggtgcggggttagcccgagcccgaaacctgacacccgaccccccctcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataattcggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccaggcagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtccgcaagaagctcaacgccttgttccttaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgcgagagttcgtcggctatcatgttatcccgtctgggcacatgccgaagctctatcccgtcaaaatgacgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcaaggcggaccagatatctaaggacgtctccggtcggggaggtcaaagtgacccccgcaccggcaccctggagggacagagaaccatcgaactgcatcacccagtgggtggtgtgaggcagctgcgaggagttcgtgctggcctcggggattgagacggtctctggagccggggtccattctgccacaaaatcagcgagggcctggctcttgatagcgtggcgtggttcaaagtgcagatcgaattcagaaagctcgattgcccattttaccacccgccctgtaccctctcgattatgcaagatttgaccgagggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctctgctaggggccgtatccccggggcgttcttcgttcaagtggcctttcggggcgcacttgtcttctgtgccgatgacctcggggtcggaggatgaaaggggcggccttccctcagtggcctcggggccgtcctgagggtcgggggctcctggtatcgtcggacaagcgggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggcctcggggccctcctgggggtcgggggcacctagcaccgtctgacaagcgggcagagggccgactccagtcgtcaggggccgtaggccaccgtccgactcgggggcccctcctccccgctcgctcccgggccaagttagcacagaatgggggtgcacgaaatgaggattgtcttcatcgcgctccacaaccaacgctgcactaactacttggggggtcgccgctaagtaaagtagcaagggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcacccgctcgatagctcgaatcttctcggggttggcctcaatgcctcgggcagagaccaagaacccgagaagcttgcccgcaggtacaccaaacacacacttatcggggttcagctttatgcgggcagagcggaggttctcaaaagtttccgctagatctgaaagtaaagtttcttggttgcgcgtttttacaaccaagtcatcgacataagcctcaacattacgtcctatttgactacccaaagaaattcgagtagctcgttgaaaagtaggacctgcattctttaacccgaagggcattgatgtataacaataggttcctacgggggtaatgaacgcagttttctcctcatcctccctagccatgcgaatctgatgataaccagagtatgcatctaaaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggaaacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggcgccaagcctctcgtcaccaccctcgggcttggtcgcagcagcgaggtggtccgcgcgctgctccatgcaggcgagcgcgactttaaggtcgccacggacagagatggggccactggggcccggcatcttcatctggaggtaggcgtagtggaccgccgccataaacttcaccaacgcgggcctccctaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccaatgatcggttgaaacggctggagcaccatccccggggccttgatagcatcaaaggccgcgggggaaaggatgttgagagccgctcctccatctatgaggacacgacccaacttcacattgcagatggtgggggaaactaccatcgcaacctgccctccccgggcaatgcacggtgggtggtcggtctggtcgaaggtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgtttggcctcacttcgccgtttaccggagggaactgccgcggacttgccctcacggcgttcctgcctcctgtcctcctcccacttcttcgttcgctcagccaagtttttgactgcgcgacaatccgcgagatcgtggagggaggtgttgtggacggagcaccacttgctggctgggcgctcccggatgggagtaccagcctctttctttttgtcgctcgcaggcctcccctttcgggtggcccgcggagcgccctcaacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcaggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcgcggggagtacgccggttattacgccggcgctcgatgtcgatgcgggcatccggctctccatgctgaccctcccgagttggaggtgtcgacgagggagtggcggccgaatggcgcgcagcagccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccacgtcgtcgccgctcacactcggagagagatcgtgcgcttttccttgctcggccattaggctgaacaagaaaaacttggcgcacacggaagagtctgagagctcagaaaacacacactgagccccctacctggcgcgccagatgacggagctcgtggctcctcaccgggagaccgcgcaggcccccctttgccggttcggccgggggcttagggtgagatctcaagctctctctgtatgtggaaagatcgtctcctcgccagaagaaacgcgagacaccggcgatgtatacaggttcgggccgctgagaagcgtaataccctactcctgtgttttgttggatctgtgtatgaaggagctacaaagtgtgagccgacttctcccctgttctaggctctcaatctccaaaagaatcaacccccctctctatgggcaaggtcctccttttatatttaaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtgtaaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgactgcgtctgcctcaagcctctggtcacgatactcccggtcccatatcaccgacactttccttgaagcttgaattaaccatctaagtccccctggcttgctgagtacataagtactcacccttgctctatatatatatagttctgccagctctgaaggtgaagttgaagtgaagtgaagattaaggtttcgtcctagttccctagtattgcctgtggttgtcacgccctgaagttttcccccctttgcttgctttaaaaattggctaaataaatcgtccgaagaaattatcttaattaacctagagctaattccctaattaataaatgcaaataataatcggaattggcattgtgggatttttcttgggttccacatgtcacaatatattaacaggatttatagtggaattttcagagccttggaaataattttaaccaattaaaaatgagcaagcgcaatattttaatcccaggaaaatcctttttctctttttcttttcttttccctcctttttctttgttgggccgtcggcccatccctctcccgcggcccctcctccttgtgggccggcccaagccgcccctccctcctctctcgggacgccgacaggtgggccccacctgtcagtcgtctcccacctccggccgctggagccgaagctccaaccgctgccgccgaaaccgccgcgccgccgtcttcttcgttcctcccgcgtccacgtcgcgcctccactccgcgcccgcacctcgcgcccacgtcgccgccctctccccgcatctcccgcgcgcgcgcgcccgcaagtggtgggggatttgaaatccccaacgccctctctctctcctccacctctccacgttgccggccaaataggggccatccccggccgtttccgcccctccctcgcccataaaaaccctcccctgagtcccctccctcgtttcccccatttgccgtcctctcccacgccccctaccgcgcccacgccgtcacacccgagctccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccggcaattcaagccgccgtggtcgtcgtctcctctcctaacgcctctccatcttctcctagggtgtcgccgccgcccgtccgtgcctccgcatcaccggtcgccgccgccgctttcttccttcgcgccggccgccgtgctcgaaggtgaggaatcccctctcctccttcctttcctctctctcccatgagcgccgccgtcctccgcgcgtgcgccgtcgtcttcggccgccgccgccgccttcgcgccggccgccgccgtctcccgcgctgccggtcaccgccggtgaccgcgcgtgccgccgccgccgccccatggctggccggccggcttgagccgtgccaagccaacagccacgcccctctcccgccctgtgccgctgcccggtggggcccaccagccggtggaccacccctccctctccccttgtgccgctgccagtggggcccgcttgccagccgccccctctccctctcgtagtgccgctgaccagtggggcccgcatgtcggcgccgcccccccttggatgacgtcagccctggggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatagttttgtttcctgcttcagtagtcttatagcctgttttgcttgtgtgctttgtttgtcgcgtagatttcggccgtttcgtcgatccgcagttcctcgaagacgttgctgaggtctcatcagttcgagagcaaggcaagtcatgcaatacgtttgatcatattgtacccaatttacaaatatcccgcatttctattaaatgttgcattcttttacaatatcatgtgggatgggtcctattactcagccatttattgtttaccatatgccattgataacctgggtatcaaaatgattagatgttggtttaggaaatgcttagccatgcttagttcaactagtacacaaatggggatcacattattacatagactttgtctattggcatagctttagattggtgccaccgcaatggtgtgagttaattaaaatacactgaatggtgggctgtgggtgcatggttttgctggtcgcacccatggcggttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccaccgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttctactgctttcaactactgcttttaaatgctagctttatgcaaaagaacctctagcctcctgtggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttattcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttaaaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatattatgtgtcagtggtatgactgcctcaattaggagttgcgtgcctctttttcagtgttttaatcaagattaagataattgcacttaaattcataagcaagattagtttctgagccctctgtttttcttccttttctcatatttctacctatccccttcagatggagataaggaatggttcacgcgactcgaacaacgccagtggcagcgaagagccgatcaatggagcacgtgccaacggtgcatctgacaacagtctgtccccaccgcccgagaacccaacaattgctcaggtgttggacaatcagactcagatgatgacaatgatgatgcaacagatgcagcaacagtaccatcaggtgatgcagcaggtgcagcagcaagcacagctgcagcagcagaacctgcagtttggtcctccacctcctcagtccaaactgttagaatttcttcgtgtcaagccgcccactttctcaagcaccaccaacccaatcgaggcccacgactggcttcatgccattgagaagaagctgaaccttttgcaatgcaacgagcaagagaaggttgcttttgctacacaccagctgcaaggtcccgcttctgtttggtgggacaactacatggtgacccgtccagctggggcagaggttacttggacagagtttcgtcatagtttcaataaagcacaggttcccgagggaattgtggcacaaaagaagagagagttccattccctgcaacaaggaaccagaacagttatagagtatttgcatgagttcaaccgcctcgcgcgctacgcccctgaggacgtgcgtaccgatgccgagaggcaggagaagtttctgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacaatgggacatcacggtggaccttccaccatgattatccggcagcaccgtccctaccacccgggtaacttcaacaagaaccaccatagtgacagtcacaacaatagtgagcagcacagcctcaaccctactccgagttcactaaagattccagcccaatcagttcagccagctctgccagaacagcccaagaggttgggagaaaaacccgaactctgcttcaattgtaacaaacccggacacacggttggaaagtgcccgaagccaagacgtgccggacccaagttcgttcaggtccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaagctggaggatattcccatggtcagagagtatccagaggttttttcggatgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggaaaagaaagacaaaaccaagaggatgtgcgtggactaccgcacactcaatgaggtcactattaagaacaagtaccctttgccaaggattgatgatctgttcgatcagctgaaaggagctactgtgttctctaagatagaccttcggtcaggctatcaccagttgaggatccgcgaagaggatattccaaagacagcattcatcactcggtacgggttgttcgaatgcacagttatgtctttcggactcactaacgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagtcgttcatgctttaaagatctggcggcactgtctcatcggtaaccgttgtgaggtatatacagatcacaaaagtctaaagtacatcttcacccaacctgatctgaatctccgacaacgaagatggtttgagctaatcaaagattatgatatgggaatacactatcatcccggcaaggctaatgtggtagcagatgccttgagcaggaagagttactgcaacgtcgcatgggtagaggaactatgctgtgaggttcaacatgatttggaacatttgaaccttggtatagttgagcacggattcgtggctgccctagaggcacagcccacactggtggagcaggttcgcatagctcaagcaagtgatcctgaaatagcagagctcaaaaagaacatgagggtcggaaaagcccgaggttttgttaaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagaaaagttctggtgggtcagcatgagaagggaaatagctgagttcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattgggaacccggttgaatttcagcaccgcttaccatccacaaacagatggccagaccgagcgagtcaatcaaatactagaggatatgttgagagcctgtgcgcttgactttggtggagcatgggacaaaagcttgccgtatgctgagttttcttacaacaacagttaccaagctagtctacagatggcaccgtttgaagcactgtatggacggaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctcccagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttcccccctttgcttgctttaaaaattggctaaataaatcgtccgaagaaattatcttaattaacctagagctaattccctaattaataaatgcaaataataatcggaattggcattgtgggatttttcttgggttccacatgtcacaatatattaacaggatttatagtggaattttcagagccttggaaataattttaaccaattaaaaatgagcaagcgcaatattttaatcccaggaaaatcctttttctctttttcttttcttttccctcctttttctttgttgggccgtcggcccatccctctcccgcggcccctcctccttgtgggccggcccaagccgcccctccctcctctctcgggacgccgacaggtgggccccacctgtcggtcgtctcccacctccggccgctggagccgaagctccaaccgctgccgccg

SEQ ID NO: 13903 - DNA, 2266 bp, Oryza sativa
cggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttctactgctttcaactactgcttttaaatgctagctttatgcaaaagaacctctagcctcctgtggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttattcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacagtggtgttgggtgttagaccgttggttccactgctgctgctgttgttggtgtttgcctcgtccgtgtcgtcggttgtattctcgggttgtcccgagctgcaacctaagtcaaggtaaataaatcctctatttattttaaggattgcaatgattcatatttgtcaccgtgggtaccagcgctatgtcctaggactggtactgtgatcgcggtttcgtaggaagcggttcgcgccgtttttcctacgacacgctcctgtcaggtgccgttgtacggcggtgccggatcagggtgtgacacgttcccgtccaacccagccccgaccctccccgttgccacccctagttgtaatgatggtttgtgggttggttaagctcagaaaccacacataaccgcaattaggactccagtatcttgctccacgtgttggcagatggcgaggggatgcaaaggcagttcgaccgaacttctggctcacctaccggccactcattcggttgggaggctgcctggtgggcccccaacatgttgtactttggctggactcaattttaggtggttttgattgacacgtggggcctccaaaccgtgtaatcgtgtccgattgtccggaggtgtatttggtcacatggcggatgatttttgtccatatatttacctatatataaatattcaccaagactactacctctaagtttggtattctattttatattctttcaattgttattatgcatgaattgataaatcgaatttggtacttaaggaccatcaacaccatccaagcaacaaatggagacaccgacaatagcatccatccaagcaaaaagaagttgtgataacaactaccttaattcaatctttgaatttttttttttgcttaacccgactactaccacccatccaagaacgaacaatcaagggagacatctccgacgaccaccaaaccagccaatcacccgtcactatcggttggtagcgcgccggagaagaagttctggagcatgatgaggttcacaagaatgggggcaatggtcccgttcttttctccaataaaagttggatgaagattaagattttcgtggcacgcttttcaaattgctaacggtacgtttcatgcgaaaaatttatatatgaaagttgctctaaaatatcatattaatctatttttcaagtttgtaataattaaaactcaatcaatcatacgttaataccaccttgttttatgtaaaaaacgtattcttcatcttcatctttattttcagaagaaaagaacatcaccaatgtaattacagacagtgctccagagtcctcagccatcggcgtattctggatctaagtgaaggatagcgtaatcaacatgacaacgagaagcgaggaaaatggtgacgccgtctcttcttgccacttgcgacggcgatggctgagggtgctctccgaccagatcggtgtctccattgcccgctgacccacatgtgcacggtggagagagatggggagatagaggaatgaggaagaagaaaaggagaaaggatgggaggtagattcaacgaaattctttcaattttcatggtacgatttaccattgtcacgtgggacaaaaccacctaactaaaccgctgggagactcgatttgcactagtatatctatatatctatctatcgattatattattaaaacag

SEQ ID NO: 13904 - DNA, 13203 bp, Oryza sativa
gccacacaccgccgcaccccaccatcgccgcgccgacccggcgagaagggagggacggcgccggtggcgggggagtcggccggctggggggagggggagagacgccggtggggagagggagggggagaggcggcgtcggggcgggggaggaagaggcggccggctcggctcggctggggggagggttagggttagggtttcatcaattttaatctgatctgagccgtccatcaaaactaacggctgagatcgatcgagggtttgggccgcacgtgggcccgcggtccactaaatgaaaggagtatgggggtattaagtagactttggtctcttgcgggctgaagaagaaaatgggctgaaaaaggcccatagagaaaaaaggatttttatttagatttttatttcaataaatgctgaaatgatatttgtattatcaaaattagcaattaagctaggtaaattccaagaaaatttcaatgagtgtaattaatatagaaaatttaataaaagttaaatccaaccacaacattttatttcttacacttactttacttataaattaatttaattgtatacctacctacttaaaaaatacctaaatatttcagaaaatttatatttcatttaattagaatttaatatgttttaattcaactttatctgttttttctattcgttgcaacgcaatatcacttttgctataatttaaaagagtgtaattaatattgcagaaaattttatatttcattaaattacaattcattttcttcatataaatagttcaaatcaaatttcagtcaccatatcattacccggtgcaacgcacgggtattttgctagtattatacaatatttatagaacttttgcaaaataaagagcgattaaaatttaataggctgtgtcaagtaaaaaaaacaatcaaatactaaaagatatgttacgtactcccttataagaacatctgttagccaatcaaatcaaggtatatatacatatttaattaaaatttaaaaattgataaggacgcaaaggatatttcttgccactacaaatttgcatgagaattgctagaaataaagttttcagggttggagtagaattttttttttgttagttctactttcgtgagaaatgccccgtcattgtaaggtctaaaacattatttgaaattgggtataggtattaataaactaggtgagtttttagataatggataaaatccagtgtttacttcaatagaagctatagccattattacatagttcttagttgaaaaccaaatataaactaggtgagtaagtggaaaaattaaataagaaatattaaccaaatataaactaggtgggtaagtggaaaaattaaataagaaatattatgattggttgagacaagggactggatactcaattgctatattctgatataaactttgaatgcttatattttgaacgaggaaaagatgttcttttatcataaattcgatttggtcttttttatatatatataaaaaacgagtacggtcgttatttaaaaatgtccattttgtaaagcttatttttaaagaccatggcttatttagctgaatataaagctcgataattaatatttttaaaataagtacattttaaataatgtagacttacataaaaaaacagtccattttataaagcttatttttaaagaccatggcttatttagctgaagataaagcttgataattaatatttttaaaataagtacattttaaataatgtagacttactaaaaaacactttttaatagctatgccataaatagattaaaatatgatgatttttaattgaataaatctacatgttaaatgaacaatttaatgaagttggcctaatcctaccaaaatcttttgaaatttctacgttcatgcataagaacatgctaaatggggcgcgccatttggcgcgagattttctagtatagtactaatatttatctgttcgacgcctccaaataattcgttctcgtgtagtcgtcagctacgtaccgaaagctttgcgctttgcatgcagcaccatcaccatctagttctactaataaccagtaagtccatacttctcgatacaactatggattaaaatataaacatgtaaatttaaatgcaaactacaaaataaatataaacacggatgtttaaattcaaactataaggtataagaaagaatacattcttaatttgtagattgagagattgagttttaaattgaacgttatgaaaggatggaatataggtttacttaaaagccgtgggatcggtggaagactaccagcacatcagcaatttttgcaaaaaaaaccctacacttttggttaattacgcaccggtccccgctaatatccgccgtccgatctcgaggtagggtcgatctggccgtccacgttcctcactgtgctggcccttccgcacccgtgggatcgtcggatctctaacggacggtgtggatttcgcaagcctgaacaaaccctaagtcaaggtaaataatatccaaaaatagaaaaaataaaagagagttcaagtaggaatacaaatttgaaacaactgaaattgaaaataaaaaataaaaatattaaaagaacacaatacgatattaattaaaatttgaaaaaaaaaataaattccaaaattagaaaaagaaaaataagatttcaattaggaatataattgtatcgctgtgggggcaagaaattcccacattaatcggagaaaaagaaaaaagagtccaagtagaaatacaatttaaaaatagctgaaattcaaaattaaaaataagcaatattgaaagaagagtccatataagaacacaatacgagattaataaaattttaaataaaaataaaataaaattagaaactagaaaaaaaagagtccaagtagaaatacaatttaaaaataactgaaattcagaattaaaaataaggaatattgaaagaagagtccatataagaacccaatacgagattaattaaaattcagaataaaaataaaataaaatcctaaattagaattaaaataaaagaatatttcgtatagaaatacaatttaaaaataactaaagttcgaaatttaaaataagcaatattgaaagaagagtccatacaagaaaccagtacgatattaattaaaattcaaaataaaaaacaaataaaatccagaattagaaaaaaaataaaaaagagatttcaagtaggaatagaatattgaaacaatccaaatatctactattataaaaattgaagatgtttccacagtcggtcatctgtgtttgagtcggttataaaaaattgaagatgtttccgcggttcgtcatccgtgtttgagtcggtttttttttggtattaatctatatctcttatctatctcttctctactattataaaaatttgttaacgaccatgtttttatcggtattttggtaagtcatccgtgtatgagttggtttttaagtttgtttgcttttgaaaatacatatccgtatttgagtcggtttttaagatcgttcgcttttggtaataccgaaagaatcatgcaagaaatctgtttaaaaaactcgcatgctaacttgagacgatcggactcctaactacagctcatgattttctaaaaaaaatatatatccaagcgaaatcccacagtgtattttatcttaactaaaccattgaaattagaaataaaaaagaaaaaatattaagagaatagtctatatagaacacaatacgagattaattaaaattcaaaataaaaaataaaataaattcaaaagatagaaaaagaaaaaaataagagctcaacttgaataaaatttataaataacttaaatttgtaagaaaaaaataaagacaattgaattaagaggcaatctagaacacatgatgagattaactaaagttcgaaataacaaataaaataattttcaaaaataggaaaaaaattataagaattgaagtttgaatataatttatgaataaaaattatcggaatgaaaaatatgcaatttttttttaaaaaaagtccatctagaaaacaacgatgacaaatagcattaaaaaggggagaagcaataggcatgtaaaggagtagagtgttggtggttgatgggatatcaacaaaaactataaacaaaaccccaaatagaatcacaatgatgattaagaggagtgacgataggtatgccgttaagcagcatggtcacgacggttggcgggacttatggataattaaaaaaaccacaatgataatcatattttatgtttaaaatgtcaatggcaataagaaggggaagcagcgggtttgctgtagaggagtatattggtgaagccactaacgattggcgagacttatagaaagtaaaaaggaacacaaataataattatatttgatttttaaaatcccgatgacaataaattgaggtggcaacagatggccgtagagtagtaaattggcgatgtttgacgatacttctaaaaattatgtaaacgaaacccaataagataaggtactctaaaaactataaggcctaacttttaaagttctcaagaggatgaatagaagtagtgatagatcaagtaagcaaataaaaatgtgacaaaggagtaaagggtagcgactggcgttgcttttaaaaactataaaattattagaatagcatgaataataattttaaataaaattatgtgtaaaaatagataattttaaattgatgatagccgtgtagttgtgcgggtcatccaactagttttaataattaagggagttttatatcagattttatggttaagggactcaaataaaactacatagttcatagcctaaagtggactttttaaaaaaatgaaaaagaaaagaaagaagttcatttgggccttctcggcatggccaggcgcttaattacagcccgcaacatgtcaggcactcaggccgggcctcgagcccttgatcatatccttttcttccttgtccaccatccccagttccccatcacaaatatcttcccataaagaaaccctaggtgctcattccaccgccatcgcctccggcgaactctccaccgccccctttcctacatcccaccactattttataagccagcccttcatctcatctggagatctggttctactcatccaggaaagccccaatctttatcatagcaaggaggtcatgtcggaatcggccctcggtaatagttacatcaaccaatttttgttatttcagtacttctttcccattcttcttcttcttcttcaactcggagtcttctacggtgtatatctcttccatctccaaaattatttgcgaatcgccctcagatctggagctgttcctcatgtcgaaatgtcaaatctataattctgatctcttctgaaacattcagagcctaattaccgatttgatttcttttcggcgtatctagtacagcaggaggtattgttttgttgaacagaaacatcaatcttattttttgatttgttcgatttccataagttttacacatcactcgttcaactagtatgtgaaaaacttctttttaccgttcatttcacatatactagataaatatctgtgatttgcgatggattaaaataaattaaacgcgtgctaatattgcttggaacaaattaattgcgaggttttggggacagtttcgtgcttgtagattatgtagaaggactattttgtaatattaaaacacgaaggagtagttggtaaaagaaataatctatacaacagagttggtgtggtggccgattcactgccaccaccactgccttctttaagaatgaagtataggtttctatactattacacacaatattattatatccagctgtgggggtggaaattcaatgaattcatcaatttcagtgatgcatgtgccgtttgattcaaaatatatgttgttgcagggtatggttcctaccagtcaaactattttaactttgaccatcagtatataaagtactgcacatattgacagtatattcatcacggaaaatactcataatatttaatcatctttacttgaaatatcatgtttccatagatattgctagcctaagtgccactttgtagatcgtgtccatgtcctaaatatcatttattttgtcttcacagtcttaaggatcattgtttaccaattgtatattatattatattactagcagtacaaagttatgatattcttttgaatgtaactagagattaatcctccttgttacagacaaacatatagtggtgaaaattcccgatcattttctgccagatgctttcataggagaaagtgttggtaaaggtaaagaagatggagcaaccgtagataacatggacccgtcccgcccttttctagttatcaagaagtctgatttggataaggctgatgaggtatggtagcccatctgcactcttcctctaggtttctgtcttccattggtacctggctgctgacattctctcttccagtgggttaaaataaaatatgcttggatggccaagtccttaacaaatgatataatcatcccagaccctacccctcaggttgctctctagtcttcatgtacagaattcagttgctagatcatcctgttacgtttgtccttttttaatcctgcagcattttagtttacgtaagttgtctcttccattttctcaaaaaaaaagggtgccctttgctgaaatgaaatgttttgtcatgaaggtgcacggcaatgagactttatgttttgctttattacattgaaagctgatttcttttcatctcttctgattgtgaacggaccaatttaggtggtgcgggatgccttctttgatatatctccccgcttggactccgtcttgagaaaggacagtgtccggtgcttcttccgtttgttcgcggaatgtactgcggccatggcatttaagtgtaacatcacctcagaaaccttatcctgcattgtcaggcataatgccttgcgatgtgcgaaaactgtattggagggcaaggcacctcagctcagttgtatgcatgccaatccaaactgcattaacccatatggaatttttccactccatgaagctgctgaacggttctctgttgacatgatcaagttgctgttctgccatggtgcttcagccaatttacacacagtcaatgatgctggcattcccggactactcccgctccatgttgcagttggaaatacttgcttgcataaatatctggaggacaatctatctcctgtgcagtatcatgaggattatatctacaagctcattcatctgctgtgtctacctgagatggtttgtttcacttaacgctctttccaaagtatcatcttttcagcatgacaacaaaatgtgttcctgtttgtcatcttttaaaaattttcacatgtgctgaggcattttcttatttcaaatttagaggcaagaagtcagcagttcaaaattccattactccctccttttctagtcattgtagttttgtcctaagtgagctatctgtatctgaccgtctatttctggtcatatagtttaacacattaagatttatgtttttatattcaccatgagaaatactttcataatatataatttgcatgttgttaaaacacacgaatttatagaaattgatggtcaaggatataaatatttgactttggataaagctagtaatttgtaacagaggaaatagctaaatgctccctccgtcctataatatagcaatctaggaccggatgtgcatgtccagattcgttgtactatgaaatgtctcgtccggtcctaggttgttatattatgggacggagggagtagtaggttttattccgcttgatcctagttcatccttgctacaattagtggaaacgagatgtaataggaagtaatttttcactgcttgcttgcatacaaatgctcaaagtcatttagatttcattcctttgccttctttttattgtgcagaaggtttttttggatacagttagactgcttgctgaaaaaacagataatctagctgatgagctctggaattacatgaagaatgacaagcttgtagaatccgcagttttactcctggcagcccgaaaacatatccgtgagggcaaacctgatgggttcgacattatcgcgcaacgtatatatgaggactatgattccctagtgtgtgataaaggtgatactgcagaggggcagaagctgctggaggaaagaagagcacttttgaaatgtaaatgtctgattgtcactataatttcgcaagctggtgaggttttggataactacattcaagcacattcagaggtactattgtttttttaatggtgtaaaatcacagcaccatatgatctcttactcactgtatattttttcatattggtattaatattttaataggtaattccatggctccatgccctgatcctaacaagaatgctagtgatttgttgatttccgtggccactttccgttacttgtactatagggtagcatatccagcataaagtgaacggtcagtccagttttatctatcttcaacattgtgttaaaaccatcacaagagtaagctgtctaatgaagcttatgagttatgacgtaagagcctccgctgctttgagaagctggagccctctattgttagggatgtgaccttagcatgttgcaggagcttctgtaccttgggttattttgagtagtcatggctatccttgaaacatattaaattagattactatcctctggttgatttgagataggtttgaattagggcatgtatacaacagcaactaatagcaggctcttagcattggtaacaaggtaaagtttgctgacatggatgagaggggaaaggagggtgaaacatcgttgttaagcttaacaacggcttaacatcgactcttagcgtttataaaaggaaactttgttgcatgaggatagataaaagaaaagaaaagaaagataacaaaaaaactgttttggtgcattaatgtcagaaccttttgtcgtcttatctattgtaagagatagtatctgaatagagcctgtagcagactctagctggtgattggtactattatttggggcatgccatttgtcaagtaatccctgtgaaatttcctccctcgcccaactctagtaccatatcccctacaatttgtcctgttatagcattactcaccagttcataacaactactagcttcttaggggagccaggttctgaaggctcacccttccaaaagaacaactttagggtattcctgtcagatgctgatatgcattctaatatctgagttgtggagatgatttaggaaacaaatctcaaatagtaataaaattttcatgcatttgtatcaaccttttgtgttagtgatttatagcgtggaaatattattgcatttcaattcaactttgtattggatattatgtgagttgttttttgcttttgcttcaagtaaccaaaactgatttaacattatttacagaaatgtatacgaaatctttgtataaaaatgtcaatttatatcaattttattagagatgcaacaagcctctttaatcgtagttgtaaccacagcgcaggcatatacagagtaactgtgtacactttttgatatattttagtgatgttggccattgcaacttttgcatgtttcatgaatacttgtgtgctattatctccttgtgaattttcttgatgcacagcacataacggcaaaaaacgaaatactttgcgtattaattattggttcatggcggcaagtggcaaccaataggttttgttattgtcttaagctgactacatttccctgaggatattttgatattgttgacacaaacaagttggaaaagttaaaaaaaatatattggtattagtggtgattttccctagtgcaggctcatattttgcatattttggtagtatatatgtcgcatgattaggtccacaacaatgaaactgacctgatgaagttcatgttagcgagaaccactatcatgttgtccaccatgaaatatgatttagtgtgttatttgtccagtttataaatttggggtaaaaaacaactagtttcttagttcagggcatatgcttcaagaaagcactatgagcctaggcccaaacacattacattaaaaaatattgaaaaaaattacactaaaacagcaacagaacaccacccaaggtagttcatctgcctaatgcaccatgtataatgcccagttcaaagttcagggtgaaaaatggactacaaggaaatttcaaatgccaaaaaatagacttttacctttttataatttatagtcaattacagttaccaagttgaaatttgaatgactaatgttcatgccttgtaccttttgaaccatctagtcgtattatttggttcctaatcctgaatatagttaaggcaaacgaagagaaatagttacgtaattttgaatatgtttgtatatgtactttattttaccaagtaaacttgtattcgatgtgattgcaaactgttctaccttctttcagttcatctgttataattaatttttctctaaaccattcttttttgtcatttctttgccaccaatgatatcattgtactacatgatcatattatcaatatatgcactttattttaccaagtaagcttgtattcgatgtgattgcaaactgttctaccttctttcagttcatctgttataattaaattttatctaaaccattcttttttgtcatttctttgccaccaatgatatcattgtactacatgaccatattatcaatatatgctatttttatgtttcattttctgacatttttcactatctgatataatggttctaatgtcattcaggtgcccaatgtggaggtccttgcgcgtgtttcatatattcttaaggaattcgggttttgccctaacgaagaatacattgacaccatgatcctgtactgctctttttgtattcaatataatattttttttctatgcaaatgtttgttgtttattaattatttcttaaacttgttattgaagctgtccatataacaagatttcttacagcgacatagttcacaaaggtgtgtgtttattatttaagtaactgtttctgaatttctcagaaagagcctttattaaattttttatggtcatatagatgtaaccaaggctgttgcacaaatgtctacttctctgcctgctgcagaaaaaaaggtaattgtattccgatgttaccaatgatgatttcttatattcaccttgttaattattgtgcaacaatgcgtggggagtatgatgtaccaaagcatgcagggagcagcagcagctaatgatcagttacttaggttccaagttaggtttgctattagttgccatcttactggctggtgcatataagccagagtgcctgccagatcattatcttgtagttgggattctagaaaagtagaaactctatgtctggtctcttctctatcctggtaaaaggttgctcggcagtttttacagcagtgcgtcattctagattatagtactgtcaacaatctgaaaataattgattttctccaatgagatagaatgttttgctttaagtattgtgtttagatttgatctgcctccctttctgtgtgtgtgtggtcttgcgatagatttttggtgtgcaatggtttgttttgatatttgatcatgacctagttaagatgttagaatgaacgaactcagtatgattagtcctattgtagttggatggtaataaatcaagctgatagatgtctgttatgcttctggttgttatgtttctgccgtgcagctgcttactggttcagctgcttttgcttaagcaattcagtttgttgacatcacttgaatataaccagaaaacaatttattctgttgctcaagtaaaacacctctcccaggatatatgaaaatattgtgaatcaagtgctctttggttgatcaagctggaatttaacaatttttttttgggtttcacaaagcttaatcttcatttaattatgggacaggctgcgagaaaaaaggcacttaaaggatgggatccaacattcataaagagaaattttttcccctactggagatcagtattaggggcccagctgtctgtatccaatggagcagcagatgagaagtcaatgcttcatcgtccacagttccgtaattcagtagtgagtaacgagtcttcgagtctgaaccataatattagtttcttgggaagaattcagcaactgagtggtactcatgaatcgagaaggtacagtactgctgcattcagaatgctcacgaaggtgctaaagacatgagcaaaaaggtatgtcgtgagttttgtttcagtctacagttactgaacatgtggaaatcattgctgtgacgcctatattattaattgagcaatatatcgtaatgtcaagttgttagggtacctcaatagaatttcacttgtttaaatttacagtaatattttcttgtttttcttcgtgcaggtgcctagtggcatgttgctgttgataaccataggtctgcaaagtattatgctgcgcacgtcttttgcggacaccttaagaaggttgcgaatatacatgtgaccaccaaaaccttgttcaaagtgatgctaagtactttaaattatgatgaaatgcaacatgccgtgtgttgtattcggcttgaaccctcgacccgcgagatgtggacatgcgtgccagcatgttgtacttgtaccaggttcaacgttagcttgaacactgaacaagttaaatgtgttgcaaaatgccatttttctttatcagcaatctcttctacctatatcagggtcatgattctagaatgttattgggccacgtggcagcctgaaaaattagctaaacatcaccaaaatttttgccacgtgtcaatcagatataagctcttgtgatgtcccttgcacatcagaatctctagaaaacccattactttacctatctctttgcactaatgcagttgataagtatcgaccaataaaataataaagagagttaataagtgcttcacttttgccaaccgatagccggaatcagcttttttgtgatgttttgatggatgcaaaagatatagttatatttaacatgtaaaatctataactaatataaatattcgtgtttttccggtcgtcacatctaattttcgtccatacacaatccgattcggttagca

SEQ ID NO: 13905 - DNA, 573 bp, Oryza sativa
atgaaccaacttgagtcctgcacgtttcggatattggcactctatggctcgatgatgaggggaagagacatttgataaaaacatatatttgttaacacttccatacatactagtaacggaacataggtaacggaatggctgggactgtgccctaatccaaaataagggacaggctttatcgaccactataggagaatctgaacttatgacgttattggtagcctttacaaagtaggatacaaacggagagtgtgcgtgcacacttatatatagtactgccgggcagcacttcgtgggactagactagtaactaccactgtcctgagtgctttattggggaatcaaaaagaacacagctatgtgttcacatagcttctttagcttaattaaacgtactacaagcggatgggatacacgggcgacttgatagggtaggagagcccaaagtttttcttggagggatccccgatcttctggctgtcgttgaacatggggaatatgtacgctctccggcggccccggcctagtgggcgagccacgcccgacgcggtagaacagcccctggttgtacgc

SEQ ID NO: 13906 - DNA, 506 bp, Oryza sativa
ttaacaagttcgtcaccgtcgcctccccatgattatatatatgttccaagaatatcgaattctcgcttcgaatcccctctttggcttccccatgttttgccgagttcaaatattcgatttgaattcaaatcccgcaccaattgcccccaaatcccttaaagcgatttcctggtaaaagtctactttacctccctcatattcgcttgggccgaatccggccatggcctggcctgcatctcctctcccacgtgcgtcgcgcgtgaccactttctctctctctctctcgccgcttcctgccgacgccacccaaaatccggccgcgtcgttcgattttcacgcgcgcgcgcgatgaccgaccgtccgcccggtcgccgctgccgtcagcactgggctgcctgctgttgttgacggtcgttatcgatcagtttcgaccgtcaatattaccaaaatagaggagaactagtgatgcttgcaatttatatatactacctccattattttaatag

SEQ ID NO: 13907 - DNA, 693 bp, Oryza sativa
tcatactccccacgcattgttgcacaataattaacaaggtgaatataagaaatcatcattggtaacatcggaatacaattacctttttttctgcagcaggcagagaagtagacatttgtgcaacagccttggttacatctatatgaccataaaaaatttaataaaggctctttctgagaaattcagaaacagttacttaaataataaacacacacctttgtgaactatgtcgctgtaagaaatcttgttatatggacagcttcaataacaagtttaagaaataattaataaacaacaaacatttgcatagaaaaaaaatattatattgaatacaaaaagagcagtacaggatcatggtgtcaatgtattcttcgttagggcaaaacccgaattccttaagaatatatgaaacacgcgcaaggacctccacattgggcacctgaatgacattagaaccattatatcagatagtgaaaaatgtcagaaaatgaaacataaaaatagcatatattgataatatggtcatgtagtacaatgatatcattggtggcaaagaaatgacaaaaaagaatggtttagataaaatttaattataacagatgaactgaaagaaggtagaacagtttgcaatcacatcgaatacaagcttacttggtaaaataaagtgcatatattgataatatgatcatgtag

SEQ ID NO: 13908 - DNA, 25585 bp, Oryza sativa
  unsure (1)..(25585): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattatcgtgttgcactactaaaaaaatacccattagtgccagttcttaatgcctaaaaggtgctggttttgcggccgacactttttggtcggcacctatgatcgaagtcattggcacctataatataatagctgccggatatacccctagaaccgagactcatatggtactataggtgccggtgtctgtaaataacgggcacgtattcggatgaacgaggcaaaaaaaaaattccccagccaagccgagcagagcaagcactgtagagcggataatatccatcaaaaattcattacatcacaatccctaaatccatgaaagatccaccatccaactatattttagaatcaaaattgacaaaaaggaaaattcacagaacataagtatttggtccagaaaaatcgaccaaaaaaattcaaaggaaaatgtagtctgcaattagactttgtatcttaagtcccaattttttccaggaacatccaccaacctgctcgatgtaggggatgacgatgtcgtcgatgagcttgaaaattgcaacaggcagtccacctcccatccgacgagatgcacccgcaccatcgtcttcctctcgctgtccacctgcacacacgcatcatcacatgcccaaatcagtaaccatcacagcaagaacacgcaacagattgacaaggcctccgagctcagcacctcggcggcggaggcgcccaaccctgcagctgcggcgccatcagagggaggagctcgccgcctgcttcacgccgccggccgctggtgccggatccacagcggaaaccaccgctgccgccggatcccacgccgtcaccgccgaatgcgccgccgcaacccgtcgcccccgcctcccgcctcctgactcccgcctcccctcccgccggatccggcggaggggagggcgccgccgccgcccgcagcttcccatctcaccgccgcttacgtcgcctctgccgggatgccgcccgaccgccgccgcgcaagagacgagaagcagagaggaggcgagagaagacgagagagagaggcgagactcgagagagagataaggccgatagagagagagccgagactcggcgataagtttgactcgacggtctggatcggctcggctcggtttggaaaggtgccggtttttttaaaaaaccgacacctataatttattattggtgtcggttctacagaagacccggcacctatatataggtgtcggttttttatttagaaaaccggcacctatattatattaaagttgtttttttaataaaccggtacttatgttataggtgtcggttttttattagaaccggcccctataattgtttaaaggtgtcggttttatgtgttttcagtccacggaggagagaaaaatattataggtgccggttttaactgttccggcacctatagtgccgatctctatgagcttttttttagtagtgttggcagtcgcaacgttaggctgccatggcaatatgcacggccaagatcgcattggcacgggacaaacgaaatcggacgcttcaaaacgccgactgtgatggaggagaaaatgtgtttgcgattccaaagagggaatattgcttcggtcaattttcactatgaaatccaactctaatccctacttaaagcggactatataaggtgaaattattattatctacacctacatatatgcatgcatgcgatttaaatagtgatataaaatttaacaagatgaattatgatgatgaacaccagacaaacctaagtctaaattcgatcctacaccttgccgttatataaggcgatcgatcccctgcatcccataaaaacctactggggcttttgcctcagccctactcaacataatcgtgtagatgtaacacacttttgcgaaaacgctttgtgttgggcgtccgatctggagagaaaaatcagatgcccacacacccacaccactcttctctcaaccttatctcttccccaaccccccctccctctctctctcacatgtcactctccccctgtacttgagcgaggcggagacgaggtggagcgcggcggacgggtcgccggagtcgagggaggcagccgcggcgtggaggcggtggaggggagagcggcgcagggccgcgcgtagggagcccggcaccgggtacgccgcgatggctgcgcggaggggcgaggctgagttcaccgacgcgcggggtcctcccagcggcgtggcggagaggaggatgagcagagtgagcaccgccgccacggaggctacggggaggaggcggcgccggcggagttcctagtcgtcgtggtggccgtggccgagggagcgtagctgttgatgcgaaaaacacacactggcttgggagatctgcttaactccagtgcatatccaaagattgatgagatgtgggcgtgccagtcagtttgatcctgcaactgacaagatatgtaaactgtagatcaaatagccgatcggctaaacagccgatagagcaatcccagccgatagcgatagggttttgagctatcggctatatgtccaatgtaaataatgatataaagtcaatcggctgataataatataatataacaatatcataatccaatagaaatcaatcggctagcaatgatatgatagaataagcacttatccgaaggttaaagcatacatcggctagaggtccgatgccataaaatccacagattagattaaacagtgaaacctttgttgtcatcggctaaatccaacttatatatatatatacgtaatccttataagccgatgcaacgtccagatatcttatcggctagcaccccgataaaacattagcatgaacctatcggcttaacaagacttatattatcaacaacaatctagtaggtcgaacctaaccgatacagcacgagattgtatatgataatctaatacccttaatgtgatggatataacaaatctatctagaacgacattgtgattgtagagatatatcggctatgatagaagatcagacttaaccgagacagttccagctaaaccgatgcatctctaaacacaatgtaattaaagatagaatcgagatatcaggtaggcaaatcaatcaaccaaaccagagcgatccaagagattgaagcgatgcagccttaaacgacgccaacgtagatgacagattcaccagagcccggcggaacgtaggacttaccctttcgccggagatcgaaagccgatgcagccccgcgtcaggtgcccaaatcccaccggttgataagtaaaaaccttaggaaagagggtggcgatgcaccgagagtagttgtattgatcgagattgatagattacagggacccctggtacacaatttatacccttgggcctatagagtccttgtcggacaagaaacaaactttctaaaagataaaacagaaacataaagtccttatcagacacactttcctaaagataaaaggaaactaataaactattcctaattaatagatacaattgccttcttcggactcaatccgcacgtggcaatcctcatgaagcactttaaacgaacccaacaatggttccaacatccccttgtcggaatcggctacatcggcttccttgtccaattcgatattagccgatgcacaccgtagccgatgcagttccgaagccgatttatactctgtttttgttgccgatttccttccaaatccgcttcggtcttaactccaaatccaatgtatgatttaccaaatttggtcgttaacagcagcattccggcaccgttgaagatttggccaccggggtggaggaagaagccaaatctagaccggtaaatttatttgatttttcaatgttccagtctattttgtctcgatgtttctctgtgttaaatcgaaatgtttcactgcatttttcaatggtgtttcacatttcaacaacagtataaacttgatgtttcatgtgtaagatacaaatgtttcaatcttgccggtgaggggtagaagatgaaggtgggttcatttttatttgagttctagagatgttgcaacctattgttctatctcgttgcactttattgtgctaaagtgtttcattttgtttttgtttcagtattgcactttactgattcttcgtgttgcaaccagtctatttcagatattgcatttgattgaaacaattttgttcaagcaatgaaacatttttcctcgatcgatgaaacattttcgttgaaacatttttttcgtgagtggtgcaacatgtgaaacactttgtgataatatagtgcaacaccgtccgatctattgcaaaagatcggacgtccgatttgtagcaacctccacacttttgtttcccctacgccgcaccacgccaccccgcacggctgctggctcgatacacctgcccgcccaacatgtgcaggattaatatcatgtttttcaaccttgctaataagttgcgatggtttagtaactcaaaatatgatcaaaattttgtatgctattctcaacaaatacaccaagaataaagcttacaatcagcgtgagttgtaacatctcttattgcataaagaatggtattacaaagttacccatcttctcttttctctcaagctcttccttttcagcaatctgtttcagcgtagtccacccctttcttgcccgcttccttgaactaccagacatctgagcagaaccacttgctacagatttatttttcacacggtcctttggagctgacttggtaggcattgtaggggccttgccagtaactgaacttggcatctcccctttcttgttctgaatgcttcttgtcttgaccagttctgcagaatccttatggtccgtcacatccaccagtttgttctttcgaggagtaacaaaacttgatccgactggaaattctgcttttgaaggaaaatcgggttggcatattgcaattttgttagcagaaacaggctcagtttcatgcatacctttttcacttgtgattgttaccactattttctgtgagacattctcctgatcagtagctgatgctgactgattcagttccaccgatgaacacgctacctccttttccatagattcgtcaagaagattgggtactggactttcctcatactcattcttttcaagattttgttgtttcaacccagatgttgactctagttgtgagaccgctgcctgagaatattcaaagccctcttttatagttactaatctcttgttattactgtcccctttcaactttatgctggttacatccatgccaactggctttcttgatgataacaagcccttcataatattctttccgctgccccttattaggttttggtctccacagaaatggcacaggtaagaaatgctgttctggcaagtgtttaacttcttgcgtcgctttgcttttcttttgttgttctttatgcggattgtgcagttgaagcctggctgtaagactgtttcacacctgcaaaagtttggagaatgtttcttcagaagtcctatagagatattgctctcttctacagtagtaatgcttatgatccagacaaatggatacgcgcagtagaaaaaaaaaacataactaggaaactgaactacaaagtactcattataagatgttttgggttttgaatagattcatgcatggatccatgtatgtgattcatatgtgtccaaattgataaggatgttagtgaatctagatgaagaatggagaggccaaaacatcttatagtgtggaactgagggggtacatagtatgtcaaaatgttttgtagtcgctttaacatggctactttagtgctcacatcatactatagatgtattaatcataattatgggttgacttccaagatttagaacaaacacatggcaattactatgctgttatttgttcaagctttgcttcagccatacaacattatcaggatgactactcatttcaatttcttataggcaaaatttgctacaagacacttaaagtctgtggcctttactgtgagacactcaaagaatatgtatcttctcgtggacactgcaaaaatgtggtaattagctgttggacacccgagacattattttattattttcggtggagacggagagagaaacattggttaaagacaagtttgcctatgggcccacttgtcaatctcacatatcctctctttctcctttcctcttcttcctcatgctgctctgttgctgccactcatgcccctcgaactcgcatcatcatcgctgctctgcagaacaccatcttgtcgtcgttgcatggcatcccgacgccgctggcgatgcgtgacttcgggtgacgtcactgacatgtacctgtgggcgaacccatcgagagggcgggagttggaatttggaacgcgttatccatctgttgaggtggaggcggacatcgccgtgacgagttgccgggcgccgcgacgggtggtcgacttcccgctggtttggtgccgacttggcgcgtagcggcgtcgcggcacggccacaacgaggcactctactctatggcgatcatccagttcaacagcattggcctccccaaggacagccgcaacctccaggccggcccaactctgcacacgcgctgcatcgtgcgggcagaacgacgtgctccgcgagctcggccactacgtctcggacggctacggcgtccgccactccctctcgggcgtacgacgcctcctcatctaggccaacctccgcgagctgtgcgccgcggtcgccacgggcgggacggggttcgtcgtggcgctcggccacaacggcgagtgcaagccaccgggcccgcacatgtgcctcctgagcgactacgggtgccatatcgccggcgtggcgaggcggctcgcgcacgcggcgaacacattcctggccgaattgttcgcgttgcggccgctagggttcggcgctagcgccggggcgctccgatgaagcaggaagaagaacagtactccgggggcatttcggtattttcaactctctttctctctgttttcaccggaaataataaaataatgtatcgggtgtccaacagctaattagcacatttttatagtgtccatgagaagatacacgttctttgagtgtctcacagcaaagaccacaaacaaactttgagtgtcctatagcaaaatttgcccttcttatatggtagcatcagtatacttaggggacaagatggaagaatagccacacacacatgcaagattgcaagaaatacttccttttagagtaaagagataattgtacatgcaactgtcagtgacacagtgttttgaatatgtgaccaatgaagtgctcattctcccaccaattctctgtacggatcaattttggactacaagattttctaaaaaagaaaaacacaatcatttgtttggacttagtgaacaaggttacagggtatgatgctctcatgaactagcagtttttaagccgtgtgaaacagtattgcaacaacagtggttgctgacagataacagaataaatataactgaaaaaaaaacaaaactacctagtgacttaatcagttcaagtcaatatgaactgttgttttgtgaatagaaggagatttacacaaatttggttagaacttgagtaatcaatcacaaagagagtttgagaatgatatgcacaatggatccaactaaataaatcatatgaataggttttgattttacaatatatctgtaaaataggtttcgattatttgctataaagaacttcaagacttggttatctgtatcccataaaactgatttatgaaatgtaccgatcgagtacattaaagctacagatcactctgtcattctcactgatagacaaatgattttaccaataaaaaaagcaagtgcaaaattatatgaatagctgaattaacacgacaacatagcatcaaaaggctgcttgatacttctatggtgcataggaaattaggaatataggataggacgatctgtttaacttttgggttctatagtatctagccggacaagtccttaaactggctaaaatgctgcttagcacaaaactactgcaatttcttagaggtatgaggaggattatgatactaataatatctgcaatggttggggggcagattggctccttcaatatcatgcaacaatttgaaagacgatgaaccacaaatgaggatctttcagtagaagaattgagcactttgccccacaacagacaggcaaattctgaaggacgcgagcatccgaccgaggtgtagtaagaagtaagcagtgaccctgacctctggcataggaaggtggaggcggccagaggtatcccggccgcctcggcgttggcggcgaggcgtcgccccagcagggcgccgagggggcccgccccggcctccccgcctgcccacgccgccagccgctgcaggtgctggaccctcagcagggaggccgcgtcagcgcgcgtcttcccggagctctcctcgcggagcgacaccgcctggttcccggccctgggcggcgccgccggggcatggccatggccgccgcgcttcttccccatgtagccgccaagccacaaccgcgaggaaggcaacggggcggggggcggggggcggagggcggcgggcggcggcgcgggagggagtaagcggaggcgaggaggcggcgacggcgagagtgtctgggtcgttgtgggccggttgggccacgccgccgcttaatttggactagcttcttttcgcctttcaggtttccagttcgagacttcgagggcatgttgatacataaaagaataagttcaccggaggtacctcaacttaattttttttaggtccttaaacacaaaaccagaaatcttcacccctaaactatacaaaaccatacactaaaggtcctatggcagtatatacagcgagatttttttaggtcccttaaatacaaaaccagaaatcttcaccctaaactatacaaaaccgtgcactaaaggtcctatggcagtatatatgggtggttctatggttcataaaagggtccataaaaggacatgggcagccaacagagcaaaagttggctctgtttcgtttgaatttatacttaaattcacgaattggtccataaaaggggagaaatcagaatcgcctgtcacctttgcagacgaggggacgccattgaagttagttgtcctctgttgtggctgggttttcttgttcagcatctactatgacatccgtgccctgttctggggtagatgagccagtaacttgggtggctggatcgacattttcattgactgcctctgctacttcacaattctccaacagcgcctgagctgacgtgctggatgagagcacattgttggaatcattgtgatccacatacataggttccaccattagttcaatctggcccatttagttaggattttccagatgtccatcttgatcaacactagtgctttgctgtgggattgcagagcctggagcaggagtggctgtatcacactcatcgatggctggtgtagctgagtgactgtgttcctccaactccagtgaaggacatgggcagatgacattgttgaaaccattatcctcctcatccataggctcgagggtcattgttgcatcatccaccatgtgaagctcttcctcttcctgatgctgagcttcttgatcggcatcaacaatgttctgttcagcttctagcaaaagtagaggcatgtcttgagcggcagctgattcaacatgtggactagtagcggaaccaccattttccttgatctcgccaaggtcatggagaacatcctgaaagccatgcagaaactcaaagaccaaggcttgtgtggttgtatcagctgtggatgtcatggccatcttggccttctttaccataccatgcagtttatcaacctacaacaatcagcagacccttcgagttaaatatattagttaaattatgcatggagtgattgtaaaactatttgaagtcttgcaaagacaacatatatctgacacaaatttaggtccaatcaactatagaaactgatcataggaactgaatagataatataggcttactgctttgcggatcataggagccttggcttgatactgaagatcaatggaatcatcaggctgtaatgaaggtcctgcttccacatcatcactgattgatggtacaagataccgccgtgtaactcctgagtaccaatgcaggtactcctcataagacgatgggtcatactgctctgactctggaaatatgcgctgccggcgggcttcccattcctgaatgtactcatgatgtgtctcttcccagttctcatgttctctgccacgtcgactaatacgatgcagcgcctgtagggtaggtcgaaaaggtggtggaatggattggcgaagcccaaattgccgcatcactcgctcaggcaaatacatctcgactatcggaaaatttattagtggagcttgtgtaagccacaaatctgcatcttttgtacaaagcaatggcaagcttgaagactcaatgtgcaagtagggttcccacttcacctgatcagctcgctgcaggttcagttcatccctgtactgcttaagacagcgtgtagcattctcactttgtgtgcgcgcacctacccaacgaaagccaacaggtggcacatcctgtggaatgtctgtctctgggcacaggggagaccggaccaatggtctgccaacatgggagcgctcccagctccaaagctgcaagagaagcaatgaaccaccaatattcttgatattgtgggaggaagcaacagaacaaagagaacggtataggaaggccagcactgcagatccccagctgtatgtcccaacacgagaaagatcagcaatcaatggaagatatatcagactcatccgtcctgttccatctggaaatagcaccccacataaaaggctcaggatatatgctcgaacatgcctctccacagtctgatcatctgctccttctggtaattcatagaaatgcttcttcagccatttgtagtgcagaaaagattttccaggcattgatggtcctcttggatcatgacctagacaatcaatgaccatctgcgcataatcatgatcagtggtagaacaaactggacggccatcgataggaagagctaacaacattgctacatcttgtagtgtaactgccatctccccagaagccaagtggaaactatgagtttctggtctccaacgctcaacaagggcagtgatcaatgccttgtccaattgaggcatcttctggcaaatttgtgagagcccaagaaggccagcatccctcaaataaggacggtatctctcatgaaattttaaaggtttgtgatgtcgcaacttcaactgctccacagcctgcaaaaaacatgacctcagtggcactgcgaagtttattctgcctacaataacttgtttacttatgcaactatgacaaaacttaattgctcttggattaacctgatcaccgaagattgcatccgatcggtggttgatcttagggttgagtaatgtgttggatacatgctctgctgctgggcttacaagacaaggttgctgcgaagtgaactcgatattgtcctctttatcagaagtagtgctcggggaagaaagtgcagaggtttcatgaaagtccatatcattttctgccaaagcacttctcccacggccacggccacgaccacggcggccaccacctcctctccttgaagacatggtcttgtactgttcctgttttgaaaaattcataagaccagtcagaggaaacagcacagacgttgacagtaaaaaaaacataaacatgtgttgagaagttagacaaggcttaagccctgaagtatgcaatgtgtgtgatcattttagtagcaggtccgaagttttaagaaatgcagaggggtctctccactaacctgatcgccaaaaaaaggagaaaaggggaaaaaaaaagaaaacatggctattcctctttatgactcgcttggaaaagagaaaattcacatgaatttgacaacaatcatttcaattcgagcgttccagacgagcctacatcgagtgaacttgctatattgatctaaacatctaatgatccacatacgcatgtcacaaaccaaaacacacagtggcttccatttttaacctacgattttccagtgacaaccaatgaacagagatttgagagtgagaatctatggaaagatgacattagagaacggtacctgcacccgcgcccttgaggactaggcgcctggctctagcaaaatttgggttcgccaacggcgcgcccacggctacatcccccctgcccccctcccaccagtctggctcgccggcttgctacgcccgcggctcacccctccgccccgcgaccacggaaatccggcgggccggcggcggccgacggggagacaagctgtagatcttcgctttctgggaggggaagagtgagccctagaatctgctttcccggggaggaggcggcgaggcgtaagccgtaaccctagtcgtaacccatctgggattcactttgtgcttttgatacatcgatagcagcttcctcctgccagcacaacgacggcccatatagccataaccccagagacccatacaatgcgccgtacttgtagtcaaaacatttcttttgtattcattgaagttgagttgtggattcttagtgaaatatgtgaatattacagccgcactcaaaattccttttttggcttctagctcatactccctccgtcccataaaaaccaacctagtactggatgtgatatatcttaataaaatgaatctggacatacatctgtccagattcgttgtacttagaatatatcacgtcaagtcctagatttactttttttgggacggagggagtacgtatcttacggtgcctaggattacaaatggccagaaaagcgatgtgtagagcttcgttgtgttttttatggagattggacaaactcacataactgaagttgtgagggtgtgaggccaaacttcgatcgaggtaatattgatgcagtcgacaagaggcttcgatgcgattatgatcaaacttctgctcggagagttttggagcttgcaatgaggtgcactagccggtcctctatcaaaagaccaacaatagcagaagttgtatctgtttgagtgaaatattagccacggtgaaagagacatatacaagtagcagctatcagtacaatagtggcacgagggagacggaaaaaatggcccatagttattcatgaatgttcctgtataatcatgtgatgaataatcttgatgatgaacgattgtcaaaggtaaatgtttattgaaaacacggtgaacactatttaatgttggtgaacagtttgttggcaatgaccgtatgtattcatgcggtctaaccagggtagcccgatggtcagactagcagactctgagaaggagtcgatttcgggttgttttcgtggaatttttaaattgttttatgtttatggctctagatggtttctatttatatgtgatattatttgtgctgatatgagttaagttggtacgaacttgtacttgagttaagttggtacgaacttgtactcagatatggagtttctttgttattcatgtgcaggtgttgcttgaggacataggagtatagccagtgatggatcgggactaggcttaagaggagttaaggtcaagacggtcaaggatatcatacgggatacttaggctaaagaacaatgcacgtggagatgaaggtttccatatggcatacacgtggtgttgtgtccatatgaacagatgagataaatttggattgaagtctaagtttagaaagattggagtgtagagttgacaatgccatgaaaaagagaggacagcctactactattagtatttgggtcaagctgaaatgctagtgagtcatgcatgattaccaagctaaataaatactctcacatcacaacgaaatgttcagaaaaggaaggcacaacagttcaccatatatcacaagagaaacatgctaattacacaggagaaacatcactggatagaaggggcagagagatgtaccgttcttggtcagtttgtcctagattttggccttcacaaccttgccatcaagccagagggagtggtcctgccataccttcttgatgtcgtatgtttctcctatttccaagtacttagcttaaatgtgaaaaacctgcaattaatatataggagcaacctgaaatcagaatgcaaataactagcagtggtagtagtagtagcggcactccatcaatctcttttgtgagtgaacatggtaaattagaggtgattattaacaattggaaggtgacaggaattttgtttggaactgtactaagctatgagctttacatgtgagaactgtctgaaattacagcaactttcagtgagctatttgcttatgcaagcacaggttttcaggaagatcacaatttttttttattgttctacagaaactggacagctagcacttttgagtatcacatcaaggtattcttgtaagaaaaggatgacctcaatcttcaagtctttgatacagtgttaccattatgtatttccagtactaatacagcataagatcttgtcatgagctgtataccatctaagctatcaattttcaacagcctgtccattgttcagagaggacaaaaattttacaatagtagttcaaaattccaataaatgaatcctaaatagatgcagttaaatctgcacctctgctctgcaccttgttcattgaagcaaccaagcaagacaggggaaaacagagagagctctagacagatcaaagtatacaagtaaactggattttttttaaaaaactttctctacctctacctgatctacacgatatatatttctggtgtgtatgcatgatcaactttgcccaatcaaatgaagatatctaactctagtggacaattcaattgttattatgtgaggtagaggcaaagaaggcgccattttctctaattttcttgcaaataatacagaaaccagtccaaaaaatgattaaattgctggatgaagaactgcttttctggagaacagaaaaaaaaacaatgacgaacatgctatagaaaaactggcaagagaagctgtcctctgaaaccttgggtcatcatcaatgaggtcaattctaatgatagcacttaaattttagctgtccaacacactacaagaacaggagatactcgattgtcatataggggctttcccattgtcatactgcaagtctggtgaatgtttatttcaagcattgcacacacttgtctttctcgaatctctactgaaaatattacattctccttatgaatcttgctactcaaaagggctcgaattgatctgaaaaaacacaggttctttatggatggttgtatggcgtcatgcatgttaatattcagaatatgacaggctgaaactaactcggaagaaccccaagaatccccatcggcgacgacttgcagtgagtgcagatccaagaaagaaacacaagaaccccaagaatcacggacctggtggatgggcgggtacatggagttggtgcagacggggcactcgagcagctcgtggacactcgtcgccggcgggacgacaaggcccccaaccaccacccggacccctcctcctcctcctcctcctcctcctcctcctccccccgtgccccctgcccccctccgccgtcgacctagaggggcggacttggacgccgacgtgggaggcggcggtgtgggacgtcgacgggggaagagggataacgcaggggcgctggagaggccggcgacagagctcctaggcagcggccatggcgccgacgtgggtggtggcggcggcagcggctggagtctccgcctctcgcctctcctggggatttgccgatttgggggaatggccgaatggggctccactgggctcacccattttggatccaataatttttaaccaaaaccaaatcggtccaaaccaaaacttttaggtaccaaaccactccagcccatttgtggtggcagcccatttccccccatccggagttgctccaattaaggaaccgaatcgtttggcccatttggccccaaaccattagcaggcttacaggtacgttcttaatttggagctgagatttgtctctcgtgatagtattagcgagggggatctgatttaatttacggtgtagtacaatcggcgggttttgattgacctgacaaacctgtcaccaccctaagtttaaagaattggaagtttctaaatggaacacaaatttgtcctgacgtacccgctcagtaactgagcaaaaccatcgccagccagaattggtttgccacaagaatagcagaatgcagctaaaaacagggtaaaaaaatactacagaagagtgttttcttaggaacgaaggaaacagggcttaggaaataatcaaatgatgacaagacagtcatcagcacccagctggtttgaattggaagtcaaacggggaatgggtaatgcgttcaaaccgtaccaaactctgtcttcaaaacttcaaccacgtcgttgatggtgaaatggtgaattgaatcaacaccagattccagattacacgggcaacagtttcattacatgaaagaagagaatgaatcaccacgttgaactgacagatattaaccatttttgaacttgcctctccctcatccggggctgttcatgtaacaaatgttaattacagattatgcacagccaagctcacatgtacaacaggggacaacgccgcatcaaaagccaagtcaaaacacaattacagagctcaattgcaaagctatggcaacaagctacaaaaactgtatggcgctggcgcgttttttgccaaaaagaatgatgtctagttatctactctcactgtgttgtactagtatgaatgaacctccccgcttgtttcagatcaccaccaagtcatgcaaagacaggttcagttcttgggcaagttgtgctgattgaccaccccgcctgcaccaacaaaatatgaaaccatcacagaatgtcaggaaagctagctccaacaaatgacgtgggtagcaaaaaaaaaatggtgcacacgaacaactgtcagcaagcttaagaaaacaacagtctgataaaggccgagtttagttccaaattatttcttcaaacttccaacttttccatcatatcgttccaatttcaaccaaacttctaattttggcgtgaactaaacacacccaaagtaaaggataaagcatctcatacagggaggggaggggaaggaaaggaattacataattaaggggtgtagaacttgctgaatcttttgcaaatggttaaaacaccgactgcaacgttgcaacctgtgtacaatacacaccagcgaagtcagcaacagtccagttcatcttgacatagacagagcaataggttataggatgctacaaacgctgcagttttttaaaacaatggttcctaactgaagtgcagggacaggacccacttgtcacctcacatccagtgtctctttgcaatttgcaggttttgcggcgtcctttaaatagcattcccttgaataaggttaatgcacgtacctctgctcagcctgaatatcaactccaactgctgaatgagctgacaatgttgaacgaataactggtccaaagatctttataagatccaacaacaattccaaagaaacaatggcatgcctacaaattgaaattaaaggcaaagtaaccataagacaaagttactactaaaccaaacattttctaatgtaggatgccaatatctccatggttttgtaaagaaaatagatccatgactttgcttgcaatagaatgaacatactaacaagaggatagacaattcaattcaacagcagcatcttgtgtctacatgtgtgcacagagcatgtgcgcttaagttactatgtatcacttggtccagtcagacaagaaccaacatgccaatatatcacctttcagccttgctggtcagtaaccccgcaagaacaggcagaaagcttaagaaaatgtctagactgaagagatcaagtttcctcttcagagtactaacaacatcagcttgaacctgtaaaaaaagagtcaaaccattagcagctaaagaatacgaagtacatgtacatccaagaataacgcacggcatcttgagaaatacttactgcattgtcgggcaactttgccactgcagcaattgctcctttgataccattttggtcaaagacatgccgcatcatctgaagacagttaacattaatatcatatgctgatggagtgatggctatgatatatgcaacttttactagttttcaaatgctttcctcactgactattccccactctccacttgtaggataattagtagatggtgggaaaagtgcatgtcaatgcataatttgcatacaggtgtagatcactctcatcttatatcaggctatcagaaataatggagctgattaattttagggtgttgctggattgatcaacaatcttcactagagctgacttcaccttcaatttagaggtgtgtacacaccaattgtctttaagaaaatgccaataaatcatttaacgcaagtatcaaagaaaaaggtaatgttcaattctaagttgtctaattgtactcaatagactaacaacaataggccattttccctgtactgaatagcctaaagaacacagaagagcttcttttttgggaatacgcaaggagcgcatctttgtattaagaaggaataaatgtatgcataaagcgggccaaaaagacaaagcgaaggggacagggcacaggagaagaaccaagaaacaaaagcctaatctccaactaaattttgcgacccttctctactaacatgagctaccaaagcagggattgcagctctagctagccgccacagctccgcttcacccgtcataacccttacaacctccgcccaagatctgctcttctggttgaagactcgattgtttctttccttccagatcgtccatgcaaccaacgtcgcgatggtgtcgaaaccccggcgatgttccttgaccatcctcttgcgacagtcgcacaaccatgagaggaacgagtgttcattgatcggtaagcactccgaatgcccgatagctctgagcgcaacccaccacagttgccgcgactccgggcatgcgaccaagagatgatcaatcgtctcttcgcattgatcacacagaacacatcgatccgggtgcgacaaaccacgactccggaggcggtatgttgtccaacaacggttaagagctaccaaccaaaggaagtagcgacagcgagggggcgccaaagattgccaaattggcttgtgctggagacgagttcttccaaaaaagagaacacaataagccgagcgggaagagtattctcccgaggtctcccaccgccaagatagagagtccggctcttcggaaagctgcactgaccgaaggcaatcccaaagcttgaaatactctaggatcgcttgaatacccaacgccgaactggatgtcctggatccatcttctatcagtcattgcctcggccaccgtgcgatgattccggagacgagcagggactgcagcatagacagccggtgctagcgacagaagagcttcttcatatgtataatctatcatgcaaaggtatgcaagattggttccctgtttattggatacaaaaggtcaaggaaggaattctatggtgcacatgagctggtaacaaacaggagtctgcaagtaaaagatcagagacaagacacacctctaactttgtcagccgagattttacggcatttataaattcatcatggctctgcatcaaatcgattggaatcattgcttcatcaattgttgacaagtccttctcatatgcctgacttggttctgcctgtccattacaaccattgcaaaatataatgatttgagtaatggaaaaattcgtaaatgctagagagcatgaacaaataaaaatggagcaaaggtaaagtcatatttttctatcccatattctgattttatttctgaaaatactccaatctcccagaagtacttaagtccacaaaacattacattatgatttatgacaatctggtttctaacaatactttatcccttctatttctatctccaaatagcatgtacttcgcagtaaggggaaaaacgaatacagaaatttacattgtataatatgcaagaataagtatgtatgacatgtggttttattccttgacagaatctgctcgttggtggatgagaggacgacggcggtggctaccctagagcagcgatggaagcaccaacccttcacaagagctcggacgtcgtgctatagggtcgaccaacgggcgcggagtccgtttctgcctctctagtcctcacgccgtcaacaacctaggccgacaagagcacgatttttcctgcctcctcaccgtcgccgccagccatctcgtcgtgtgtccccaagtcctactgctgcgcctactcaatgtcctctgctgcgatggtggcgtcgcacctgtcatcatcgttgtcgtgctcaggcatcctacgccttctccaccgcaaaggccaccgtgccgcttgcccacttggttgacctgctctagctcctgttccacacgtccgtcttcactattatcctctcctactgccttgtccttctgcccctatcatgtgcaccctctgtgctaccaaccggcccgccttctcccactgcccctttctgccattgctgccatcgggaaggatactcccctcccaataccatcagtaacttaggacgaggctgctaacttggatagagagggttgcttgttcgtcggcgctagaggggagaaggtggcaacgagcaacaatgaactgaggagctgggcagtgtatcggtaggggtaagaggagggagaagaaagagagatgccactgacatgtgggcaccacatactaactcaggcagtttgatcaggtcaaagagccctgccagcgaaaattgcccccaaatcgaccgagggaagcaaactacaccggttttaatatttaagggtcaagatatatgatataacgttgagggaaacgacttagattggagctatatttgagggagtcaaagtgcacttatttctaacgggaagatgagtacagtgtgttaaaactgaggccgatggttatggcccggatctagtatgggccagaacgggccgttcagcgtagggggtttaacgggaaaaagtatactttaactccctcaactatcgcccgagtatgattcatgtcctccaaccacaaaactgggtatatcaaccactccaactatcaaaaccggtgcaaacaatgtccctcagtggttttggctgacgtggcgcttacgtgtcattcttgaccgaacctttgtcctacgtgctgcttacgtggcattagaataaaaacagaaataaaagaaatatgtgggacccatatatcattcacacaaaaaaagtattgtgggatccaatgacatgtgggacccacatgtcatcctcccactcccttcttcctccccctctatctcccttcttcaattgcatacaccccttgcacctctcccacactcacttgagctttgtgttcatccgcttagtgtgtttgagggttgttctagccaagagtcaagtacattgcttccactgtagagctagtgtggcacttgatcatctccgagccgggtcatcgcttattactcttggaggttgccgtctactagacggcttgtggaggtgttgcccggtgacctctccgaggagattgtggaggaggcccagcgccggtttgtgagtggtttggagttcaccactttcggagtgaaggaagaactacccctagtgatcgaggcttagatagtcctctccttgggccagctcccaccttgcccaccccttgacgaaggaggcgtgcggtggcttcgtggttgagcggtggagttgggctcgcctcaacggggattaggaaaccggcgagtttccgaacctcggtgaaaaactccttgtctcttgtctcatttatttgttgcatttacatttgtgtaatttacattcatagagacatatttgagcacatatcaccctaggattgcaaaacttaacttaggtgtattttactttcctagagatatacttgagccactatcactctaggattgcaaaacataacttagttgctttgttagacttatccctcaccaagcctagcaacttatgttagttttgattaggtgtcatttagttttaaatcgtctattcaccctcctctagtcaacatctcgatcctacacgtgcgctgagggaggagctcccggccgtccccgcgcgggtgaggagctcgctgtcgtctgcgcgcgggggaggagctcgacgccgtccgcgcgcgtaggaggagctcaacaccatcttgccggtgcccatcggcatctcgagcagcgcgtggccgcgcgtgtcgagggcgcgctttagctcacccatgtatcgcggccgccgctgctcccgctccctaccgccgtccccaccgccactgccaccgctaccgcccccgcccgctgccgccgccgctccccaccgccatccccaccaaagagaaatgccgagggaaagagagagataagggagagagagaaagggaggaggaagaagggaaggagagggaggatgacatgtgggtcccacatgtcagtgggtctcacgatactttatttgtgtgagtgacatatgggtcccacatatttctttttattttttgtttttattctaatgtcacataagcgccacgtaggaaaaaggctcggtcaaaaccgccacataggcggcatgtcatccaaaaccacatcagttttaatagtggttggaggacatgaatcatactcggggatagttgagggagttaagtatactttttccgggtttaacatgatgtttcgccttctcggtccagcggcccagtttagaagaacgcgctccgacgggaaaacgagataccccactggggccgtttcgtcttgttctcgctccctcctcgcgccgctagtccggcaaatcgaccgatgtttgcaggcctgcagccgcctagcgttgccggaagagggcatcgcgatgagccatcctccccacctgacccagccccctctcctcgctaccttccctccctccgctggaagcgcgagatatcaaagtcggatttatcctttggccactagctaggtcctagtcctacgatttgggatctgatgcacgccaagcgttcggagctcagccaacaccgtccaaagctctcacgaggaggccccgggagcggcggattgatgaactctccacttctccaggctccaggtacaaaccaacacttttgtggctttctgcttgtacgcattgcctgatgaattctgtcaacacattccacgcgtacatgtctgaaacggcattcatcagactagaagacaatggagatcggatcaactcctgaaatttctaatatattgaagggatgatatttgaacattacaagctcttggcacactaaccaccaccaccacacacttcccacaatggcatgttactttctgaatcacaaaagaaagcaacagaaacagccatacatagcttcaggtagccttagcctaagctcacaatctcacattactcaacctcatagaaacttcaagcttactaccaaaactagtggcctcctcatacttacagaagaggtttatatatctttcgaccacaatcactaagagattcagaacaacatcagactgacaatgctaacaatgccaagcagcagcccaatacttgccttcaacccagcagctccattcaagccccagacgcgcacatcatcgatcactggcccacagagcgagctgtggtcgtcgcttctcgtgttgtaatacacgctgtagaacgccactcgcgtcctctcagctcgtgctgtgaatgtcacattcgcagcctggcttgtggcattacccatgggcgagtagtggaagttctgggcctggtcacctgcgaatgccatgacagccattggtggctggcatgaatcccctgctgagcccaatgtgaatgtcaggctgtactctttctgaggggttgtctcgaccatctgtgagatgatgccttccttccctgatagaagctcaatggcgcgcttcccttggggaatggtgtactggtcagagtcgacaaagcggacagctcgatttgactcaatcatccagccaggcaaggcagacgtctgctcatcgaggttggttgggagaagcaccccaaagctcgtgtttggaaacatccatggaccctcctcaaagtctccattcgacaccacattatctgttgaaagaagacaacaccaagtgatgacttacgaaccatacacatgagaaatgaactagagcacctctagctctcttaagacatcctgtaaggatatacactctactaggtatagagataagcagaactgtcataccctttggtttgtctggagtgaagagcttctttatggcaacgttgtcaaggataggcccacaagtcggatcatcctccataccagggttcctgaactcaaggctcgcctgctcatctgttgcctgaaaagccagtgcatatgcatcccagccttctatgttgtacaatgtctgcaggtccactgtctgtgatgcaccaccgagcacagacacattgagtgactctagctgtgcacacgttcaggcagcactgaacgtgatagcatactctgagcccttctcaacctgcaccacctgccctatacttgcatcgtttccaagacgtacagcatgatcccctgacatgaaaatccaaatattaaacacatcgaatacaaatcaatggtgcaatttgattgatcagaggacagaaggagaaaagctctgtaggataccctgtggaacaataagaatcatgccaccctggtgctggcctgctgagatgagctcgactgtcccattgatcgtccagccagggatcgatgatgcaccctcagcaactgaagcagatttgacaaaaccaccagctggtgctgtctcaaagtcaccattgctgagcaagcctgttgtgcaaagagatcacttgttcatgtaagtgccaaggtcaatttagtaacagatctccgaaagtaacacggctgcaatccaagatcaagaggcagaaaatatgtttctcaagaactctacttaatatctacccatgttatatgcgaaagtgttcccatgcaagtgaagccaagtacatctatgcaagtctgcaatgcaataaaaccataactattttaagttgtgtagctctagcctattgtaggataggacgaaccataaatctgatcccccactgaacctagtacactgtgcgctggactatctttgttatggcatatataaaataatgtacaactcagactgagggtgcgtttagttcacgccaaaattgaaagtttgattgaaattg

SEQ ID NO: 13909 - DNA, 11303 bp, Oryza sativa
  unsure (1)..(11303): unsure at all n locations
cagtagagtttgaggaagttcatttccaagactggtttttcttataagtgacttcccaagcttgtttttttatggctaccttcccagttgaaagcatggttgcacagataaactgtaccataattaaatctcctgtacaaaaaattaacagctaaaacctctaattcagtactataggagagaaaacatgtccatgtttttctattgtacatccaatgcatttcattggggcactgcgggtaggccactttactgtgcttcaatgtccttacaaggacagccatgtgactatgcacgacgatattatgtggtgaaagtgaaacatccaccaaccctaccctatccaccatcccaccatggagagccccatgcagtggtccagactccagagctgcccatgtccggaggaaatcaccacggcccgtagcgtaattctggggaggttaaggtacgaaaaattaaagagacaggcatggaccctcacggccatccttttaataagccatttgacctttttactggacggttcattgaacacgtttgcaggacactggctcactggtttctgctgctgtgctgttcggcctggatccaagtttactactacgccacatttcattttgactttcatgcaacttcgtccttgcatagaggttcatagtacctcctttggacaagataggaaactgaaactctttcagttacaagcctgaagattttctgaatctttcaagtggttttgttagcagcattctgcacccaacagaatgtctctctcatcatacaggacagctcacttgggggtttttagtcattttcaaacataaaattgcatgattcatagaaaaggaataattttataaagatatatacatgcagactactaaactcgaaggcaagtaaggaataggggggggggggggtattaagcaggtataaatatttttatccaattaatgtacttaaaagaagtggttagtggttacactggtcactgcaaaaaactacagtcgcaggaaagctttggaacaaattgcagtataactgatcagtttttggctgtccagacttcaataacaggacaggtttggataattggtatgaataaatgttatctcaacctccaagggccaaggctccttcctactttctaggacctttactttgcaggtatactgaaccatgctctacaaaaagagaaaaaaaaaagaagggggggactatcacactccttcctcacgagtgcaaccacatctcttgattcctagggcacaaagctaacttcttggcatgctttaccacaccattttcctaggggattatttttctcttctcctacccacccttcaaatttctcctcagtgctatgtatatgtgctaatgaactccgcatttgttatacaaatgtgggatgcggagaggtactaaatcgcatgatttctctatttgctgagatctgtgatgcagaaaactacccatccccacaaactccagccaaatattccacaaatatgtcaaaatactgccttggatcctccagcatcaaaagaacagcagcactactgatcctccagcaagggcaagaaacagaaacgatcgaagagacagcaaagcataccatcctccaccgcagcggccgaggccagatgggagggcgccagcagaagcaggcccaggcacagccccagcaatgcgagcctcctcgccgtatctccctccatctcctcctcctagccgcctcgagctctcgcctcctccttcccccctcgccgaggaagaagaacagtggagagagtgagccgaagtacagtgtgtgtgcagctgaccgagtgagcgagccgagccagccctactcactgggctggaggcagctctctgctcacgccctgctttttatgggactccgatggcgattcccttttcctttggcactttgctggccacccccattattctatttttctcgcaggcctggcctgtggggtctgaaaggaaaggaaggaggagcagtgaccactgaatggtgagaatgccgtcgatggtcaatactctagaggtcaccctgccttttgcttttttttcgcagcgttttggtagcactttttgtcgagcaccaaaaagaggcgccgctgccacttcacggaaacacgactgcagtatagtagaacttgcctgtgtagtgtagttgtgttctgcccccagtagggcagtagtggagcctgacccaaaatctcaagggttcctagagctcctctaattttttgccccatgtaatgatacctccgaatgatttcaattaagcaagttgaatctgtacagcacaggcttgctgtgttcagttcatgtctactccagctccagctgtcatatgtcagctaactactgactatgactacacatttcagcggagcaaattttggatgaaatctgaacagctgtgacgagttggtgttttaattctttaatttactgaagtactactacctagcagtagttcatttaccgaaaatgatatgcccgtcctttgtgttattgtgtatctctgagactctgacagcattgggctgcagagaatgtgtttttcaggaaaagaatgtggctggtaccgtaggagtatgtatttgtgccagttggcagcaggatttgttttctatcttcttttggaagaacttgttgtttttgggtctataacttgtgttaaattgtcattgccctttttgatgttacattaccatggctgtgtttagatccaaagtttggatccaaacttcagtcattttccatcacatcaacatgtcatatacatacaactgctccaatttcaatcaaaatccaaactttggatccaactaaacacagcccatgtgaagctgtcaacatttcatacatgaccatgatgtacaatgatgttccacagacaggccacctcattttttttaatttagaattgttttaattcatttaagtctttgagatttgagaccatgcataaggctagtggcccacaacttctcaaatttcccaacaatataatttctatacgctttaaaaaatcatattaatctatttttcaagtttttttagctaatacttaattaatcatgtgctagcccttgcttcattttacgtgttgggagggaaggggtctgaacacctagctaggttcgaacacaccaagtttgtatcagtgttcacctcttcgatttaatattagattccgaacacggtgatatgattttctttggccaaaatttgataaattttgattaatttcggttgaattttaccacttcaaattcaaattatcaaaaactattcaaaatttcacttataacctactttcatcctgcatcgaaacagcgtagttttcgaccagttttggttgaaaatagcctcggtgatcatttatcctgcttcgcccgtagagcgaacgctgaacttcccctctcagaatattgtccacacgtcgggcgtgggagcggtgaagcacgcacggaagcagccaggccaaggctacgtgacagcaacggggtgccgtgttgccgaggcaggccaccaaagccagtagggccctgatgattagcaacaaaagcgggtgcctgccgtgtgggctgccctgcatccatcggtcggtccatcgccctccgtccccatccccaccgtcaccgaagcgacgcgacgcgacgcgactgctgcttgggatttgattagttgtgttgagagatggccacaccgcaactgctgctacgccgcgccttctcctcctccttcctctcctccccattccgccgcccgccactccaccccgcccgctccttcgttcccccccgcgccgccatggcatcctccgccgcgccgttccacatggtccagatccagcgcgacgacacggtcagtcactctcactccactcacactacgctcgcccaatcagtccccccctccctagggttttgggttttcccgtttcccactgtttttatttaggaaatatatgttcggcccgcttcgttgcggtttagctcccgcttcttgtgattcccccccccccccccattttttagagaatcatccatgcttcttgtggtcgaggaggtgatctttgagacatgaatatattcgtttttagaactcactttgccgctttttccccgccttcccgcattggctttacctttaaccctttctccgctaattagatggcacataatgctattgagtcatgacaaatagttctggctgtcatgaatttggtggatactcggtatgcgttgagattgttgtgtcgttatgtggagtaatacaacgattaatccattcgtttccggttttcttttgcctaatacggaaaccgtttgcatccttttccttgtattaatttctatggtatatacatagaattgatcgaagtattgcagacgcgaacttgctagtacggttttacagtgccaacgatttcacctggactattccagatgtttcagcttatctgtgccttttcatatattcacttgattattctgtccatacagcttacctgaggttgttatttgttggtaagaatgtgcattagccttgtacgaagtaggtacccaatttctctccaaccagaaaattgtaaatgtgggacacttttaaaatttctcctaatctaagatcagttagctacttagctcaatgaactaaattggctggaaagacagcttgctataaatatgtggtgattggtgaaaataaaaaaagatgatgtcactgaggcattagtcaaatttatgtgagttttggaggcatatgccatcacttgatgctctgatgctcccactttcctctaatcaccgagtaagcattacttccttcgatatacaatgcatactgtattaaacttcattactgcagtatgacagcggacataacctactatagtagtaattgtaaataaactaccatctcaaaaaaatgtactttgtaaactagggcatatcacagccataactgaacaaaaagaagtgccaatattttttttcttgatttcttgcaagctaatattaagattctgcaaccttcactctacatcatgagaattgctctttatatcgtaacggtcgcagtgtgacactaagtcaatagtacttgtacatgatactatctttttctctgtagtaaactggtaatgtggtttactcataaattaatctaatgctaatctgcagacttttgatgcctatgttgttggaaaagagaatgctcctggaattgttgttttgcaagagtggtggggggttgactatgagatcaagaatcatgctgtccacatttcccaaattggtgaaggatacagagctctcattccagagtaagatcatatcttgtggttctttattttgcaagaatttcctcatttgtcacaaagttaaaatggcataatcacattttccagagagtttgtgtgctctttttctgttgagtttgatgcaaatcagttcatttgccacaatagagccacctctcctgcttctcccgagaatgaccattgtgggtgacacttcatcgtcttcaacgcatgcgctgactccagccatcatcacgccatgccagctactgttgcatccccccatgctggctccaatgtcgcctttggttaggagctaggagagagggaaggaaggtggaggaacaatatgggaaaggaggcagatggctgggcatgggagctcattctcgggagaagcaagagaggtggctggagcttacacataattgttgtgcatgtcattgtggcacatgagaaaattcccattcaactcttgtaaatttgagcatgccactcaacttctttgcacacagcaaattttcattcttcagcaataattagcatcacgtattcaaaaacaaagttctaggaatggatgcttcataaatcttaatacttagcatttcgtttctcagccaagaaacttgtttaccaacgtgcctttttcttcagtttgtatcgtggtaaggttgctcttgatgtagcggaagctcagcatctgatggaaggtctagactggccgggtgcggtcaaggatattcaggcttcagttaaatggctcaaggcaaatggatcacccaaggtagggctcgtatttgttcttgtttcattgttttctcatgttttctgtactactgaaattatatctccgtccaccatccaaatattttcagatgccatgacatatttacccaactaactcgtaactaattatttctgtttgctgactgaacttcactggtagattaaaaagaactagagagttaaaaatgcagcatttgtatcttgttacgtgcttactttagatagaggtacctcgggcagaaatttcagcaatagcaattgattggtttgagtaacagggagacagaagaagtaagagcattgttgcagtgataagttgtgctgatggagagggaaggagatttcttaactcttactttccataatggcaggtgtatagtctttaaaggaactggccctaacaaatgttatttagagatgacttagtaaccagaagataaacatcgtaactgtcagattcttggttacagaaaataaacctaggtatattccttgatttcctacatatgccttttcatgggaagtaactaatcatggggatagattactcagctgagttggttgcttgccatgtgcctaacttgctgcaccttttaggggtgtacacatgatgtattgacatattatcctaattgatggatgaaacctagcaaaaaaaaaaaattgtctacattctgatgaaaccatgcagaatgtaatgaattgcattatgataacttatattcctccatgtaggttggtgttactggatattgcatgggaggcgctttgtcaattgcaagtggagtttcagtcccagaggttgatgctgttgtggctttctatgggacaccaccttctgagcttgccgatgcttccaaggcccaggctcccatccaggctcattttggggagcttgacagttttgttggatttgcagatgtcacggtaagaccacctctcatatgttttgtctattttgctatgtattgacattatgcttggggcaacttgtttaaatttcacattcatatactagtatcggcattgttgaatagttaccttttttgttcaaggaagggcttgattccatacaatttatctgcctagaatgatgtacattggactagagaatgattagagtctacttatagatgctcaattgagcattttgacctgaaaaatctaatattattaataggggcacttattaatataatgtttcaggcagccaagtcgctggaggagaagctcaagtcatctggcgtgccacatgaagtccacatctaccctggctgctcgcatgcttttatgaacacatcacctgaggccgtcaagaggaggaaggagatgggtctgactgatgagaaccaggcagcaattgacctggcctggtctcgcttctcgacttggatgggtcgtttccttggatcggcgtgagccatttacgcatatatgttgtcaacctgtcaggttgtatgaataaaatcattcaggccagatgcagagtaattaagtatacccaaaccaaataattgtgctgtgttggactatgtgaacatgccatgctttggtttgcgaattatctgtggttttactgtgctttcgagattgcatatatattctgcgttggcctcaatttcttgaatatctgccgcagggagcgggatttgattgtgaaactcggctcaagtagaatccagcgatgaactagggtcgagaacggatcctgccgaaaattcaaagagttcctataaaatttataaggaactttgttagcaaagaatatttttgaaaaaaaaaattcaatttccattcagtttgtgaaccgcacagtcaaaagaaaacaatttacaaggaaagaggctttccttccttaaaagtaaaggaataagttcactttagatctcttatattgagatcgagtttgaatcatgttcttaatcataataacaaatataagtgtctcttgtcttataatactagagtaccaaggtgtgagagcagtattatgcctagttttagctgatttaacgggctaactattgtgcctagtttcagctgacatggcgagctaagttagtatgagacgcatgtggatcttatatgtcatggcctgcacaactcgcaccttaccgtcctcccttgtgatctcttctgttactatttctatacatttgttgttgacattgatctccctcgtactgaagatatatctgacggcaatttatattacacataaattaaataaagttgtttgggtttgcagatactatataattattgcgtcaaagcggaatggacaaacatctgttcctactgaaacatgtaactccacgctctaattactaacagtggaacaggaattggcaaaattaaccaaaagtaagaggtattctggtgtcagtttgtagtaagataataaagcaaaagaaggaacaggtggcagtgaagttaccgtaacacatggttgggacctgcagattttgtcacgctcattaccgcaccgcatgattagaaacaaagagggcaattcgtgtccaaactgcttactccacaaggccacctaattaattcccaacgcttcccgtgtctatgataccatcacttcttgcatcgatcgtgcatagccaagttccccgttctaaactccaacaacatctagatttttcctcgatttctgtttgcacgttttttaaactgctaaatggtatatttcatgtgaaaactttctatataaaagttactataaaaatcaaataaatccattttcaatttttaataattaaaactttattaaccatatgctaatgatttatctcttgttacgtgcacacttaattttcatcctataatcagattcgaacggggccttaatttgcatgcctcccctcatgttctatcaggaaaattgtaaaattcaagcaggctggaaagaggcaggatgaaggaatgcaagggaacagctagctccaaaacatagtggaactggaaggtgtgattgctttcatagaaaaatcgggaaaaaaaagtggaatggaaggtggcgtgcagtgtgctgaagagtgatgcgcttttaaatagtcaaactaatacgtcgtcgatcaaccccacgacacgtggaactgcttgccaactaggtgggcccgtggtatggcttcaagagctacactcgcaagttctccattcacgctgatgattgggacccacgtggacatgtcagcgcatacctatgcaaacgcacgtcgtttagaatctcgtggtgtatatttccgcttatgtagagcggattttaggttttttcatcgaagtttattttttagcctttgcttttagatcgctaaaatcatctatataaaagttttatttataaattacttttcgtttgtaaatatgtcgtttggcttattctacgaataagcgaaacaatagggctgttggttaatgaagccaagccttacattttttttattatgttattttcgattgaccaaatattccaacaattttccatttcttattatttcggtcagcatgcctatcaccattacagtgtacttgtcaaacgtaataggagcgaaggactagctagaaacggaaacagatctcttgactttatgcagattgcagttgtgccantgacatgtaggccatataaaagnggggtnganatatnagtggnacaactgcaaactacacaacgttagggatgtaaaatcaaaggtatttttgattattattctgtgatgaataattgggcattggagattattagttttgttatttggaatttattcacgaagtggttttggagatgattggagttcacaggtgaatctacaggaaatcgctgttatttcatgtgaccggtcagaccgggcaggtgttgccggtcagactggcggtgatcgagcagtcggaccggctagcccacggtctgaccggccgactctgtgtcggtttcggtttcgggttgtttgtttggatatccgtgattatttcatgattatggcttctagatggatactatacgtatgtaatactgttgtttgctactaatgagtcaagttggagatagcttggtctcggaatatggtttctttgtttatttcatgtgtaggtgactcgatgcctcgggagagtatttgcggtgatggaccgggagtcggcttggggataagacgacgtctgtggtggtcagagatcatgcgggatacttaggctagagttgatgcacgtggttgatagagattccatatggcatacgatggagttattgtgtgcgtatgggatgcggagtcgaatttggaaggagtccaaacttggtacgattggttatgtaaagtttctttcttatactagagggtttcctaaggtgtttaggactcgtagtatgggtttggttcgtgcctttaggctgcctacctcaggatataaatagagggggagcgtgaggcttcccggtatcacttttgtatcgcttttgagagtatttgagttgagttttgagttagggttttgagtttagtcgaaatttttgtaaggagtgcagttggtgcactttgtaaacacagagagaatcaataaagtcgtcatccactttaagagttcttcgatttgtgtttcaccgggtctcagcggtctaaccggcgatataccggtggtcagaccggcggcacgcggcggtcagaccgatggcatacgggtggtcagaccagcggcggcggcaacaggcgcggcaggaattccagggcggtcaaaccgggagatctacaccggtcagaccggcggctacgcttcggtcagaccggctaatctactctggtcagaccgatctccatcgatttcgagagtaacttttatttcagctaaaagtttttggtttttgggtataccaaccattcaccccctttggttagcttagttcttgctattcgattctacaggggagtctcatccgccaggaacatatctagaaaagcacaacataatgacagcagaagggccttaaaagagaatgtgttcagcatcctcaggcataccacaaagtttacatatgtgattccccctcttcagtttatcttgacctattgtacaacagactggactctatcataccaagctaggaagtgtttaattttaaatgtttggggcttccaaacatcccgtatcatcatcagctattccctagaaagtcagacatatataa

SEQ ID NO: 13910 - DNA, 16130 bp, Oryza sativa
agcacctctcaagtgtacctcacctacaaggatcttatgttcattacttatttggaggagtttacaacagaggaatttgataggacaaatatctctccagataccatgcctaaaaagaatgtactcccccattccccacaaacaactgtaattctcgccaaagccactctttcatagcatgtaatcctttctgaaactgagaaactctaccattacctgtctaaagaaaaaacctctctctaacatatactctatgcttactatctctaagcaagagctggaatcctaaagcttcaagagtttcattgtccattgtccatttagcttggtgaaaaatattcattttgctggacgctactaaacccaaatctccatatataatcttttggtctagccaaagcagaccatttcaccaaccggcacattatatcatctttaacaccagtccaaaaattcacgatttcttgatgccttccaatattgcacccctctggtaatatactataccctgcttaatttcgttgactattccgatggcacacggttttgctagcaatctgggctgttctttcctagctgctggttttgtctggcaacatgagtgtacactattatatagtgtgacaattacctcaattcttcctatatatatatagaggaacacctattgattggactatcttaaacacacaatgtagtatgtcagtgcttgttggaagactggagagaagcaaagtggcaaagtggcattgtatggtcgctacctaccatgactaattattcagttatgttttctcttagaaaagatacaaagaaaaataagtccttacaccaactatttctccgccttcaataagcttggagctttttttttttattggaataagcttggacctttggtattatttgcaaatgaatgtggaacaaatacacatccatccatttaattcgccttctgtttgtcggaagagtcaatagagataaaagccatatgatttagtgcattttcatcttaaaagaaaatatgcatatgaagttaaattaggagttcttaacccattgatcattttctaagaaatggtatgctttttccccaaaaaggctatttgcagcataggtacgacaaatcaactataattttcacaaaattttagctggatacatgagattttatatgtgtaagttgaagctggaaaaacaaatttcactgtacaatttaatttttttatttcagatttcttctccgaggaatctattactttctctcaatatcaagtttagacttggttatttttagataagcatgatcttaattattttctgtgttaaaaagatgataaaaaaaatctcacaaacctaggccttgtgagccagcttgggcatatggatgaaatagcgaggttctgaacttctgatcatattgtttttcatgcaggcacccagatgtgattcgctgatgcaatgcaacctccattcagccagtcgagatcagttagaaccacgaagcaagacacgaagcaagtagatgcattgttcaccacgggcgcgttgcgctgaagatatcaaaaggcacggtacatggagaacgctgcttgctcagcatgtcatgcagcacattacctctatattcccctgactagccgatgagaaaatgaggccctccaactcccgacgcctctcatgcctagcttgagatatctatgccacattgccagagatgcagattgttgagttgcaagtgtaggactggcatttgcgaacatcttgaactggcacttgtgtaggactgactaccatatcccaaacagctgtatatgtatcttcagctgcttcttgtaatggtcttgctagcaatcacctccgtcctccggttgttggttgcaatgaaatactcctatttggaaaccatgatcgcactaatttattacaactaaagggtggccatttaagattttgtacatggagatatggaggtatgaggcgaattttgtcgatatagttaaaagaccctgaatagcattcacacacggttcagaaccttcatgaatgattgtttgattttgtgtatgtatgtgatatgccgtcataaaaaaaaattacgtgcatcatatctttttaaggatgtgcctatccatcagttgacaagcacgggtcactgacaaaatcgcaagggtagatattcaagtggttttgccccgaaaagaaaaggaccctttaatttgggctatttttaataggaaattagataaaatatataacactcaccctttcgagataataggctcctatctgttggaaataggactgcaacttctgcagtcctcaagctcacataaacaagatgaatacacaaactaataaactggtattatgttctcgcataggagtatgtctcatgatcttacaaattaaagcactaacctatttacatgggacatcaagtcattttaatcaatacgctaattaaacaactgacccagtactaccgacttaacaccacatggacagtgaagatctacggcatggtgtcctcccctgttcacacctctcagcttgtgagcttgtcacaaaattaagatttgacgactggctatgctcaataccctttgattacttactcccgagatatatacaaatgtgcatcttgccttaccattttattagctaaattaaatggctgaaaatgttatttgattaataagtaaattatttctggttaaatggaaccaacgagaagtttagccagaaagaaataatgatgtaaaattatcattgaccgtaagatggccggcacgatttttggccggcttaggaagtggtgggccacattattattttttaagcccgccatttatgttttatttatttccaaaaattcatttatgaactttcttagccatttaaaattgctggaaaattatggtcaattatttgaacacttagaaaattatttctagttaaatggaaccaacgggaagtttagctagaaagaaattaatgatatgatattatatttgaccaacgttaatatgatttcatgtcaatatttattaagattattatttctttaagccatttaatttatttctagttgaatgggaattcaactagaaagtatattatgatttcatgtcaacatcactatgatggtcatttccttattaacttaattatttatagtcgaatggaaccaacgagaaattcgattagaaagcattaagatgtgaagttatatttaacccacgttattataattgcatgtcaattataattttgttcctttcttatttctacccaatggtgatataattaaggaattaattttaagattattcataattatttatgaccaatggtgctttgactatgaaattctaagtttattttgcatatgattgattaagccatggtaaactaattatatgcaattatcaatgcttattatcagttgcaatactgagtaaattatttctagattaatggaaccaacgggaagtttatctagaaagaaaggtgatttcattaagattgttatttccttaattatttctgcccaatggtgatgtaattaaggaaaaaatctaaatatcgtcaatcattattttcttcgtcattttagccttaatggtgatatgacttagaatcttatttatgccattagtgctttatttcctttatcacttttaccttacagtgatgtgatcaaggatctctaattcgtcactaagcttaattcctttaccatttctgcccaagggtgatatggctaaggattttaatttcgtgtcatttactaatggcattatgccctatatcatatctacctacttatggtaatttgatttaggattttaatttcagtaattcatgataacattattcctctaaattctctgtcatttcataatcttttctaccctatggtgtttgattatgaaaatttgagttttatttgtatgtgattaattaagtcaacggaaattaattgcatgcattactaatgtttaattaataattaattttctcagcattaggacagcttaaggctattcagcttcttgatggatcaaattacgttgagtggagaaataatgtgtttattaacttagccataagagaggatccgcccgaggaacctcaaccggctgaagaactcaatataattggggaagaatatgataatctcatgtgggcctacaataagaagttagccaactgggagaagtccaatagaatgtgcttaatttatgtcaggggtgccatctctccagaagttattggagaaatcattgactctaatgacattaagacgtatctggcaaacattgaagaaagttttgaatttgcacctgagactcatgccaatacgcttgtaagtgagatgatcactagtcattatgatggcaaaagtggtataaggaagcacatccttgagatgactcatatggaaaatcaactcagatccatggatatggaaatatctgatggatttttagtgcacctcatcatgagatctctaggtcttaactatgatccattcaaaataaattataatacccagaaagagaagtggaccatacaagaactgatctcacactcagtggaagaggaagagcgccaaagggctgaaaagcagaagataaaagaccagctcaacctcactaatgcctttgataaaggcaagaaggtctatcaaggggaatcctctaataagaatagcgagccagagggcaagtagaagtaaggcgagccgcaagctcagagtaactgatggagtgaagggttgttggagacctcacacttagtttctccaacagttgcaataatatcttatttgttcaccccattaagagaaaccttattaattatttaaagtcatgtgagaaacgggtcatgtccgttatttttccaaacagaacatgttatattaagcgtgataataaagtgattggtcttgcccttgtgcacgacaatcatatttgttctttggatgactatgtgactattataataattgcatgtaatgacaaaagatgagacgtcattgaaattgtgacattgtaattgatgtcacatttctaggggaggttggaacgtctcataagttggagagattctttcccttggattgattttaattacgttatttaagctttaagggaaaaattcacgaagttaagaaattagtcaacaagcgaatacttttggttatgtttaccccataaggctatgtttactcataagagacctccgatttcctttaagaaatttaagatactaatgctaaaatcaaatgaagttatgagatcgaattatggtggtaaacactaaataaagcttgttcaccttataagacattaaaaataagcgttcatccaaatggtttttgaaccatgtaagaataaattgagattgatgaacaaaacaaagaatttagtagaagtttctaaatgagtcaaaatagtaggccatttaagtgggttaataaaattttggctgactctaatggaaatttcgaacaattcaagtgaggtgaacaacttcatgaaaattaatggtgggaatttcattcaccggtactctatactaatgacattttattgtcaagcaatgcatattgctgatagaaactaaagaaaatttttcatgaaaatttttttggtctaaaggagtactgggcttatatcagtaagttataaattaaataaataatttgagagaattgagttaaagttagtcaagctgaaattaaattataaagataataatttatgattcagctgacagttagctcaaatctggatgcatacagatttggcatacatttcttactaggaatcttgacagtatttaaatccagactagaccactggtattaagaatgctttgtattatttgcaaggcaactttaagtaacatgctcatatttctaaaagtctatttgtcggtgaaatgggtccgggggtacgcatcgtgaggggaggcggcttccccgtccggcacgtggctgtacggccggccccttccctgcctcccccgggggggggggaggtcagggggttggaggcccgccgagggaccctcggggggccacgtcaccctcccctcgggcccgtaagggccacgtcacacccctcaggcccgtcgagcgagccaccccaaggagggtcacccgaccgctgcgtggccggatgagccacgaagcaagaggcgccttgagggccttaattgcgcggcgccccaaccgtcccgcgccgcattaaatgagacgtggggggagggggggacgtgcggcgccgcacgattgacgcccgtcaatcagccctgaccagtcggtcggtggctgattggatgggcggcggtgcccccacgccccgtcctgtgttaggcggagtgggggcaggtatgacccgtcccatcagaccagggtcgagtgcgcccccctgcaaaagggcgcatccaccgaagtctctcggcatttaagagggaatggcagggatgtcccctacgacggactgaggacggcgctgggccccgcctaagaatgggcgaatgccttgcgtccggttgaaggcacggttggcagttagatccaggttaagtgggccgccttccggagaaggagtagataggggcgctgcatgtggtatccccttaaactataaaaggaggacctcgccatggggaaagagagagaaaaaaagaagagggtgcttgtaacgtccagagataatcccaaacataggagtagggcattacgtcttttagcggcccaaacctttataatccctagtttccagtttttcctcgggctaaaggaagcggctcccgatcctcgcgcccttctccccggccgaactcacaaaggggggtctcacgatcacccgctagagaggagctctcctcgacactatttgatctcaaaattttagagacatttggacacttattttgtgagatgtgtggatatttataaagattattaagctaatttagattaagctatatccacacataggggagcaataaccatggaaaagctccaaaataatctcttactgcatagtcgacgatgcaattagatttttaaagcatgttatgattaatcatatatttaagaatttttcccagaactaagagtggtaaatagcgctcataaaccactcaaaaggtgtaaaccacccaaaattatactgtgctataagttgtgcactaattaaacactgttttctattctagtagcagcatgttgtgtgttttcttcctaacacattgatatggttgtgaaagacatgtcccaggatcaaattattaagctaagcatttgctcatggatccatactctaaaggctcataaaattaataaacatttgctcatggatccatactctaaaggctcataaaattaagattaattaagattacgttctggccagtacatatgtaaattagagccttactaagatcctggatgagggggacttaatttttcaatcaacacccactaagttaagcttgagtttatttgagtactatagtgagctattgttaacgaccaaatttggtaatatgagtatcggagatgaagatcaaacagaagcggaatctaagacaagaatcgttacgaaaacagagcaagaatcggctaagtccgaattggttgcgaccttaatcggcagagttcgagtcggacaaggttaaccgattgagccgattttgacaatacgactcggtatacgttatcgggtcgagttgaagtgcttcatatggattgccatacacggattgagtcctaaggaggcaattttatctattaattaggatattttatgtaaattccttagagataagtttgggcaaaagtctgccgcaaagacttatggtatcttagagtttgttagagataagagtcgtgtccgacaaggacatattttgtaatctcgggtataaatagaccccgagccccatgtaataagataactcacgttcaacaacaatttcagcgcatcgccacccttttacgttcgttttgtttcgatgagttcttgctttcgggttgagctggatcagtttcgatcttcaactagaggtaaaacttgttatggcggcttgcgttctcaggattagtgcttccatttttatgatactctaattttgttcatgtaagttgtcgagttatcatatatcttatataatctctgacaatatcgctgtctaaccttcaatcggctaatatctatcattagtgggtagccgattaggttaaatattgacgttggcttagattatataggatatctaccattccataaagcttccaatagcttgattgtctacatattgtctttcttttcatacttatggctgcatcagttgagtttggtctcataagtcgtgtttagaactatagtctctagcctgcttcttggttgttgagtagagtagcatcggagtttcagccaatcttacctgatttagctttatgtcttatgtgctcaattgttatgctagatctgccctttgtgttaagatcctattgcatttaggtgtattaagctctctgtttgatatattttacttgctttaatatcttaatatagagtggtgtcggagtattagccggtgcacgctagatctatctgatcggctatgctgtgaacatctataatctcatcgttaatatatattttgatctaagtgatttatactgtctcggcatggcgaccgatccatcccaatcacttgatttaagtatatatcgacataaagattatgtgctgttaacatctacagccgatcgagtagatttagtttcaattcacttatttacaactgccgatcgattcacatatgacatcggctcaaagataaatgatatgtcatcggtggctggccgatcggctatcatttatggatttaactacagtttctttgtctctatttcttgttgattgcaggatcaaatcaactggcacgctcatgaacctaaaaggcaagattttggacctgcactggagttaagcagatctcccaggcctcgtgtttttcgcatcaacacacttttggcatgcccagtgggaccacgagtgttaacgacttcttcccgttggcccaaaaactaccaccgtcaccagggacaggagtcaaacctcccgttgctaaaacaggagctgcaaatccatcaactaaagtgaatcccagcaacatagttccagtcacattggataagctgacagctgaacaaaggggtgagcttgagcaaatgatgagcagcatgaaggatcaattcatgaattcttttcaagaaacccgcagaggcacaatcgtccataagtacaagctgaaggtagttgcagccgatgaggttggctcaagctcttctccaggtcatgcaggtaccgtggctggctcaggcgacaaaggtgatgttcctaaagatggtgcagttgaagatcttggtgaagatggcgaccaagagcgtttacagtttaataactttcaagactggatcgactatgccgtgcaacatgctctgatcaaccaatctggagtgctagttaatactttgacaaacatggtgaagtctgtggtcgatggcacgatagctgagcatcaaactacagggccagtttatttaccaggaggtgttttcccgaactatcggccttcgatcacaggaaatcaacagggtgtttctagtgtaccaccaatccagccgatggcaccagtttcaactactgcaccagctgcgtcatcatcggcacaaagacaggtggtcaatcctagattgttgaccagagaacaaccacaacatgctgggcgaaatgccaatcggctgactcaggaacaggttgctgcaatgtttctaccaaatccacaaacagctgacccagtacagtcaatgctgaatcagcaaacgccgccaagacagcaaacggttcagccgattcaacagcaaaacttgcaacatgtatcggctaggttgagaacacctgataatcggctaaggcagcatgctgcaaatcaattggttcctgagcacttggtccataatgtacaggccgatcagtcagcaatacctcaagttgttcctgaacatttggtgcgtaacattcagccaaatttcaagaattatcaaggaggtaatttaaattatcaatataagccttcgtcaccttatgttcagtaccagcaaacaggatcgcctcaaccccaatttgctcctcagtttaatcagttcgagccgatgtagcaacaaacgcaaggagtacctcagcagaggccatgggctgatatgattgtagatgtgatgagggagcagtttgggctcaaaccaaaggacactggaaacttgtatcggcatccttaccctgaatggtttgaaagggtttcattgcctagccgatacaaagtgccggacttctcaaaattcttaggacaagacaatgtttcaacttatgaacatgttagccgattcttggctcaatgtggtgaggcatcggctgttgacgccttgagggttaggttgtttcttttgtctttgtctggatcggcattcacgtcgttttcttctctgccatataattctgtcaatagttgggccgatctggaaaaacagtttcatagctatttctacagtggagtgcaagagatgaaactgtccgatttgacaacaatcaagcaaagacatgatgagtctgtgcaagattacatccagaggcttagggagatgaggaataggtgttacagcttgtctttgacagattcccagctagccgatctggcttttcaagggttgatagcaccaatcaaggagaagttttcatctcaggacattgaaagcctatcacatcttgcacagaaggtgaccttacatgagcaaaggtttgctgaagctaaaaagaatttcaagaagatcaatcatgtatatccctatatgtatgattctgaagagcatgatgattccgaagtagcggcaaccgaatgggtcaggagcaagaaagtcataccatgccaatgggtgaggagctctaggaaaagaggagatgtttgactttgatattactaatgtgtaacatcctgaaaattctcaacaataaaaatcactaaaattttgaactttttaaaacttttgcatcatgctggttgttatgattcctattgcttgccaaaccataaatgatcaccaagaaagtaaagaaaagaactacatttaagcaatagatataatttacgagaatatatttaatcttacaaataattatgcacaagatattaaaagcaaataaaagaaaagttattataaacctattttatcaaatatgaaaatatttgaataatgtaggtgtgtgccataatatgagtacacatgaaatgatgatccttcaaataaactgagctctctgtatatataatagaattatgggagtatttaattcgatatgtagatcgatattgcaccaagttcctaattgcatttagggattgaaatttaatatattaaacccctctatataaaataaactaacatatagataaattgagctaatgtgctaatgtgttaataacagtctcattaggaaattatagaatctttaataaaacttaaatttggacaatattaatttgaatataaatttcgatgaaataacttagacgcggtgtatttttacattgtgacaaaattagtggcaacagtatatttttcctaattgcaaagtaccctctaaaatcaaaaatagttggctagcactgttcattagcccctaggtgttcgatttggtttctagccatcccagctctctttctccccactgctgcgccaccctagccggcctcgagccccgcccgcaccggcaccatcgctgtcgtgtcaccatcaccgcgccgcgtcgccgtcgcctcactctgccatcaccgccgcgcgccgttttgtcgccattgccgtcggcctaccacgctgctgccgtgcgccaactcgcgccctgcgccgccgcgtcatgtcgcgtcgccgtcgccgcgccgtctccaacccgccgcgtgctgtcgccgtcgccgtcggctgcgccgcgccgagccccgcaccgctcgtgtcaccgtcgccgtcaccagcgccgcgccgagccccgcaccagtcgcgtcgccgtcgccgtcgcatcagtgcctcgcgccctgtgcgccgctgccgcgccatcacgtcgccgtgtgtcgtcgtcaccgccttgagccccgcgcgccatcacgtcgcccttgagccctgcgcgccatcatgtcgccctcgagccccgcgcgccatcatgtcgtcctcgagcccagtgcgccgtccgtcgcgtcgaccattaagccacccttcccacaccctataaataccccccttccatcttccttcctccccacacaccttggctgccatcacaaggcctagccccatctctgcctctttctctttctcacacacatttcatcgaacacctagcgtgcttgcgggatcttcttctctactccacccccgcgacatcgaacttcgtcgttcctccatccctcggtaagtcctcgctcctctggcctcccctagttctgtagaaagtatagtcccctttaatttcgccaattagcaaccgtcgccgtgccggtccggccaccgttctgccgccggtgagctcgccgtggacaagccatcccggagctcctcctctccatctagtgagtaaaatggaacccccacactccgtagatgctcacgccctcgtcaatttggttggaacttagccctagcgccctatccccttgcaacccgagctcggccatggtggccatgctgcgccgctcgacctcactccgccgcgcgtcgccaacggtggagggatgtcgcccgagttccgccgcaccttccctggccaccgccgtgccggcctcgcgccgtcgtggttgcgcccagccgcgccccgcgatgcctccctctctctggcgagaggtagaagacgactcccggctgagtcgctgacaggccgggcctgctcctcctattttcctttagaaaattaatcccgtgaaaaagaaaatcaaagctttgaccccacatgtcagcagctgttagggataaggatatatttcggattaaaaataaatgaattaagaacagtgccttttcacaatttctcggatttattcaaatttgaatctttaaactagcgtaacttgctcattttagctctgattcgagtgaaacatgaatctaaattcatctaaaatcataatctttcaaatggtatataattcactatttaataaaatatatttataattataaaatagttaataccaagaaattagataatagtcaatttaaaaatgtgctaataaataaaattgatattgtactgtaaagtagatgtcaaataattgtctttaacatgctttatcactgtaaaacccatgtaaactaattaaaagcattgtttcaaattaattaaagcataggaaatgctagtgccatttattaatatatgtccatatataattatacccatgacgtccaaaatatataaataatgtttagcctcatattttgtgactaaaatatgaacacgcatggatcagtccttagcttatttgtgaggaataataacagaccaattataaataaaccaccaaaatgaagttgattaatagcatagggaatagcatatagttgatttggttagcatccaattattgcccgaacagtaaatcactcatggatccactttgatcacatatacggtatatcttgtagtaaataataattaatcaataaatgatccaatattaagacattgtgcacacacataatgtacatcccgttatagctatacggtacagtattaatttgcgtgttgcatatattaaattagagggagtttatgacaaacatgtatattggataaatactagttataaattttgacctcatataatccaagttcaattgtaaattaggattattcattgtaaaattatgtgatgggatagtccgtaaccataatatgattaacctaaatatttctaacatacaaagcatgggtaattgttaaccttttataatttattttgacaactaaaatatgtacataattagaataaagcctccatcaataaaataataatacaaatgattcacagtaattatttgaccaatccaaaatccatccggcaacagaacctctactgtataaccgttctatttagatagatgcatatatagccatttgctagactaaaccacatattagccaaatatgtatcccataaatgctatgttggttaactcctaaaaagaccatgatgacaacataaagattaagaaaccttagttcttagcttgattagaatccattagcaaacacgagtagtatgagcaaccctaggttcgaccccaacaactatattttgtttgtacatatttgattgttgtttgaatattggtttttctcgcgtattatagaatttgtatatcggttagtcatgaggcaacatatgctgcttccaggaggtgaaggttgatcaagattgtatcaagaataaggactatcctgagcaggcaagtcatcactattctttgtacatgttgatcccaattgcgaaattgttttgtttactaataaaattgcatgcaatgatgaacatcctacttgtgattatgccatgccttgattattgtttacccttaaatccttgtaaccatgatttacgtataagtccctagtcaactatgacaaatgcttagaaatgctactctagatttatgcatactcatatttatcaaatgctatatgcttgggcaattacctttgggaaggtaattgagatgcggcatgtggagacatgagcgccacattgccatgatattgatgacatgatttgtgaaaggaaaatgaaactaaacaaatgttttcgactggggcggatggaggatttgggtggtatccggaaaaaggctagtgccgtccctggtcaattaaggaccgagccatgaagttaagcatgaaacgacccccgtacaaccgtacttctcgaatgggtatagacctagcggagtagatagctgagcggaggcagtatccatgcatagtggtttcttgatgtgtgaggcaggggctctacggtggggcagccattggtaggaccgcggggcatgtgtctacagtggtgtcgccatcggtaggactgccatgtgagaatctaaacataattataaattaatgcatgtgtgagtcttcccttcccgggtgcgccagaactcctctcactgctagaaaccgtgtacgcctagagtgtatgaggatgtaaagttcatggagcgggtactgccaatgcgaggttatcgaaaagctttgccgtgacgcgtcttatgtgttgggacgaggctcatgtgttgggcagtcgcggagtgcgggtaaagtgtacatccactgcagtgtgagtaaaccaaatctattcgaatagccgtgctcacggttattgagcaccggttcatgtattacacttggctagactctaaattcttaacttgtttgggatgggatattgcatgattatttttatgctgatggagccacttcctgagaggagggaaggtggacgtcctcagaaaaccatgacgactcaatggcgggaagctatccctgggatcacaatggatggtggacagaaccatcgttgtttaatgtgaacactggtactaaaatttgatcagtctatgctaggtcttaggcttgtgaaaagatttgcaaaacttgctttgcgcaaaggaacctgaagccattccttgaaatactctctatcatatgcatcattgctgtggtggattgctgagtacggttgttactcacccttgctatttatatatcttttaggagagtgttgaagagaagcccttgttagtacgcttgcgtacttgacaagatgatcggagtgcggtcttgttctaggtctcgttccccagtcgactgcctgtggcatgttaaccgggcccttgtattattttgtcgtccgctgttgttctctgatagttgttggcctacctggctctaatgtaagtatttaactcttttagcttgaattcattcatgatatgttgtgattcaactatg

SEQ ID NO: 13911 - DNA, 12299 bp, Oryza sativa
taacgactgcaaagttttcaagcagcaaatccaggtggccattgagggaggaaagatcaagttcgatgatttgaagaagccgatgaaggtcgatggtaatcctttctttgttaacatggtacacacttctgggaggacagccgataggggaaaaaatctaaatttccggatgaattcggctagagttattaacaaatatcagaggaagcatgataagcagtaggaaaagtattatgaagaagatgatggtggttttgatcatcattgggattgtgaatttttcagattttgctggaatgaaggtatgaggctaccgtcgattgaggattgtcctggatgcagcaatgatgcagggagttctagccgatcctataatagaggcaatcggctgagtcagaaaagggtacctattcatcagaggttgggcccggtaaattaagattatcaccataatgaagatgatgataggaatacacaatggtgtcctacaagtattttcaccaagaatcagaagagaagggttcaaaggatgaggaacaggaagcgttttcaagaggtgcggcaagagattaatcatcggctgaggaaaacttggaccaagcaggagtggcgtgttaagagcacggttacaacagccgatgatgttgaagccgacaaggcaaaaaggttgcttaagggcaaagctgttgcatctgcatcggtaaatatggttttcgtgctacctgcggaattcgaagctaggcaaaccgatgttgatgatgttgaagaagcttcggctaaattggttttgtcaccagaacagacagtttttgagaaaccagaagggacagagaatcgtcatctcaaaccgttgtatatcaatggatttgtcaatgggaagccaatgtccaaaatgatggttgatggaggaactgctatcaatttaatgccatatgctacattaaaaaaattgggtagaaatccagatgatcttatcaaaactaacatggttctcaaggattttggttgcaatccatcggaaactaagggagttttgaatgtggagctgacagtcggcagtaaaactgttcctataacatttttggtcatcaatgggaagggttcctatagcctgctgctcggaagggattggattcatgctagttgttgtattccttcaaccatgcaccagtgcttgattcaatggcaaggtgacaagattgaaattgtaccagccgacaggtcagttaatgttgctaatgccgatttagctctttgagagatggatggtattgattgtctatctggaaaagtttgggatggagattttctaagagtgtccaattgtgatatacagccgattgaagatggagagcccaaattattattttgagggggtcgtggagggttcaaatgtctacaccaaggacatggtagatgatctcgatgacaagcaatgatagggttttatgtcggctgatgatttggaggaaattgatataggtccaggagacagaccaaggccaacattcattagtaagaatttatctccagaattcagaaccaagttgatagagcttttaaaagaatacagagactgctttgcttgggaatatcatgagatgccaggactcagccgattgattgtcgagcatcggcttcctatcaaacccggggttagaccatatcaacaaccaccaaggagatgtaaagccgatatgctagaggctgttaaggctgaggttgcacgtttgtatgatactggttttattcggccatgccgatatgctgaatgggtttctaatatagttctagttatcaagaagaatggcaaagttagagtgtgcattgactttcgagatctgaacaaagctatcccaaaggatgagtacccaatgccggtggccaatcagttggtcgatgctgcttcaggatacaagatattaagttttatggatggcaatgcaggatataatcaaatcttcatggcagaagaagatattcataagatagcttttagatatcctggtgcaatcggcttgtttgaatgggttgtgatgactttcggtttgaaaagtactggagctacatatcagagggccatgaattacatatttcatgatctaatcggttggttggttgaagtttatattgatgacgtggtagtcaagtcaaaggaaataggagaccatatagccgatttgaggaaggtgtttgagagaactagaaaatatggcttgaagatgaatccgacaaagtgtgcttttggcgtatcggctggccagtttttgggatttcttgttcatgagagggggattgaggtaactcaaaggagtgttgatgcaattcagaagattcaacctccagaggacaagaagaagttgcaggaattgatcatcaaggtaaattttgttagaagctttgtctctaatttatcaggaaggttagaaccctttacacctttgttaagattgaaggccgatcaaaagttcacttggggggcagaacaacagaaaactttggataatatcaaggaatatcttagttccccacctgttctgattcctccacagaaagggatacatttcagattatatttatcggctggtgacaagtcgattggttcggtattgattcaagagcttgaagggaaagaaatggctgtattttacttaagtcgcaggcccttagatgcagaaacaaggtattctcctgtggaaaaattatgcatgtgtttgtatttctcttgcaccaagttgaggcattatttattgtccaatgaatgcactgtggtatgtaaagccgatgtggtcaaatacatgctatcggctccaattttgaaagaaaggattgggaagtggatatttgctctaacaaaatttgatcttcggtatgaatcaccaaaggcgattaagggacaagctatagccgattttattgtggatcaccgtgatgacttaatcggcttggttgacattgtgccttggacattgttcttcgacggatcagtatgcactcatggttgtggtatcggcttggttataatttctcctcagggggcaagttttgagtttgcctatactattaagccttatgcaactattaatcaagctgaatatgaagcggttctcaaagggctgcaaatgcttaaggaagttgaagccgatgctatcgaaattatgggtgattctttactggttattggtcaactggcaggagagtatgaatgcaagaatgatacattaatggtctacaatgagaaatgccgaaggttgatggatggattttggctggtaactttgaagcatgtttctcgagagcagaatatagaagctaatgatttggctcagggagcatcagggtataagccgatgttaaaagatgtggaggtagaagttgccacgatgacagccgatgatcggagatatgatgtgtatcagtatttgcaaaacccatctcaatcagcttcgaggaaatagcgttataaggctttaaaatacaccttgttggatgatgagttatattatcgaacaatcgatggggtgttgctcaagtgtttgagcgccgatcaagcaaagcttgcgataggtgaggtacatgaaggaatttgtggtactcatcaatcggctcacaagatgaagtggttacttcggcgtgcagggtatttttggccaataatgttggaagattgtttcagatattataaaggatgtcaagattgtcaaaaatttggagcaattctgtcacgtcccaaaatgactctaaaatatatcctttaaattatgcctagaataattaaaatccttgtgaaagccttcaaaaattaaaatgtgcaaagttaaaagtcaaattaaggcttggaggatttttgtatatttcctaaaatcctaaaatgtgtaaataaattttagtggaattttcagagcacaaataataattgttaagaaataaacaaagttaaaaaggttttataaaaataaaaaccctaaaaaaaaaccctccctccctctcttgggccggctcggcccatttccctccccctctcccttctctccccgcggccaatccggcctctccctgcgcgcgcgcgccgctgacgggcgggcccgcccgccaccctcgctgacgggtggggcccacccgtcatccccgtcctcccgccgctcccgccgccccgcccgcgccaagcgccggggccgccgccaaatccgccgcatcctaccgtccccgcgtgcaataaagtggggggaaatactccccgtgatcccctctccctttccccccattttttccctctctctctctctcgcgttcaaacgggcggatttgcccccgcaaatctcgccggcgccattgatggcggctggacctcccgcgccggtttccttcctccccggccgctctctcccccttccaaccctatttaaaccctccccgcacttccttcgcccgttttcaccctttgccgcgccttctcctcaccggaatcgagctcgcgccgtcgctctctctctccgccgccgctgctgagctccggtccgccgccgtcgtcgccccggaccgcctcccgccttggcaccgcctccttcggcttcgccgcaccgtcgccgtcctcgtccacccccttgtcgagctcgccgaccgccgtagcgccgccgtccccgtcgacccgagccgcgccgccgccttcctccgctccgagcgcctcctccgtcgccgccgtcgcctcggggtgagccgtggaccactgcctcgtttccccctctccctcccctctctcggccgccgctccgccgtgcctatggccgccgccggcgaccataggggcgcgggtgccgcctcccgccagccgcgccggcatggccgccttcgggcgcgccgagtgtctgccgcatggggcccggccgtcagctgcccgcgccctcgggtgcggctgacgcgtggggcccacggcgccggccggtgtgagcccgggtgcgcccggtccaccgtggaccgtgaggctgccgcgtgggccccactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaggtcaaaaacccatttttctgccttgttcctgcttgttatatggagtttattagagtaaaagccttttcttttctgttggtcgtgtagacgctgcagcttcggaagatccgctcttcgtggaggttgaagccgacgtttgggaaagcgagcaaggcaagtcacatcatccttgaacatattgaatcccagtttataaaattattttgatttaaaattattgcattaccgctttacttaaattcccgcgttatcactattttgtttagccatgcctatttacctttgttatgaccttattattgttgttattgttattattaccttgttcaccctagaataaacaaaaccccaactagtgggtactctatttatggtaccactagtatgaatttaggtagatgcttcgctggttaattaggcaacattaggtggttttacaactctagactttgggaatattcatatcacctggacactatggaatggttggattattgtggaattggattcacacctccccctctattcaaaaccctcaaaatggttttaggctgggctcggggtgcatggttttgatagtaacacctcggccatataaggaccggtcttcgggcctctgttgcaaagcactatcgtacttccacatgtctagtgggtaaggcttagtttgtggctcagtctggttatgaacaaaagtacacggatggagatggacgaagtcgggggtcgatggacatctctagggcaaatgaaggctacacgagctgcggcccggtagtcgaaatgtcatggcacagggctggtgtcctgctgctaggggctcagtcctacctacctgtcccggaggttccggccataggtggggttgggtcggtactcttgtctatggctaggatgggttggaaactatgtcacgtcttccgtccgtataccgtgatggtatgtggcacgtgattacacgtgagaaagatgtgtcttgtgggtaaagatgtacacctctgatcaaagtataacctattcgaatagccgcgccctcggttatgggcaagcctagcaatgtacccaagttagtgttttaattcttaaaacctgcttaacaactaaaatatggaatggttggcctgggttggcttgggacgagctgggacccagggtcgggttgccagttcggtttgaatcatcgtaggccttgggttaaggcaggttcgtgtgggttcacggccttgattaataacattggatacctctaggatcgtattgacaaaatagctttgagcaactaagtgtcttttaatgctgtttactgcaaaccctaaccccttatattataacccccttgtactcccttgcatctattttgcacttgtgggtgtgtcttgttgagtacggtggttgtactcagtcttgctcaatttttcccaaacccagaagaggagttcctggatgatgaaggctttggtgtctagctcgtgcctgccgtcaagcgcctgtggtcgtcgccctagtcttccgctgtttttcgtttgtcttcttgtgtgctgggccttcgccgcccatgtaataaattaattacttacgcttccgcttgttaaactctgaattgtatcaacttttggtgtaccttgcctcctgggacaaggaataatacacgcacgtaaggaacgcccgttgggttattttcggtcgtgacaaattcaaagagcaccagcatcagctatgaatcctattatcaagccatagccgttcagaggatggggtatggacatgatcggccagattaatccaccttcaagtaaggggcataaatttatattggttgcgactgattatttcaccaagtggtagaagctattcctttgaagaaggttgattcaggagatgctatacaatttgttaaggagcacataatctaccgatttggtattccccagaccattacaactgatcagggtttgatatttgtgtccgatgagtttgttcagtttgccggcagcatgggtatcaaattgttgaattcttcaccttactgtgcacatggcaatggacaagccgaggcgtctaacaagagtttgatcaagttggttaagagaaagatttctgattatcctcggtaatggcatactagactggccaaaggattgttgtcttatcggatggcttgtcatggatcgattcaagttcctccttacaagcttgtttatggacatgaggtagttttaccatggaaaattagaatcagctcgagaagaacagatttacaagatatgttgacagccgatgagtactataatctcatggccgatgaaagggaggatttggttcagtttaggttgcgagctcttgcaaaagttaccaaggataaagagagcgttgctcgacattacaacaagaatgtggtacccaagtctttttctgagggagagcttgtttggaagctaatcttgccgataggaactcgtgataataaattcggcaagtggtcaccaaattgggaaggaccgtttcaaatccacaaggttgtgtctaaaggagcttatatgttgcaaggacttgatggtgaagtttatggacgagcacttaatggaaaatacttgaagaaatattactcaagtgtatgggttaattcatgatcggctgagtttgctgatacgtgtaaagccgatgtgtttacatcgccttgagatggccaatataattatatcgcccttagttgttttattatcataatcggatgtgttttgccgatgtatgatggccgatatggttatatcgccctaagcgggttgttttcattcacataatcggctgtgttttgccgttataggatggccgatatggttatatcgcccttagactaatttataattttatcaatgtcttcgtcattgcaaaattaggagggcacatatatgcaagaaaaaattgagaatttttgaacaactttagaagttatattaatcggcacaagagaatatcagaacaagtagatgaagtatcagagttttctagccgattacaaaaattttctaagtcctattacatggatattcattgggataagtaatgttggatagccgatacaaccctttatctaatttactctacttcttcgatcgcttgggcgtcttgagcatcggttccagggatgactgttaaggacttagtcatatcggcgacatttctaatggccgatctcagcttagccttctgctcctcaacagcttttgggagatcagctagtttcttgtgttccagatccagctcggcattgcattcttgaagttgtgccaagagatcaatcttttgggcttcgagccgatcaatgttggacctgatcggaaccttagacagctgatcgagcttggatttttcttcatgcaccaattgccgattggcttggattgtagcttcgatatccttgtgctcccgccgatcagctaatctttgtttagctctttccagcttgaattgatgctgctcgaggtatactgctggagtaataatattggcaagatcatctgggatctaaagttgaatttccttgaatctagcccggattgaaccacaatcggctactaagctatctaacgatgaccctagccgatgagatatatctttaagtgttttcttcacgtcatcggacaagggagctagagccttgctggtggtatcttcttctgtctcttcatcaaggtaatctttgatatcaaacgagaacagatcggctaatacctgcaagagagaaagttgaagatagttaagcatcaagacaaattgtacagccgatttgagatttttgaagacaaaatttactaggatagcaggagcagttggccgattaacaactttcatggctaccaagtttaaccaagtttgcagcaaccaccatggtccacctacaccaacaactgagccgacagctatcttggccgatgcattattcaacatttggtacagatagccgaggaggattttgcctaaggggaattgtctctttgtttctagggcttcagctggaaactgccagttggttgtgggaccacaacttgatccgcagaacaggaacttttcaagccatatcagcagaaagactacatgctctcgaggggtgactggccctttgcccttgtacgctgcaatataccctgaccagcctccaatgctcttggtcttgaactcaaaagtgtttttagtgttcaagctcatgggattagccaatgaggtgacatctaagccagtgatcattgtgatgtctaacagggttggggtcattggcccttggttaaagagtaaagcattaagtgtgttcgaccagaaataggctgcagcggccatcaggggtttgtccttagccgaatttgctatggtcagggcaagtgcttggccgattccaatttcgtcccagtgagcctgcttgctagccgatacccgcttgtaccatacaggccaacttttctcaggggcacttttctcaatggaaggccaagatttgaaggtgtttttccaatgacctatgttcgggttggctagtctgaaaggaatcctattagtctcggcactaataaactcatggggatcaggattgccgatcggaccgagaaaatactggtgctcgtttgacagactgggaaccgcgaccaagttggagagatgctacaaatgcaaaagaatagagatgaagaaaagctgatatactgcacggaaaaagggatctagctgatgagcacgtacctctgcgtactcagccgatggcgcgacagacgggctggcggaggtcgacatcgccgcgggcggaatcttggccggagaggagatcgccttggaattgccttgcgcaccgaggggatcgccggagagagagagaagacaaggtttgcttaagcggtgaaaacggaggtgacggtgtgaaatttctcggagatgacagttaatatttaaaacaccgcggtaacggtcgaaaaacggcaacgagcgatattcttggaaaaacagatatggcaaatctgaaacattaccaaatattccgaacttggggggcatgtgttaacgaccaaatttggtaatatgagtatcagagatgaagatcaaacagaagcggaatctaagataggaattgttacggaaacagagcacgaatcggctaagtccgaatcggctgcgaccttaatcggcagagttcgagtcggacaaggttagtcgattgagccgattttgacaatacgactcggtatacgtcatcgggttgagttgaagtacttcatatggattgccatacacggattgagtcctaaggaggcaattgtatctattaattaggatattttatgtaaattccttatagataagtttgggcaaaagtctgccgcaaagacttatggtatcttagagtttgttagagataagagtcgtgtccgataaggacatattttgtaatctcgggtataaatagaccccaagccccatgtaataaaataacacatgttcaacaacaatttcgacgcatcgccacccttttactttcattttgtttcgacgagatcttgctttcgggttgagttgcatcggtttcgatcttcaactaggggtaaaacttgttatggcggcttgcgttctcgggattagtgcttccatctttacgatactctaatcttgttcatgtaagttgtcgagttatcatatatcttatataatctctgacaatatcttatataatcaccaaaatttctgtagatcgttccggaaatagagtaagaatcggccgaagtccgaatcggctgcgaccagagttggcagagttcgagtcggataaggtagccgattgagccgattctgacaatgtgactcagtacacgtcatcgggttaagttaatgtgcttcatacggattgccacacgtggattgagtcctgagaagacaattgtatctattaattaggatattttgtgtaatttccttatactttgagtcggtaagggtccgccttaaggacttgtttgtatcttgagttgtaatagtgttaggagtcgtgtttgacaaggacatattgtgtactttgggtataaaagtagcccaaaccccatgtaatcaattaacaatcagttcaacacaatttcggcgcatcgccacctttttactttcgttctatttcgtcgagttcttgctttcgggttgggctgcatcgatttcgatcttcaactagaggtaaacttgtcatggcggcttgcgttctcgggattagtgcttccatctttatgacactctaatcttgttgatgtaattcgtcgagttatcatatatgttctataatctttagtaattactctatttaacccgcaatcggctagttcttattgttaggaaaatagccgatagggttaaatcttgctgttaatctagattatatagcatatctaccatctcttagatgctttcatcatcttgcttagatcttatgtttatctttatgcttaatgctgcatcggttgagtttgatctattaagtaatatttttaatcgtaatatcttgcttgttttatggttactgaaagagatagcatcggagtttcagccgatcttacctgatttagctattttatatcttatatgcttaattgttatgctaaatccaccctttgtgttaagatcttattgtattagaatatgttaggcttcctgtttaatgtattatgtttattttaatatcttaatatagagtggtatcggagtatcagccgatacgtactagattgatcggctatgctgtgaacattcatataattatcgtgttaatgcatattttgacttaagtgatttatactgtctcggcataacgaccgatctatcccaatcacttggtttaaatatacatcgacgtgacaattatgtactgttaacatctacagccgatcgagtagacttagctttatcttatttattcacaatggccgatcgatcccaatatgacatcggctcaaaaataaatgatatgtcatcggcaactagccgatcggctatcgtttaggatttaaccgcggtttctttgtctttctttcttattgattgtaggatcaaatcaactggcacgctcatgaacctaaaggcaagattttggacctg

SEQ ID NO: 13912 - DNA, 2159 bp, Oryza sativa
atgaaggttagcaattcagtagtgaagtactacctacagaattttagggttggacacatttatttagaaagtaggtagaattaaatgatgaaatgttgtaattagatgagaagtggaggtaggtggagaaattaaatggcggatgattgtaattgttgttagtagtatattttagtataagtcctgaagactaaaaattactatattttggatggagtaatacatactatgtgctatacaggcattgtttaattcccagaaattttttcccaaaaacgtcacatcgaatctctgtacatatgtatggagcattattaaatatagataaaaagaaaaactaattgcacagtttgcatggaaatcgcgagacgtatcttttgagcctaattagtccatgattagctataagtgctacagtaacccacatgtgctaatgatagattaattaggcttaataaattcatctcgtggttttcagacgagttataaaattagttttttcattcgtgtccgaaaacaccttccaacaaccggtgaaacgtccgatgtggcatagaaaattttattttcacgaagccacattgaacctgcctcgcctcacgaaaacggtcggaaacgatcggaaaacagccttaactatttccataatcatattttctcggaaatgaaatcaaaaagggtaaagtcagaaacgaaaacgatatcggaaatatcggaaaaccggaaacggaataatacggatagaaatatgttggtacagatcggaacccggtaacaaatacggaaacattaaactatagaaaacatatatttaactcataagtatgttatatgtataaataaatttaagctatactatataaattataaattaaatccattttagccacgcactcaagttaggatttgattgaagagtcaatcaatctctaaactgtgggtaaagtagagacataccctataaatatcaacatatctagaaatacagtaattattataagaaacagtaatttccataaaaatacggtaaatacggaaacgatcggtataacagcaaaaccatttccgtttccatctccatattttttaccatttccaattttttgggtcaattaccatttctatatagctcgaccggtagaaagtcagaaacgaacgccggttccgttaccgttttcacccttactaataactatgctcctgcatggacctgttggacgaaaatatttcaaaatttgtattgggccgttcgcttgagaagcgcagaacatccagagttccagacgtagtacacctatatagggaaaggattccttcatcttttagagctctgcatcctagcgtccagtaacgtccagtacaagcacgacgaatcctcagcaaaccacgagactttctcctcgccgccggagagcaaacggctacatgtccagactccgccgcgccgccctcgccgcggcactggccgggacggcggccgtggcggcgaagctgtcggggatttccgtccgcgtctcccatccgccgcaagacggcgccgccaccaccacccgcggacacctgggcctcgtccgcgcgcaccctgggctgcgggacctcaacgcggccctcgccggcagcagcagcggcagggacgccttgttcctcgacgcggcccacgcgctcgccgccggtgcactccgcgctccgaccttcaccggcaggtacctccgtgagtatgccaagaaactagcggccgcggagtccacggtcgtctaccgggtcgagatgggcctggcactcgtacacgctcgggacggccgattcgaccaagcgctcgccgatgtcgcccggctggtcgcggacagaccaggcgacccccacctgcggatcacctccgccgcgctgcgcctcctgcacggccggatggggaccccggccgagtggctcaacggcctcccagaggacgccggatggagggtggcgttcgaggtcgtattcgccatgcccgggtcctcgccgctgtacacccaggtgccgccgacagggtagtcatgttgctagcggccaagctcgccgaggccgtgctcgtcaagaatttcgagcaaggtgagtggtccgtcgcggacaagctggccatttcgttgctgctcaccgcactacgcctcttcgtgtccaag

SEQ ID NO: 13913 - DNA, 19498 bp, Oryza sativa
acgccgaggcggagggcgacgacctcgcggcggtcgacgtcaacctcctcctcgccttcctcgccgccagggacggggacttcgacgacgcgctgcggcggtacaaggcggccgtgcagaaagacccgtcggactcccagccgtacgagctcgccgcggcgctctgcgccatcaacggcgacgccgcggagtcagaggcgtggcggcgagacggcaagcagcacggccgcgctactgtcgctgtcgccgtcgccgagcttgagctgccagccctcctcgacgagctggtggtcgcggcggcgctcggctccgggattctgacgaccctcgacctcgagcgtgggggacgacggcgcctcgtgttggtcgccgcgtggagggaggtggacgcaaggctcgcggcggcggtgctggacgacgacctgacattgccggagcgcgtgcagctccgcctgctccgccgtttgctgcgcggcgagacgcagctattgctggacactgccagccatggactgatgaagaactccacgcgtgagagtgactgaagtttcaggcttgtcttctcgcttattcttacgtttatcagctaaattttaaaattttcattttagatttgattttaggattcttttatcgtattttattttttagccttggattctaaactgccaaaaatatgtatataaaaattttatttataaattatgtttcatttgcaaatacgtcagtttggtttgattggccgttggtgacttggtgccatacttaactgccatctttctagctcaaaattgtttttttttcttttatggctgcagaattgggaacgcgctggacatcttgattcgtgtctacattgttggggaagaggatgggaagttaagacagtgagaaataaaggtggatcagtatgagaatttgatttttagtctcaatttcttttaaattagcggtgggaactgggaagtgatacaagggcaatcataaccctccatttaggatggtgtctatggtattaactacattcacatgtaggacttttaacttatgtgtcactatattaattaagagagagagagagtgaagagagaaagaaactgggtctcatgcaagatacagtttcaacacgagaacatatgcactagacactatcaagttttgcattgggagaaaatagtgtcttcatagtagatgaagaataaatatgattggtaaagaagagagatgatgtatttattaatgacccactttaagaaatcatgggttgtgaagtgtagtttccattgtaatgtcttattgatatgtcaccatagacactgtttatggacactatgggttgagactgccctaagttggtacttcttcaatttgcttgtcgttctccatatgttacaaattaaatcgttgtggcaatttacatcgctaccgtattaataacataacaataatctttttaaggcaagtattaaaatttccagtgatgagtacaaatagtagtatggatgcattgattatgggtaagaaggaaagtatacatctcggaaaatgttttggagtatgagaacgaaaagtactttcaccaaaattttaaatgctagagcgataagaaaattgaaacagaggttgtatggagctaggggtggaaacgaggcgagccgagccaggctcggctcggctcgtggaagctcgcgaaatgccaggctcggcttggctcggctcggctctccaaccgagctgtacattaggctcggctcggctcgtggtctggctcgagccggctcgagctggctcgtgagctttgcaatagcagcagttgtattgccagcagcagttgtgttgctttgcaatgacttggttattcagataataactctcaagtccctacaaagataattaagtatattatatgcagccaacatataacaaattgatgggcttttttggttttcagccagaagtctttctattcaaaccgagcctactaagctcgtgagctgctcgcgagctggctcgggctcggctcggttcacaaacgagctaaaacccaggctcgggctcggctcgttcaggattcgagccgagccgagccaggcgagcccgagccgagcttgagccgagttcacgagcccgagctatttgtccagccctatatggagctttgatagaaactatatctttgagaaaacagatgtttgagattggtctagacaacctaaagaggagcggctacatcggttctcctaataagtaaatgacaaagccaaaatttcaattttcaaacttaattttaaaattgattttaagatatttcaacgtagtttctttttcagcattggcttttaagtcgctaagaacacatataaaaagttttacctataaattgatttttcctccattcctaaggacccctaaatcttatgctgtacagatttgggttcaaccgttgtaggcgagttgtctggacatgcatgacttgtttgccgttggatagtttccaagcatgcagcttttgccgactttcaactactggtggataattcattgcaactaataaaagccaattgaaacgcagcacacatgccacacatcacaaaacgcatgcaacccgacggttacagggattgagaaactagttgaatagacagctccagtacagaccataatggtcatcatgaacaaacagcagcaatgaatgacttaaacacccaaatgcaaagggtccgtctgtgaagattagttagtaaattgttcccttccaacaaaaaaagttaataatctacagccataataccaggatggatcatgttatcgtttcagtatcagccatccaacaaacatagcctacagaatcaatgtattcatgagaatatcaacagcgtcagctgcaagtacatctatctataaagcaccataaatagcagcaaactattacaaaactgctaccatacgaaaactatgttagatggcatagtaaataacaagatgttaaacaactccaaagtgaaaaccacgtcaaaacgagtatgaaactgctgcagcagcacgaccaatgagtgagttgggcaggctttgcctcttgccatgcttccaaccaagtgtgctttgcattccatgcacccacagacaggcctcggtgttacagcaacagccaggtgccgcttaatggcaacataatgcaggagacgggagatccatggagaaacacaagtcttgtagatcaagagctctaatcaggatacagtggccactgggcacagatgattcaacgaaattcagttataaacctcagcattgcatgcatttcgcacctaaccttctaaaggatctttttcagccactaaacactttacagccctccccctcctataacaaatacaacctatacccagactgacaaagggaaggggataagaagataactaaaggcaacaaaagttttgcagtacaagaaccttcatgactacattgtgagcatccaaacaatgaaggctattattgtccatttccaacaagccagatcaagacaagaagataatccccataaagaaattgtccttctctggaggaaagcatttatagttgccaacaaaatgcaccatttcatatgtccaaaacaggaggggggactgtattgtgatactgcaaaatagtataaaatactaagtaaatctcagagcatgtacactaataacagtgattgacactaccaaattcttaagcagatgcgctacttgagcaaaacaagaaaacggtatttaactaataacatggcaaggagcagtagtactgacaatctcagcggagaaacgaatgactaatgaatctccccatcttctccaagttcaccatcttcaaggtcatcacgtgtgccatttctgcgggagctatctcgatcctttttgtgtcttttgtgccgattttcactatcagagtccgaagcatgggtatgctgcattaatagcattcataaaatcattacatgttctaactaagtttactcaatcagataaacaaccatgtgatttacaaaactgatttcctgctgaatacaaatatcaaacatgcaagagagatataaggtatagttgattagaaagtcaaaactttgtagattttgacccccaaaaaagtagttagtcaaattacaagtaaatttgcagtaagaaggttataccaaaagattcatcaagatgccaatagattcatattacatagtgctttcaaacaatagggagcactttaacaagattattgctggtacaagggctagagacaagatttctggttgaatacaaatatcatatactttatgcaagagatttacaaggcatagttgatttacaaagtcaaattttgtagattgtgacaaaaaaaagttggtcaaattataagtaaattcataaggtattttttatttatacttatcaaactttacagctttgtttggggggtgggggtggccaaaatacaaagtgcatttctttacctactgaaaaatactgtacaaaggttataccaatagattcatatttcaaagtgctttcacacagtagggatcaattaacaagatttaaggacatcctatgacattgctaataaagtaagcagcccatctaatattattagttcgaaggtggtatatatggcagtgttactttttgcttgaacatcctaaacccaattctcccatttcaccaataaaaattacagtattaaaataccaaattactttttggtagaaagcatgaagtgatggcaatgtcagcttgtaacggttcaccaaaagctgtgacagacatgtttgcagtgtcctacagccactatggcttttacaaacaaaagacgacttaaattttagcacaaacaaaatcatccaccaatgagtccaaataacatcacaagacaaaggcaaagcacagtctttcagttcaataaaagttggtaaacgtatatcagcactaatatttggtgagggtggaaggtactcctcaagggatggtggcaatgtctgctgatatatttagcactaaactggtagtttttattatcctagtaccggggcctgtatgcatgatacagtgccatatcagcaccaaatcgccaatacttagaagcttgatttgcacgaaagcacaaatgttataccttccttgatttcttgcgatcactgctatgtctacgagactttttagagtcatccttctcatccctttcagagctcacatcatctgcagtgtcatggtggtgtctcttatgcttcttttccttgtccttttctcttttcttgtcttttgagccatggctatctgcatcaacagcatcaatatccatctcatctttcctcgaccgatcctttcctttgtccttttctctttctttctccttgtctctttctttttctttgcgttctttctccttcttttctttctctttcctccgttctttctcttcacgttccttctcttttcttgcctgaatagaagatacaaattcaggcgaaaaaaacataagtcaatgctacacctgacaaagaaacagatgctgctgatacaacatacaagtaacgatgtttcaaccatgttatacacattctgacaccttcaagaaatgcaggtaaacaatatatcatatgataaaacagccatcagtacattaccttttcttcctccctcaagcgctctttctcttttaacctttctttcaagtggacaacgcactcttcgaaaagctctctagagtatgtttcgctgtccaatgccctaatgcaaaaaatagtataaaatcattcaaaacccaggtaagacataaataacataaaagtatgacagaaaacagtcaagcaaattcagtcattcaaggaacatgtattttgcaaaggaagctcagttaaaatctgattcaggcaattcagtaattcactgccttgcttgccatgtttgtgaacagatacaaaaaccattatttatagagaactgatttgccatacttactgcattggacacaaattttttttatgtgtgagctataaattgtattgagtaacaatgtaacatacagttagcacaagagaatctaggtcctaaaattctgcaatatgaattaaattatatataaaatggatgtgccacagtactctgattacaacatctcaagacttcaacgcaaacttttcttcgacccatcgttactatggccattcatcacgacaaggcgacccagcactctttatgatctaggcagaagggtgtacacagggtgcgaacgtacacaacaaaagaaagaagagagcaagaaaatgagaaaatatatgggtcaacaatgcgttcagcaagtcaccacattagcttcgtacacttaagtcagcggaagagcctatttaaagcccaccaattctttttcctcagctgccctagcatagtagaggtgcaatacgtactcctccctctcccatacagagtagcccctccttccctcttgtgcaataagctataatgtggtttgtgcagatccatggcaggatggaagcaccaccacgcagggtgagtttccactctcatttccctcactccttgcccacaagatggagccacaaaagttcctggatcacgaggaatggagtccatcttttggaacgcccttgcccacaagatggagtcacaaaagttcctgaatcacgaggaatggagtccatcttttggaacgctggttaagaatgcgggtcgagaacaaatgtttttgggacgacatccacgatgtacattcggaatgagagaagattggagaagacagagcatgacaaggcgtggaatcgaccaatgaactcgagcgatgctctgcttgcacaagagggccagacgttctcctatcactatctctttatgttgtgaactaggccaaatgggctagcgtggctcattaacatgttaaccacttaatcatatctgagaacctctgttctcttctcccacatagcccgcagcttgcgccctccttagccaccaacatcagtgcccccattgcgcgaccacctcttgggcgacaagacaacgcaagcctcggccaacgctatcaccagcccctcgtgcaagtcgattcgagggcatcgactgcacccctgtcaccatccatttctctcttctccacctctcccttcccctcttcagtttgttccccatctaatggctgaggcaacgccatggagacttcatagaccaagcagcgaccaattgacgcccccatccatttctctcttgtccactcccttcccctcttcagtttgttccccatctaatggttgaggcaacgccatggagacttcatagaccaagcagcgaccaattgacgcccgggacgatgatcaggcaacgacccatccacgatctatgatgcgtcacgacgacgtggaatgtgggctcgtcccgcagaccaggtttcttaggccttgccttgtggcttcagcgtcatctaaacgacaccttgaaatacatggatctaccaattctgattgcttccccccacaaaattgcaagattgaacccacgtatcctatttaccaccaggttgaacacaagtatcctatttacggaactaacttccttccagctggcaaagccagtacaccaaccagtttagtataaccaggaggcatggtaaacatttgtcacaatacagtaattttcagaggattgcccttacttgtactcttggctatcttcgaatagtgctttagaatcatcccatgttgaagaagctgatatttcctgcatttttttcaaagaaatatacatcagtacaaaaaagatcaatctcaaaagtgtagtctcgtgactagtctaactgactctatagataatactgaactatttgcccatgctgttgcacctggtgtaaagcaaagtgcattcatgaatgtaggttccacatgcaaccatttctcctaatgtcctccaataaagctttaacaaagtgccaaattcgtatgcctttacgatttgaaatgaatgtctatccatgatttatcaatatgcaacaaaagtaaaacaagatggacttctttattttggccagtttctgtgaccacattgcacacaattagaactatactagataaccttgctgtcacctttagaccaattttactgtacataaagtgggtaaccctaattcaattatcaattcctcaaaccattgcaagtcacagctataggaaatcatcaacaaaattagttctgacctaaaagctttcaagaatcatatttagtgagccataaaagctcatgattcatgcactccaacaacaccagtagtatttatggttccaactcatcaactatttttctatgcaaaaacataaataataccacatctgtgaattataaaagaatgttaccaataactaacaacttagttcaatgagtaccaaagtgcagccacttttccatgatatctttcaactacacacttcgaatttgattaccagttaccaaatacagttcattgccatgctaccaatcatccatataatttttaaaaaggaactacattgtaaattgattttatcagtactatatatgcaacaaaagtataaataaatgaataaaatagaaggcatttatggatcatgtcggcagcccaaaagtcttccaggctgttaaatagttctacactgctatgttaactttgtcctgaaaattgctggactttggataagcataacaggacaattcaatgtaggtaatcagcaatcaataggcatgatgtacaacaaattacagagtgtcataccttgattgagtacaaaagatctgagaaattttcacccagacgctggcgcttctttgcttcctttacctccttttccctgagcctttcaacttgatcatcaaaaataagctgcagcagatccagcaaagataagtaacaatatcgacaaaaattcttatcagtcctacaactgaacatggaaattgttaccgcaagaacagcatcaataatacacatatattatcatcttcatcaaacataatcaaattttcagggtgacaaaacaataataccttcatgtttatgtttgttattcctttcaaagtatcatcctccgtaacagcagtttcgaaatcctctagtgtccatgaagtcgtcataggaatctaaacaaaattaccttgtcagccagatggcaaactaatttctacaggtaaaacttacctatggagcaagcttgtaaaataaaaggtacctttccagacttcactgcttctttaattcgggctttgtcatcttgatactgagataaaaggatggtaggtacataagttcatgcataacaaaaaataacagatattccagaatttaaatggtgattgtgatgagatgaaaatattgtagactcgtgcttttttgtgacatgatggaaataaaatttgttattgtgttttacaaagcatgagaatggatagaattaacatctttcagcaggaccaagatgtaggtttttgccatagttgctggccacctctattcactacagattttacttgccatgataattgcaattccaaattcaggcatagaggcaactatagcacattgatgacttaatacattggataagcaagagtatactacgaattttaaaggccaacctgtttctcaagctcctccattacatcttcaaacagatcttttggcattgaaccacttatgttcgaggccacagccaagtacacagaggaatctttaacctgtaaatcgataattttatgaatcaagaaaaaaaatgttgtcattttaatcgtatttataaaaggtcgatttcaatgacctgggcacagtaatcacgccaacgagtttttgcagtaagcattccttcagctacatgttcttccaacatcttgcgaaattcatcacgatttttgcgctcttgcctccttacttgttcctgacagaattgacttatattaaacatccatagtggttcaagacatcgaacaaaaaaaaaagaagtgaacgttatgtgaccaaaaaaaccttatgtatccgcttgtgctcttcctcttctttctccagatcccttatatactcctggattgcacagaaatgcatagttgaagcacaaaataaagaaagtcactgcagatctaaaaaaatactaacttggaaaatctccagtcgatcgatcttttcaagtcgggaacagcgttcatcatcctcaagacgttcttgaacttttctccactgggtacttgtctgcagcacagaaatatatatgtttctcattgatgaagctgtttgcatactaattgactaaacagttaataggagtagtaatgaaacaacctttatgaattcacatgactcgagaaaagctctatattctgctatgtgccttttgtgctcttcagcagccctggctctttcctataacaggatgatcgtagatacttagatcttgatccatacagtcaagtcatgccagaaaaatctctagttttgttcttagacatactaaaaaaactaagaaattgcagaataagattcccaaaagtgtattctacaaacagataagcccaacaccaattaaaatttaaaaggggaacagaatttctataagacagaaccttcttctgtagttccataagatagctctcaaataagtcttcacgctcccttggacgctcaacagcactaaaccgttcatcatcctcaaacatagttattgctttactgcataacattgaacacgaacaaacataaggcatcctccagcacccccacaaaaagttacaatgtaaacagcaactagaaactaacagtttggtaaacaaaattgcatcgaactatcacaggactgttattatgtatgaatagaagcttgaagtcagtggcgcatacctccatcttgttgatgaagtaagctccttagattcctaaaacacatagcagaaagtaaaatagtcagtatagtcaagacaaatgagtattagtaagggacataacatgagttagatatcttacttctagcatagctaaaaaatcatcacgtgccttccgctgtttgatacgtctttcttctgcttcaagctttttcctctggtttagatactgcaaaaacaaataggcctggcttcagtgaaccactaagtgaagaataaaacaatgcaatagaagacttcaacattccatgtaattgctaagacagattctagctcgtacaacaaagagctaacctcattaaaagcttgcttcctctccccaagagttttgagggcaccataccttttgtcatttatgatgaccctcatagcctagacatattatatcagtgtcaagcaattcattaactgatatcgattcaagtaaagttacatacctgatcccatgtccaatcagactcaacatttgatgattcaagcagagctttgaacgcatttttagcttcctataagtcaaaagaaaagtgtacctatatgagcttaaaacttgaaatgcacagtcaattcttaatatgtgcaagtttcccttaccaacttattagcataggtcacaggttcttcttcactagttttgtcttctactggagtaacattgatcttccctggaactgccatggtctttttggcctcctacagagaatataagcagcataaatgtacaggtatacacatataaacacatacatacagacagacacacaaacacacaaacacgagagtgagatatatcaaatgcaaatgtgtaggcacttagaagagcacaactgtgaccgtcggcatagcccaaccctaagtaggcctaaatttcttctaaggaattaaactcaaattgacatgcttctgtcaccactcactattccctacgtcccaaaatatagctacccttgtagttcactgagggagtaggcaggatgatttccttatcccaactcacgctaaccccagaaaaaatatccaagacttgaaatgaaagaataaagatgtagcaaatgatatttctctatttggagtaaatttcacaaaattacagatatattgaccaagctatcgtaaaactatagatttaatactaaatttatcacaaaactacagatttaaggtggagtattgcaaaactacagatttagtaacaaagttatcacaaaactacaagtttagcgcatatttaatcacaaaacttggacgtttataactcaaacataacattagtattaaggatttaaaccataaaatctttagttttgtgacaattttattattaaacctgtagttttgcgatacttagtcttaaacctgtagttttgtgataaatttattgttaaatctgtagttttgtgatatatatcaccttaaatcaatagttttgcgataatttggacaaagtatctgtagttttgtgaaattttgcatattttcttttcgtattaaacaaagcatacatatccatgtaaggaaaaaaatcagtgtttgcttccatccgaattgagtcacaccttgggatttgtattacagcaattcttgtacaattgtccaccctaacatacgttccaagtaagaagtagcatgtatcatggcaatattgcacaggatggtgataatagatattttcaactgaaaattcaccagtgtgggaataatgctcagactattaagctacttaacatgtagaatatatccaatcaatcctaggaatcacagataaacgatactgttacggcaatacggggatacgaaatttttgaaaaatgtggatacagcaagtatacacatatttcaaagcaggaaaaatatggagatgatatgatattgagattacattgttaaaattacaagcaatggcatgagaaaataagtggtacatttttcttacaatctcatactttattaggttcttaaatgactattgactcccatagaagtatcggtgttaccagagtacaggatttatcagacgtaagttcacagtaattttgaaggaccagaacatatgtttcacattaattttgaagcaccaaaccagcttgagctatcctaggggatctttagtttctttcacgagattacttgttcagataagattttgtttctttcaaatatttgagattaaataagactgttagtgcttctctcatctcttttcatgaggatttggcacagttttgaaatcaatgaaagacaagctaatctatcgcctaactcccattttctctagtgtctactctcccctgcccatcattcaacaacatagctccaggcagaagaggtcataactcaattatcatacacttgcaaatattaagaactcaaactataagtctagaaccctgtgagaggacaccacatgtacctccaattcttcagcagatgctccattttgagtgtcagcagtgctagctagagatgggtattcgttattggctctgaacaaatcatataacaactatattagcaacatttaagtggtgactggtgaggaagcattgagtaaaccatcgacagttacctgctaatccctgcatcacttgcaactgatggaatttctgtgcttataacaggagtaacaacggtacttggaccaccattttgcatggcagtattagatgaactggaggtgttctccatattgtgcgaagggccagcaccaggaggaacagagttcgctgctgcatcaagtgtacttggagcacccataatcgttgtggaggactggttagcaggtacagaagaaggttccacagagtttgaagtgggtccagaaggagcaccagcagttgtttccgtttcttgatcagggcgtggatttgacgccttctctgctaattcacgcgcaatctaaaagggaagaaaaaattgtttatagatatacaacaatattcaataaacaaatataaaatcaaacatcaaagaaggctgggaaacctttaactcatctggaatcgtccatttggattgctttgtcaccttattgtaatagtacctggaatgacagaataataagaaccggcaagaaagtgatttgtttaacttcatacagatgtgatagcatgtgttccatcaagaacttactttcgaccctcttgtgtagtaaattctttccattcagtagaggcatcagctctctgttacatcaaaaaataaataattaagaacacgtaacttttagcatagcaaagatgcagaatcaaagataaagttgaagttgtaatacgctaaacgttccatacatcatttcagtaagaaactaagaacatgcattgtcctctcgtggaaagagtaaagagttcattctggaaatagaagtagtcaatatagtgatgaattccaattcaccccctttagactttcaagatggtccaaattgaataagcccctcaactttaaaatccagtgcagtttacaacctgatggtggaattggtagtagcaataccaatccaaatggtggctatatcagacaagtcagcaaaagcccataagccatgaaaggaagtcattgcacatattcaggaaattcatgtaaaaataaacacaaatctctctttgactattcctcctatatctctcctctttctattagatggattaccaattaatttagcaacttaaacttaacaagaccaagatgccatgtatgtgaccaacatgacagttgcttaggaaaccacaaccgaagagtgtttagtacttcctttcaaagtggagatgagtcagtaagcagttttgtagtgcgtgttaggatatggactattgtaaagtagatggaagtagaacagaccattccataaattttaagagatagacagaacaccctaagggaaatgtaacaagtcatgacatgtttagcatataaaaaattaaggtaaccgaagaatatatctacaaaaaggtaagtgtagatgacacataagcacacagcacaactaacctccaacggtgtcatcaactcagcaggtttctcccaacttgattgccttgtcttcttattatagtagtaccttaaaaaggagagaaatagagaaagcaaccaaataagaataaaggtgaaaacttgcaacacaacaaaagatactgagcaccaccagaaagttaataacaaaaggtaagtaggtaaaatgattcaacttactttttcccatcagctgaagtgtgctcttgccagtctgaagagctagtttcgctggaattgatctgttcatttgcaaactcaattattgcaaggtaaggatgtcatatttgataaagcacagtagtaaacttaatacagaaaaataaactgattcagaagagatcagtgatatttactgaaggcattgtagcggaagatgacatcggctgatgcccaggctgcacaagaggtacattctgacctggagctgtaccccaagattgcactatgggaggaggaacagatgatggttgatactgcagtgtagcctatactagtatcagtaacttatcggcaaggggtggcattcaagatccggcaatagctttgtgaaattaaatacatatatcaaatgaacaaatagaatccacaaagtgcaaggaaaaataggacttgccgtataggatggaggcggtatagggcctcccatggtgggcatatggcctccagagaatgtcgctggcggctgcagaggcccagatgacataggtctagctggctgataagccataggaactgcttgtgatgcaggtggaacttgaccagagtgaggcaagtgctgtgtaggttgctgaaaatgtggcatctgacctggcatgccaatattagctcctggcatggcctgaccaacaggtcgaaactgctgccccggttgcatgaactgaggaggttgttgctgatgaatcaccggcctaaactgaaattagagaacgagatgacatattaggaatgtaaaatatgattaaaatggtccatgctgtggatacaaggggaaaattcaatcttccagtttacctgcataggcatcggaggtcccagattttgtggtgggacactagagcccatcatagggggcctagattgctgcttgagagagagagaaagagagaaagaatggtaaaaaattagcacatcacacgacaaaaatcaaaacttcacactgaaaactgccatccttaaaacaaccagacaacatttacctgcggtggcccagaaggttgcatattacttgccatcaaagcacatcaaaatgtgatgcgaaaaagaggaaacaagtttttcctaatacagtggctgccaagtgacaaggaaaggaagaaaatgacgggttaggacattaaatgcttacggatcgatcctcttccgaagataactgcaatatttaactaaactcaataacaaacttgctctgccagctgcactttggcacagtatttagacacaaataacgctgtgttagtatttagtaaacagggtaacggataccggcttttggatccttcctctccctccctctctcagcgacagaagcgaaagaagagaacttaccgttaccataaaaacaaacatgtcttatatacatagccaatgagctaaaactagatatcagtccagtgacctactagcgggtatagattagacatttgaacacaactggtctcctaaaccacatgccctcatatacatatccatgaaaacagatttcaaattttatctaagcacgacccccccccccaaaaaaaaaaaactaagggaggatcgaattatcagaacaaaaccacgtctcgtgttctgaaaaaaactagggcagggacagatgattccgctaaaccctaaaacaactaccgggagcaaatctatatgatggataagggcgattggtgcctatcaacgagaacagcgaaacgaacagaactagaaaagcagagctagggtttcgttactcttaccgcggggaaggaaatcaatccaggtccggatccgcgccacttccagtagaacggaggacgacgacgacgccgtctcaaccacgggagaagacccacccgagagaagtaaccccccttcgattcggggtggcaggagcgcctcggcggaaggagacctagagggcggagcgggttccggcggcgcggggcgagggcggcaaggagcccggcctcggcgccccccctgcgagattacggttgccgcgcggcggcgcggggcgagagaccagtagcgagaagagagagagagagggagagatgcggcggcgttgtctccacacgccggcggcgagggcggtgtggggtggggttggggttttagggcaaaaagggggtgcgggcgccgagtcgggcaaagggcgggcggggtggggttggggtcccaaaccaacgggttaccgatacacacacccctttcctgtctgggaccgtgggacggcgcggggtatgtatgtgtcaatgtcatgtattgtatcggcgagggagagacgctgcttggcgttggatggataatagcaggcacgcgacgggagttttttgctttgggctttcggagtcgcgttcctcgcctcctagaaggaataagttcactccaggtccctcaatttgtcgccgagtcttgaaattcgcccctgaaccgaaatatcaggtgtacctcatcccaactcacaataccatgtcaattttggtcactcggcagtaaagtagttgtttttagctgacgtgatgagtgggacccaagtgggcttgtcagcagccaactcgtctccctgtccctttcccttttccgtctcttcccatttctcagatactcaagcatcgagcagggtagtcggtgaggagggggtcacatacgatctgtagtggtgaaggggagggacttcctcatcatcatgcgcgccccgactgtgcacggggagtccaccctgatcatgctgagctgcacctatcagagcatggtcaccatggagaccgtccacatgggaggcgacacggggatcgtccctctcatggtggaccccgtgaactacgacgtgttaccgaaggtcgagtaggagctgcaccatgtctaggccacggaggacatggtggtcatgcgcaccgccaccgagcagagcaacttcaagctggttgttgccgtcctcgaaaagcgtcatggcgtgctcaagtcacgcgcggaggagctatacgacaaaccgcggtccgtgacgtaggcagccgagctaagggagatgcaggacagggtggtgatgcgtcaggagatagaggactttggtaggggcttaatgtgtgagaaaagggataggaaaaggtggaggaatgggttcaccttgacgaggtggagttggtggcgcgaggtttggccaacggggctccggtgagggagatcgaccggcggcagcgtggtggccagacatggtagagagagaagacaagagctctaagagtttggttgtgggggaaaatggagacatcgttgtctcttataggcagcgaaaggtggttgcaatggaattcgctgatgaggacacggtagtggcggcttgagatggaagaaagcgacgccggcttcgtcttcctattggttgcccatggtggttcggtttggtgacaaacaacggatgacgtcggcagggtgactcacaactgaggttgggcagcggttagggctgtcaacgagccgagctcgagcgagcttccatgtgtaggctcgaactcactatagactcgagtcgagctcgagccgagtctaggtttgccacgagcttgaagttgagctcgagctcggctcgttcgagcttcgagcttttctcaagcctgtttggtgcggtggaatactggaacaattcattccattcaaagaaaaagctgacactgtgatgcatgattagacggctaaggccctgtttctttcagcttgggattattataatctagattattgagtcagattactataagctagattgttataatctatagtagaataagcggttagttgtttctttcctagattattgggtttgcaagtctaaagagagagtggggtggcatggtgggtaatttttcacccaataatctggaaaaaaactcacctaaatgagcttatcagattataataagctgggctccagattataataagctacttcaataagttgtctgtttctttcagcttactcccaataatctggattataataatcccaagctgaaagaaacagggcctaaaagtaatactagtgctcctatgtatactaatgcaactgtgcaagccgcacactagtactcctactctcttgttgggaaatgggacaacaaatgcatagtgctccctctgccctggcactgccagtacttgtgcagttgtgctactccagtactactagagaatttgaccgagtaagaaagagagagaaggggaggaaatacctaggagaaagaacatgagccagatgttgaggctcgccgagttattcgagctcgtgttggtaggctcgtgagcttaaagtcaagctcgagctcggtttgattcttagacgagccgagctcgaatcgagctcataacaa

SEQ ID NO: 13914 - DNA, 2766 bp, Oryza sativa
  unsure (1)..(2766): unsure at all n locations
attcctgcagcccgtgagttgaaggatatacctggtatttaggttttgggacaaatttctgacccgacaacaaattaagggatctaaattgaacttactccctcctagaaagagataatgagaatatatggtgtggactggaccgagattagggtttgagcaggcttaggccctctttgtttaggcttagaccctctttgtttaggcttataagttaacttataagccgaaaaatctaagcctaaacaaacgagcaaccttttcatttggctttttaaaagccataagccactctaacactattaagccaaaagctagattagagaagcttttttggcttatgtgaggtagatgtatggctccgccactaaacttaggacattaatccaccgacttataaatcatataagccaataagctgacttaaaagtctaagcctaaacaaagagggccttataagtcaacttataagcctaaaagtctaagcctaaacaaacaagcagctttttcatttggcttttttaaagccataagccactctaacactatgcaaaaagctaggttggagaagcttttttgacttatgtgaggtagatgtattactccactactaaacttgggacattaaatccatcggcttataaatcatataagccaataagctaacttaaaagtctaagccaataaacctaaacctaaacaaagaaggccttagtgcatgtgctggtgccaacttgccaaatcttaacaggccatctaggatgaatttagatgattaaatgggcttagtatatataaattttatcttactaatgggccatctaatggtgaacaggatggttaaatgggtttagtatatgtgctatgtcctttagcacacttgccatattgtaacgggctatctggtggtgaatgggaatggagcgcactccactgggctcaactgaggatgatcttagcatgctaagcattcccagggtgaaaaataactcgtcaggttctagccctactagactcggggggaggggggcattgtcatcgctaacctcgtagcccgtaagcctttgtgagttcactaggcatccatggaaaaatacttgttggagctgctatggttgtaagtgatgcaaaacatgtgaagtaagtgcaagtgcaagatgttgaatgcagatcagcagtaccacatagagccatgtagcaacaagcttacaatattgtgagtctgctatggtaactgacgcataatgttgtagaattttttttagcaaggctagttgatttataatggagtagcttttgcaccgtagcgaataatatgaacatcaaatgggtaggaggagctcctcctatggcatttgactttttgtcttttgcagtagtgtgttaaatacatcccatttggaacatgttcgtctagccatcatgtcacttcagtgctcccttctaacaaatgagctaggttgatgcaaacctagctagatcaaatgatatattaacacgttgtcaccctttgccaatagtcgcattatatgctaaagtcaataatcatatcagatgtttaaatagttaatattgtggttggaggatatcaaatttatgatcattgtagttgttggttcataatcattctcctaccactacctattgcatatcatgaatgaaggccaaccaccactaactgcaacaaggttagttggagggaaataagaggaagaggcataaatatatagactttgtggtgatgacaaatatcatgaaataactagtacaacgtatagaagtttggttcgaggagaaaaaagaatacaagaataggaatgtaagagcttataagatgagaattgattgagcttaccggaaatttccttattatattattttcaagataggagttatgctaaacatagcaaataaagggtcaagttagagtctggtggtttctcggtcaataacttaaatatagtatcaaatacaccttaaataccctaataaagcatatcaaaacaataagcacacccattaaaggtagctctctctctctctatctatctctctctcatgtggaacaatagttatttcttcacaaaatcttccttgcgtgatgttgcttaggggtgttagtcggttgccattgccataaacatattgtggaaattcatgaaagaagctaacaaatcattatctaccaatctactttgttggagcatcacatgaggatatggcggtaggctcgtgatagtatagcacttttagacatactacatatatagttaacatcctagccattgttcttcactttgctatagttgtttgtgtgcccttcgacactattcaccattatcagctccacatcatcctacaacattgtctaatatttcacgtaacaagaccactaaatacatgtcttcctatgcttgcaagtatacccatcgcaaacaccaaggattcctcaccattccttgtgtgtccatgtattaattaaccccatgcatgactcacatgtacatttgagcaacatccatttattcatgtcttggtatggcacttgatcaatttagacacagtcaacatatacttatcaagtacacatgtcctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13915 - DNA, 600 bp, Oryza sativa
aaacgcctccagattcaagcaagagttcgacgcgcggtgccgctcgatcaatgccactcagcgaagacaagaacgagaggaccgcgacacgaaacaccaagcaaacaaacatcaccaccaccaatggagcaagatcgaagaagagtagggagaagaatctcacggcgctttcggagaagtagggtttagggatggaggcggcggacgaaaccacagaagaggaggggaggatgaagtgagagagagatctcacctcccacctttcgccgctgcgctcttgacacccccgagagagagagagagaggagagatgcggaaaagtggttgtgctgcgaagcgcaaatagttgtgcttaaatacctggatcgtcgacggctgatccaacgtcgaggagtgcccccatcctgtggctggtggtccccacagatcgctccccctgcacggacgtatctcctccgtcggttcgtccctcgcggctgatccaacgctcgaggagtgcccccatcctgtggctggtggtccccacggatccctccccctgcatgatccatccacatgtaaattttcaactacccttaaaaaaaaaaccaatcccaccta

SEQ ID NO: 13916 - DNA, 945 bp, Oryza sativa
tttttgcacgcttagggacacacaagaaccaaccatagaaaaattgaactcaaatagacgtaatatgtgacatgtagaatttttcctctcctctcctctctccgaactagtgcagaggagagagatgtgcaacttttttatttttatttatttttttgatatttttttcacacttagaaactcacaggaaccaaccacgtaaaaaataaactcaaacggacgaaatatgtggcatgtggaattttccaaagctccaccgaaaaacttctctcctcgaaaacacaatcttgcaagcggaatttggaggttttaatatcgccgaacccggcaaagcgggggagaatcggatgtaactttttctgtagatgtccgtgcatatattatttgcctgattccgagtccgtatgagaaagttacgcctattttaatagatgtcatattttgtccgtttcggtagagttttggaaaattctacatgtcacatattttgtccgtttgagtttattttttatacggttggttcctatgttctcctaagtgtgaaaaaaatatcaaaaaaaaaataaaataaaaataaaaaaattgcatctatatgtactgtttaacttatatatctcatttcatgtggttatattttgaattagattaagtaatttcatatggtggtagagtgcattatgtttaacatgctgatcaaaggattttactaaaggagctatggttatggtctaattttagtgaaggtgcaaagtagactaagtggtatgctagatattttcagacttagctaagtggtagttcgagtttaattttttttttggttgtatcatgatcctgagtgtgaaaaaacatccaaaaaaataaaataaaaatgacaccgttgcaactccatacagagaaacaggaatggaggcggcggcgccagccatgctggcgccctcctcc

SEQ ID NO: 13917 - DNA, 689 bp, Oryza sativa
ctggacctatcttgggccaagattagtccgatctggaaactgaacatggctctgcaggccgctgtgccagactaggccgaggcaagatggcctttacaaatcgagcgcataatgctggtagccagaaggggggcaaagcccagctttgcaatggcagtagcaacagtggtacaatgcaacacttctatattttagatcctcctgtcaatattagaacaagttcttaaaactttgatcaccttcatattaaaatcagtttatgaaatatgataacttcatgatattatgatattatgatagtagtatctttcaagaaaaatctatgcatatcttttttaagatcaattttgctacatggcattgtgacttcacggtttttacgtttgccacaggataacttcatgaagggcagctcgagatggagatagatagatgggaaatttgacagtgggctcatgggactttctgagctttcatatgatttctttcttctattcaattaaataaactagctgggaggcccgcgcaattgcgcggctagcatctgtacaaaattatatattttttacatatgattttacttacattttgtcaaatagttatctcgttgtcttaagactttggactgaaccttatcatcccgatgtttctacttttatagtttatataaaagtcacgtcagtcgctat

SEQ ID NO: 13918 - DNA, 5865 bp, Oryza sativa
  unsure (1)..(5865): unsure at all n locations
atttttacaatatttagatgtctcgtcaaacactgctactgtagtctctatgctctacggttcgtccactgcctctctttattaatattaatattgagattttaaaagtcgaacataattatctagaatcccgtcaaacgatgccactgtactcctctacagccggtctattgcctcctctctttattaacattgagattttaaaaattgaacataattatctagaagtcccgccaaaccttcagcggctttgccaatgtactcttctatggttcgcccgttgcttcccctctttgttattattgatattttaaagattatacatgattattattggggtttgtttttttactttctagaagtcctgccaaatcatcagtggcaaagccactgtactcttctacggctcgcccgctgcctcccctcaaccattgtgaacattctacttaatgacatgtctatgttcctcctcttaatcttaattgggattctatttggagttttgtttataatttttagatgtcccatcaaccatcatctctactactctacaggcatgttgcttctcatttttattatcgtttgtcattgttgtattctagattgtccttttttttaaaaaaattccatatttttcattctagcattttttatttataaattgtattcctgcatgaactcttccataatttttagaagtcctgttaaacaccgccactgtacttctctatggggcagccactgcctcctctctttattatcattggggttttaaaaaacaaacataattatcgtgttggttcagcttttactttctagaagttctgccaaaccgtcaatggcttagccaatgtactcatctacggctcgcctggtgcctcccctccttattgtttttgatattttaaaaattgtacacgattatcattgggtttattttttttactttctataagtccaaccaactgctataaccatactatccgccgtccctccttttaatcttcattgggattctatttggtttgtttttaatttttagaattctcattaaccgtcaccactctacttctttataggcatgaccatgatcaaactatttagattttttttaatccgagaatttgtaagtctcgagagcaaacttagagacttttttttacattactttattaagataatagatagaatattttatttgtatataattatatcaatcaatatacaccattaaaatctagatcctttaaatacttcacttttttttaattaatatggtgatttccgtccgcttctcagctctgccccattctcggagtatgagctataacatatggaccctaaatatagagaaagctattgggaatcttgttacttagaatttatttttttctaaaaaacataccgtctctaaagattatgcgatagagcaaaacttaaatatggttgaaggagttcggatgcccagttgttttatctcccctacatatgattttgtacaggacggtcagttgtgcatatttattatttctaatttagctatgcagacatgacgtgtttgtctcctgtcagtaaattaagtttcctaatttgattttgatttcaaaggctgctgcgtagcacgcatcaaaatctaactccacgctctttcacgtgtccgattcataaaaacagaatcaaagagtcaagcttttacatatattgtgattaaatctcaacccttgtagtctagatatgttaggatctaacggtgtagattttttcttttccccgattaatgtgggaatttctagcatccacctgtcttctttcaaagctgttttaataatataatagatagatagatagatagatagatagatagatattctatggcaaaatttgctacaggatatcaaaaaacatgtaatgtaattagctgtagaacatcgaaaaacctgactcagctataggacacttcaaaaatgatataatttgctaaaagactctaaagccattattttattatttcttggatcaaatggagagaggaattttttagaagacggcaatgccctcagacctctctccttcctcgatcttgtctgcaggtaaaaaagagaaagaaaaagaaacaagccgtcgttgcacatggcccacacaacaacatactccctccgtcccaaaataagtgcagttttgcactattcacgttcaacgtttggccgttcgtcttatttaaaatttttttatgattagtatttttattgctattagatgataaaacatgaataatactttacgtgtaactaaatatttttaaatttttcataaacttttcaaataagacggacggtcaaacgttaggcacggatatccacggctgcacttattttgggacggaggtaatacaacggtgtttcggtgtcctccatggaggaccaccgtggcgagggcaatgatggcggcattcacatgatctctgatgatcgcctaaaacaccctattgataaattgagaacaacacagattttgccaccaatccagctgagaattcaggatggagggagggcacatcaggatggtgttgatcatgatgaggctgaagaggaggaagaggggcctaagctggagcacgacaagcatgagagacactgcatggctggttccgccgcaacttccaatctcgggtcagaaggccgagggggcaaaaggccgaagattttggtcgtctgctcaccccaagcgccctctccacctcatccagtggggggcggtggctcagcgggtggtggatggcaacgaatctgccggcgacgagaggagacgaggagatggacacgatgaagaggtggggtgaggcttgctcgctcctctggaggtttttcatggggtagctcgcgaggactatgccgtacctcatggcagtgcgtgggcgcatccctcctcgtcgttcaacatcgacgcatgatgccgtctccagtgctctgccacggacctgtcctctgcatagcgccatctacgttgtcgccgcaagtgctagatggggggagcgattcggctctaaagggcaaactcgtattttctatgttgtttctccatttgacctaaaaataataaaataatagcttcaatgtcctctagcaaattacaccttttttagagtgtcctagagctaaatcatggttttacgatatctcacagctaattacatatttttttggtgtcccgtagcaaattttgctttttctcggagagatttatacgtggttggctgttttacccacaaaaatcctcatttttttttcacaaaatatacgttctccagcgcaaaaaaaaatatcgtgtgaagagatttacacgtggttgactgttttactgagctcctctttgaaaaaaagtctatttgtccaccctcatctctttgggttatctttgacatggcttgactaagtctattcctcatcttttggaccgtaccttaggaaaaagtatactttaactcccccaactatcgcccgagtatgattcatgtcatttaaccacaaaaccaggtatatcgacttctccaagtattaaaaccggtgcaaacaatgccacttgatggttttggaggtggttttgtctggcgtgacgcctacgtgacggtcttgaccaagtctttgtcctatatggcattagaataaaaaataaaaaaaatgtggaacccatatgtcattcacacaaataaagtattgtgggacccacatgtcatcctccctttccttcccttcttcctgctccctccctctctctcccttatctctctctctctctctccccaagcctttctcttcaccttgggcggagcggcggtgtggacggtggtagggagcggcggcggcggctgccaaccgaagcacgagctcttccccgaagcacgaagcacgagatcctccccgaagcattgtttgcaccggttttgatagctggaggagtcgatatgcccggttttgtggttggaggacatgaatcatactcgtgcgatagttgaggaagtcaaagtataattttccctgtgccttatatgtccgtaataagtctattttggctcccttatcgttggaccgggccaggtcgggcagcccatcgtgacgaggcagaggcctaggcacagcccaaaggtcaggctgtgccatgcttgggctagaccagaaccccgtgctatgggtcaggccgtcgggcctcgagtcttttggctaactatagatgaggaacaaggtgagcaagcacttaaccatttcattaaaattgagatctttattatttgcatggaaatgagctgaagaattgtgatctttgtgtttgcatggatatgaattgaagaaggataatattatattcttggagttcccaaaaggacggtccaatggccgatgaaggcattctttgatgctcggtttactaagttaataaggtatagtctcctgcttaatctgagttaacaaggtgaaccgcaagtgctacaaagtttcatattatgaaaaatttccagtttccatgttcttcgcttgctaaatgaaatactccatccatccctaaantattgacgccgttgactttttaaaacatgtttgaccgttcgtcttattcataaactttttgtgaaatatgtaaaactatatgtatacataaaagtatactccctccgtcccaaaaaaacaaatctaggattggatgtgacatattatagtacaacgaatctggacagagatatgtctagattcgtagtactaggatatgttacatccagtactatgttggtttttatgggacagagagtatttaacaatgtatcaaatgataggaaaagaattaatcattactttttttttaaaataagacgaacggtcaaacatgtttaaaaaaatcaacggcgtcaaatatttaggaacggagtattatatagagtaaaatgcactagtggtccttaaacttgtcatgaggtttcacttagatccacaaacttgcaaagtgcacatcgaggtccctaaacttggtttatcgtatcattctggtccaaagcgtcgtttgaccgtggtcttgcctatgtggcacaccacgtggatgatgacatggtgtttttttttccttttccccattttctttttcctcctcctcttttatcttcttcctccactggagccacgtcgagctcccccgtgccgaccgccgccgtcgtcacgtagcgttgctgctgtcgaaggaagaggctgaagaagagagaaatgaaagaggaagaagggagaaaaaagaaaaaataataataatgtgccatgtcgttgtctacatggcatgccacgtaggcaagatcacggtcaaatgagactttggaccgggatgatataataaaccaagtttagagacctcgatacatactttgtaagttcgtcgacctaaatgaaagctgcttacaagttcaagaaccaccggtgtgttttactctattatatattacaactttaatggagcagtttgttgccaacaaatgctaggtatgcacaaatattcattcgatctgttttcagtattgtgtcgcccctctgcaactacgtgacttctaatttcagcatgattttctttcaaaatgtaaatcatatgaatatttacttgtttcttagtttcttttttcaaaatatatcagggagatataagataattattaatatgttagattatgcactctctgttgctatgaaactacaccaccattggtcagacgtatcaaggatttctaatatctgtttcctaagcaaaggagaaaacaaaaatcattaatgttttcattcctatcaccgtatgattatttctacacttgattattttgatatctttcattcttgtatg

SEQ ID NO: 13919 - DNA, 9641 bp, Oryza sativa
gaaagaaaaagaaaaaagtgaccttggtgaatcacattgaaaggggggtaatggtagtattcgtgcgtgtatttttgtccactcttaaaaatgattcttgatccatgcatatacttttttttcttttttttttaaccttgatggaaggaacgttgaatgatttgttggtttttgcgtcatggaatgaattttgtgcattaactgattagctaagttacttgttgatcatacaaggaattaagggtgtgttcgctattcctggatcccaaccggatccctccgcacgaaaaatggagcgatctattagcgcgtgattaattaagtattagctaatttttttttcaaaaatagattaatttgatttttctaaaacaactttcctatagaaacttttttttaaaaaaatacactatttagcagtttgaaaagtgtacgtgcggaaaacgagaaagatgagttgggaaaaatggtatccgaacacaccctatgtgtgggtatcgacgtattgatgtttttaaaaaatcccatatcacgatatcaatgtatccatatcgtcgtagcagtatcgcgtatccgtgcatcaccaatggcggatacaaagggtggtccgggtggtcccgggaccaccaaaaaaagggcgatggaaccccctattaattataaaaaaaagaaaatagcgacaattgaaaagaaagaaaagaaagcgacataatccatattccctaatgccgacgcgctattccctaatgatggctccagagaccccacacacgcgtatggaatcgatctgatcgacgcgatcacgactctctctgacgcgatctctctgacgcgatcacgactctctgtctctctcctcatcgccgccctagcccgtaggccgtagcaactgccctaggccctagcctggctagcgacgccgacgagccgacgagaggagagacgacgcgtcgacgccgcgacggcgcgaccacgcgagcagcccccacgcggccacggccacgccgccgcgcgcgacgccgtgaccggcgacctgctgctgtcctgctgtctgctgtctgtttaatagtgttcgtcagttcgtgtgccgctggacgccgccgcgaggagccgtcgtcgagccgatcagccgcccgcgccaacacaaggtaacaattttagttttaggttttctaattgtccacctttttcaatttttagttttaaaatcttaaactcttgtgcattgtgagattaaattgtagtattatattgtagattgttgattgttgaatcatgaagaaagatggagttatcgtatcgctttttctttaaagtggatgaagaggatataatgaacactttcatggccattagaagacgtagacccgataagaagaaaaagtaatatggtaattttctttaagctttcatagccgtacaagcttctttaaatcaaaattttacttaattactaattttatatattttaagatgttttgttaatatatcatggtaagtttttgataatttgatctattttattacttatagttacattgtatatattagtatcgttaggtttactgtgtttagaaaaaaaattttaggtcggaccacccatatcctaaattctagatccgccactctgcatcacaggtgaacatccattgactgatcgacgtttgccaataccggtcggaaatttgaagatcatattaacatgccgtgttgttgttgacattgcccaagtgcatgcccacgaaacttcgaggaagcttcgtagatttgccattcacggcgtaacggaacaccggaaattgtcttaaaaattgtcaccatccacatgcgtatccatcgtcggctggaacaccatggtcggctggaacaccatggtgctggaacaccatggtcggctggaacaaattcaacttcccgtatcctagttgactggaattgaaggtacaatttccaacattcgcttccaaacaaggcctataaagtcccatcccctcgacctctcgccattgtccacctgccacgtacggcccaacccgccaccgaattcgattgctccagtgaccatggacgacgctggcaacagcagcaaggaggcggaggcgcaggcgccggcgccggcgaaccaggcccctgccaccgccgccgccgccgcccgcggcgcgattcatcgcgggccgatgctgcgcctcgccgcgatgcagctgatgctgttcgcggcgtacgagatcgtcagctcgtacgccgcgccgccagtggcgcttccccgcctcttcgcggcgttcgtcgcctggctcgtcggctgcctctcgctgtttgtcgcgccgccctgaagggctgcacgtttcatcggaggttgaaagcatagccatcaggtattcaggattaatctatcagcatcaatcatcagcggtagtgtggtgtaacggggctcgttttttgttttttttttcttctttatgtggagtgggagtatgacgttctgcaggtttatttatgttgaccactcgttgtttattcggacttgtttgtccgtttcagcagtaggctactgttaggctgcctgtatcagatttctctgcacatgagagcaggtaaaatagcatgctattagccagctataaatatattttaatgagataaaagataagagagaagagcagcgggctacagatctgtagccagttacagcacggactccaagacgcagtgtgtatatgacaggtgggaccgtatattaatagtatagtaaacaactattgtatgaattgactattagatcggctatagatgaattggagcaggtagtgggctatactattaaacttgctctgacgcggcttaatttttttacctcaaagcgtttgatctaaatgcttttttattggtcagtgtgagtgtgacagtttatccggctacgacgcagcgtcgcaggctcgcagcgctgagcagcagcagcagagcccagtgttttggccgagaccgagcgtccccggccaaaacagtacgagcaaagctgatgctaactagtactacgagcaaagtgtgacagtttatccggctataattctgtcacgagcaaaaataaaattgctactccctacgtttcacaatataaatcattctagcattttacacattcatactgatattatatgtctagattcattaacatcaatataaatataggaaatactagaatgatttacattgtaaaacggaggaagtatacgagagcataagaaacaagaccaagcaggagggcgatctagatcaccatgccattttctgcaactggacatgctttggaccaagcttgtccgatctggaaatagacaaaggctatagatgttgttgggtcagagactcaggccgaagccagataaaccgagccccgaaagcccacataaacaggggggcaaaggcagtagtagcagcggtattaaactgtagtacgctaccgttatgtgcaatcggttttgttaaatcatattcaacccgcaaagacagaaacatgcaaatcaagcaactaatgtatatcaagaacaactggttggatgagcttgcagcatcatgcaatttattatggcacattcctcacatcagactgaaaaactgattcagtgattccacaagcagaatagttctacacaaccaaaactgaacttcaaaacatatgggacagtatcaggtatatctacactgagcttcgatatctccgcatcccgtttcccagaaaccatcatcactagttcactcagtcttcaattatcctttttttaaaaaaagttcactcaatcttgattctcgatcagcttcttgactatgcttttaagagctggtgcactagcactgcacttctgatcgacgaagcatgacctcccttcctcagccgccttgcatagctgtggatccatgggcaccttgccaaggaaaggtactcccatttcgttgcacattttctccgcaccacccttgctgctatcaaacacctcgctgcatgcaaccattgtcaaaagctcaggagctttctccttgatatagttcagcgcccattctgtagcatccatctcgcctccctcaccttgcttcacgaatctgaaatctgagagaacctgccgcaagccactcatgttctccacaacacctaagatcggcacaccaaccttcttgcagaaatttatttccttccgcacatcgattagagagacctgctggggagtggtcacgattattgcaccatcaattcctgtggcttgaaggtactgaacgattgaaatatgttcatctgatgtccctggaggagcatcaaccacaagatagtcaatctccccccaatcgacatccttcaagaactgtttgatgagtccgttcttgcgaggtcctctccatataacagcatcatctgggttgggcagcatgaaaccaattgacatgacaccaaggttggactccacatagactggtgaccaaccaaggttgctttgatgaatatcctgaccttcaaggcctaacatttttgggatgctagggccacatatatctatatcaagaaggccaacctggcagtccatttcagcaagggcaaatgagagctgggctgaaaatgtactcttccctacacctcctttcccagacagaaccagtatcttgtgttttactgtagccatccgttcaacaataccaaccaagtctacaaacacaatcaggcaatacaatcaataattatttcactgtgtggacgaaagcagcagtaattaatattgtctatgaataacaatcggtcatggctaaaattaggaatgcgagaagtacgtaggaaagaaacaccaattatattcatgaaagaatttacttgttcaactacaatttttgtaacatgaacttgtcttcctaggtgctcaatcacatgagttccttttttaagtggcaatactgctgtgaaatattttcatggataagtggatatcactagatgtgttctccgtattgggtttccaacaaagttttttctttaacattcttgatgcactccattttttgtatgttaaacatttaagtatttccgagtgccattctatttagaaaaggaggcagctgtgtttcaactttcaggtgggacaccagatcatgcacttccatttctttccctctttaatgttacactcacaagtaaaatgtacttcctgacagtacattagatttggaaaatcagtaaggaccacatatttcttcatgggtttgggattgggtttggctccagtgtagtaataaactaatgatcatcatgctttcaatgtcagccccaagccttgctacctccatcactcacgttgcttctgtttttttaaccatctgaactatctacctaagaacctacaaggtgtttggttgtactgttatatatgcaataaggtagaacaatagatttatgaaatcacataaaaaacactgaagacatatcattgtggtatatggcatcttcatgcccaatataaaacatcagaactgacagaacaaagctggttggtaaatatcaaaggtaaaaactatccataaggcatagaacacaatcaacatgatccagctttggagctggtagattagagcattgggcctcaaacccacatcgcacacacccaacaaaaccatacaatgagatgaggagcataataaatactttcatcccgctcctatgaaaaattttggatgttgactactaacaaccccaattttcttccttcagcttcaactgctcaacttattcatacgagtgctcttgtaagatgtatcaacagcgaggaataggtatctgtgtgcctattaattttaattcatccatctcttttccccaaaattcacaaaacaagacacaacaacccgaaatctgataattttaagagaggcccaaactgaaaacactgcagctatgtggcacgaactaaattaactctaaactatgatatatgcagggaaatagcaaacaggtatcgcacaccccagaaagaacgatcacatggaaaaattttgccagaacacggtacaacaacaattggtcaagttaccaggatcagggcccttgggggcggtggcgcaaatctgctggttggggcatccggcgcaggcatccgccttccccgcctcctccgactgcgtcccagggcaatctgcagaatcaaacacttatcgttagggttgcgcatagcagacacccatccctttttccattgcaaggcgatcgaaacccacaccaaaccgaacggaaacaggggggaaaggtagcaatcgagtcttacgctcgttggcgtccgccgggacgtcgctcttgccgccatcgccgccgccgccgccgccgttctccatctccctcgccgcctccaactccgcctctcgagttctcgttactttctcgcgaggtttgctgcctggtttggggacttgaagcctagagagcgacggaaatgaggagaaaaggagtatttgtgagagagaagggagaggctggtcaaagaggatatggagcgtccgattgtgatcgaacggtccagataccggttgtcaaggacaagtttgcatctcgtattctcgttgcatatccgtcgcgcgcgctctctctctctgtggattatttttttccgtgattttttttcccgtggttgactttattcctaattaaaatataatggatgatttcatattttagaaaaaaaaaacgaggtgatccaaagatattttaactactctagaagagcaaataatggacccatcgtagtagttggcaaagtatgattcgaccataaatactctcttgtttttcaaaatccaaaataaaatacagtcacaccgtgaaactataattgggtctagaaaataccaagacttttaggatctgcttggaagattagcccagagctaattttgaaaggtaatatttagtcaggaattggtaggctaaacattagcctagggtggtatgtttggatccatgggctaatttaaggctaaaaggtggagagagagtagaaagagaggagagagaaggagagagagaggtgctttttgatggtccccacataaaattagccccattagcacctcttggaggggctaatgttttgagggaggctaattcacattagctcaaaattagctcacctgtttggatccttgagggctaatttgaggctaaaaggtgaaggataaacattagcccatgaaaccaaacagagccttatgctttaggattggttgtgttcgggctaattggggcaaagaagataaacaactttcttgatctggtcaaatccatcatttccccaagcatatttttagaattaaacttttcacggacatggacccatcaacatgacttggccacaaagtactttctttattctccacaatcaaactcacaatatatatataggccctgtttagttccttaaatttttttcccaaaaacatcacatcgaatctttggacatatacatggagcattaaatatagattaaaacaaaaactatttgtacaattaggggaaaaatcgcgagatgaatttttttagcctaattagtctatgattaactatacgtgctacagtaacctacatgtgctaatgacggattaattagtctcaaacgattcgtctcgctgtttctagccgagttatgaaattagtttttttttattcgtgcccgaaaacccctttcgacatccagtcaaacattcgatgtgatatccaaaaattttattttcgcgaactaaacaggcccataaacaggttgtgaaaccgatagacatgataattgggtcccacgaaatattaccaaaccatcaattagtatactcaaatatagaacatttttaaatattatcacatctgttctaaaatatagtaacataatactaaataggacatattaatactacgaatttgaaccgataatgtgtcacatttaattatatgtctttctctggtcatataatcatcctccccagactttaattttcactataagagctagttgatgtcgttcctggtatctaaaggggataaggcggcaccatcagctgcttaactttgacttccagtctcccaccacttcagcttgaagaagtaaacatgactgataatctggcatgtgcataagcgagtctgtatagattaatgatagataccctaacggcaactgtatggttgaaaaagacataaatattagagaattatctaatatcaaataattagaaggagcgaggttttgaatttagattgtttagcccaccatctagccggcgagcatttctccgttatggttgaaaaagaaacagaagagggaaactacgattcgatatgatgagacgcagacactaatcaaaccagactacaagataaaagtacggaatactatactggtacagcactagtgtagtaacaacgacacaaatgacacgattcgttgtacatgtactaatcgtactgagctctgcaaaagcgtgagaggctcagagccacggcgcgaacagagtgatgcacccaacgagccaaatcagcagctcggcgagcagccgaggccatggcacccggtcccccgcgcccgcggacgcgccgacggcggcgatgatcatcgtggcgccggacaccatcagcaggaacgcggcgcgagtggtggctgcgcctccgccgcggccgtcggcgtgcggtggctctggctcttcgccgaaggcgatctcctcgggatccatttgccttggctcgagatcggccgtcgatgatatgttttctactgtatttgcctttgtgccagagcgtgtgcaatatatgttccagatcgagctccgttggcagtggcaacgaccatttttatatacgcatcgagggcaatataggtgggaacacagaatgggcccccggttgaaacgataagtcaatttgtagtataaagtccatgcgagctgtgtgcatttggccgcttcttgtgttgcgttaaccttttctagtcaatttcttcactgtttctagcttactggctggtttgacgctggtacgttactttgaaataagtattctgttatacctgcaccaatgcgcggtgaaatcactgacaggtcggtccgatacagcacatcgacccacttatcagtgataactccaggtcgtgtagagctcgcagttcgtacgtgtaggaacgtaattgcgtacggaggggaggaacgtgggctggattttttacattttgatccttttgaaaaacttatttcgtaaatagacccctaaaaaaacttatcccagaaatggtcctttttggggcgccagagtggctggcgccgtcatccagcctctctggcgccgtcctcctgccaccgtggtgcacgcgaaccgacgtggcaggaggagggcgccagcataccatgctggcgccgccccagggaggagggcgccagcatggctggcgccgccgcctccattcctgtttctctgtatggagttgcaacggtgtcatttttattttatttttttggatgttttttcacactcaggatcatgatacaaccaaaaaaaaaattaaactcgaactaccacttagctaagtctgaaaatatctagcataccacttagtctactttgcaccttcactaaaattaga

SEQ ID NO: 13920 - DNA, 3935 bp, Oryza sativa
cactcagcaatgttcgagaggagtgaggaagaagatgagtgacgaggagagaaagaagagagtataagaaaaggagcatatgcaaaggccgacaggtgcaccccacgcttgcccccaccttcttggtttacccacacaagaaagaaaatagtccatggtaggtgggctccacttgctgactcaacgtgtcaactgtggtcaacctaccatattagcagaaatcacatcctaaaatatcgaaggagttgatttgtgctggttttgaaagatgggggaggcgttattgtcggttttgcggttgagggatgcggttcattcaataggaagaaatgaaggagagaaaatagacttattccctacttgcagcatctcattggaggtccagtacgtaaggcccactacccaccacgtccacacactgcaggccttaaggcccagtaaaatatggaccactcacgtgggagttctgtttgggcccaacaggtacttggggacgccgttccgacccaaattggcgtggagtgcaaaacggcccgctcttctgctgcttgccagaacttccgcatgatctctctccagctctccagccgtccgagcttctgaagcgctctgctacttgttccttgagagtttgagacgctttccaccatccagccagcatcttgcgctaatccgctgccgccgtgaagccgatccaccgatccacggaccacggccgtctttttggcttcatgcctccgacccgccttctgctcggacgcctcctctgcgcgaccatcggtgcttgatcttttctttttctttagacaatgataatgatcggtgcttgatctgaccatgtattatcttgtcggcgtcagattaagcaaactgcactttcatcttctctgcattttaagcaaacggagtattaattaattaatttcggaaacaaaatggtaccaatgggcacggcggtagccatcagctgccggagatcgaaaagaggtgggagaccgaagatacagctccgatacaggtcacgggtatcgtcgggcttctcgagaaagcggacggccgccgcccgccggacgcgtgcctcgcgagatgatcgagctggccgttgtcatcagactgacgaggaggtagtagtgtgccacgtatgtatagcttcgcggcaccccattccaatcaaatgatccttgcgacgtgaaccatccaaagaggatcggtggaatttcgacttgcacagccagcccattcctgcaaaggcttttatcaacttctctccgttcgaaaaagggtttatcacgagtgcacattcaacgtgtacacgtatactacatggttcgacactcgaacagttctttttcttttaaagatgttcgaacgtcagttcgggcaaacaacgttatctgttttttggagtgcacattttacaatcccgaggttgcgatatgtggcccaataatgtgcactctgctgcattcccctttggagaaggttggatcagatgtagtatagggtgtgtttatttcacgctaaaattgaaagtttggttgaaattgaaacgatgtgatagaaaagttgaaagtttatgtgtgtaggaaagttttgatatgatgaaaaaattaaaagtttaaaaaaaaatttgtaactaaacaagaccataatgtattaatcacttgcgttgacaacaattggcacactcaaactccacaagccatctcatacactcctattatattattattagtagtattttttgctgggaacattaggtacagtctactattttaaggaggccaaaacgaaaagcacatcctcttttctttttctttttaacgcattgacatgacagtgtagcaccaacaacttcaacaccagcacgatcaagcatattctaccatagaaacttcaacagttcaaccaacatcagcatcaactcctgttccgttcaaaagaacgtccaaactctacctaattgacaaatgatttcaccacgtccctttccattttcccttgttttttttcctcctcgaagaggtcgctttctgtaccgtctggaagacgtcatgtgttcttactatagaatgtccacagaaaatcctgcattccacggcggccgaaatccaatcttgccgatggtttggtttcctcttcctcactttttctttctttcttcctctccaagaagacaagtcacccttccccacgcccctctctctcctgacgagtggggcccaagtcgtgcggtcatagactttttactactacaaccaacgttcgcgacccaccgaaagttccagaaatccaccgctctccgggccccacctgtcgccctgggcccgcatgtcatacgcgtgcccgccaccgcgctgcgggcgccgcctctcccggtgggtttagaaactgtgaggccgatccgcataccgcggcggccgtggtgggcccaccgtctagcgaaaaccacccccgccgccgcgcgtgccacgtttactcccgtgggccccgcaacgaggcacaaaccctaggccgcttatataaacccgacccgccccgctccggtgatcggatccccacagctttgcgtttgcactcctctcgatctccattcgtttttgagttcctcgtttgctccgcctctctttcactcatgggtaaatccgccaatctttgattttattttattttgagtttgattttgggtttgattttgtatgtgtttttggctgattggtttgtgatttttttttttttggtttctctggaatgagcaggcaagattaagatcggaatcaatggtgagtgttcgagcatacgattggatctggttattttatggtatggggtttattcggtgcggatttgtgatggatttttttggtttggatgatgcagggttcggccgcatcggcaggctggtggccagggtggcgctgcagagcgaggatgtcgagctcgttgccgtcaacgatcccttcatcaccaccgagtacatggtaccgtctctttccctcgcctcccccgcgaattagttgatctggtgcttttgagaatgtatgatatgatgattgtgctcgcttcggttaaattgaattgcacgaattcggtgcccatcaattgggattgaggcatcctggtagatttgttaggactatttgttataaaccttgtttggatttgtgatctgcagtactgtagatgtcactgtcgttctgctctgatggaccacaacgcactctgtttataccatggattcataaatgcaattcttgtctgctttgactgaatatttctgtagatccatatagtagatggtttgtgttcatctcttcttttatctgatggtgctatggatgggatgattggtatgagtctattacactacagtatttataaagtcatgcagacatgcatactgatgtgggtctcttttgcatgcttcaatgcatttagaaactatgtgtagttgagtacttgaatggcgttcctacctacaagacctgatttccttgatagtacagaatgctaattttggtttgatctgttgtatatgctaaattggactgtcgttgcgtgcagacatacatgttcaagtatgacaccgtccacggccagtggaagcatcatgaggtcaaggtcaaggactccaagaccctcatctttggcacgaaagaggttgcggtgttcggctgcaggtttgttgccatccatttcagtatcattttggttcatctgctcacaagagttacagccagtctgataagccaatattctgatgtaggaaccctgaggagatcccatgggctgcggctggtgctgaatacgttgttgagtctactggtgttttcaccgacaaggacaaggcagcagctcacttgaaggtacattcctgtgtcaatttttctgttcagggtcaagctgtagatctgttctcaatcatttttcatatg

SEQ ID NO: 13921 - DNA, 10322 bp, Oryza sativa
  unsure (1)..(10322): unsure at all n locations
tggggatacaggttagtgtgtgctgcattatgaaagtgtaattctctgttacatgctcacgacagtctgcttaaaccacattttcctctgattgcagcacccgtgtgatcgacctgatccgtcacatgcacagcaccaactagacgagccctcctcatggaggcctgcagatacaggggagttgtgttttgccccagagaagagtagatgaagcctcttccgagaataaattttaaattctgtatggttttatgtccgtcgaaacctaaaactatacttggttgtatcatggtggttggttgggcctggtcatggctcatattttgtgtctaattttcttgcgcttaatctaaatcgaagtgttgcttcgcagatgcatttgctctgttttctggttgcttcttaaatacgcgcgccctaaaccctatgtgcgcgcgccagagtttcttcctgatttacaacgtttgctgtttagtcattggccaaaccccttagagcccaccttgattgatcgaaacccatctcctccatcgataaaaattggacctaacttatcgttaatgcaagtgcattgtctcgctggggatgagaaaaccaccagcaggtcagcaagccaggagctacttctgtccgctttgtctctagaatttgtagaatgctcgttttcaacggaaatgtggactgccatcaggcctcaattgtgaagtctccattgcacacgaggatttatctctagaatttgtagaatgcccgttttcaaaggaaatgtggactgccattaggcctcaattgggaagtctccattgcacacgaggattgaatcaaaaaaaaaaatttgaaggacgaaataagcaggtgttccagaatgattgcaggaactgataaacaagaaaattgaagaattgtgaacttggaggtacagagtttctgtatctctgttctgaaaactgaagaattgtaaacttgaggtgagactatttctctgcccctgctctgttttcttctatcttggcattttagctctgtaacttgctcttgttttatcgcacagcctgacctgttaaaacgaaaaactgcacgcacaataatggatgatctctatcacaaatgagatcgaaaatcatacgttcatttctgacaagaagtcgtacgaaggagatatgaacagcaaatttattcagtcacaacgatcacatataaagcatggaaatgcagagcagacagccagagaagcagagcgcccaacgtgtgtaatgctgcttgccaacggcgggtggtggctcactgcaagggcacacgaacaatgggacacaaccaaagtggattctcgcttcccacgttgatgcctatctcctccgtcatgtctagttcgttcggcgcaactccttcaagaagctcccatttaaagtggtataagagcgtagcaagcatgagctccacggtggcatgcccgaatgtcaccccggggcaactcctcctaccagcaccaaacggaatatactcaaagtttgcacctttgaagtcgatcttgccatcatcgaaccgctctggcttgaacacctcagggtcatcccaatgcttggggtctctgttaattgcccatatgttcacaaacacggtggtgcctttaggcacgtcgtagcccatgaccttgcacgcatggagacactctcttggaagaagcaatggtaccacaggatgcaaccttagagtctccttgatgataagctttagatacttgatgttaactaagtcatcttccttcactggatgttttccttgaagggtgtttcttgatggcccattgaattatatttgaagatgtatcacttcccgcaccaaatatgtcctgtataccgatgtagaatttagtaaattgatttaacaatgtcaagcaaaaaaccaatgtgccactgatgtacattcatcacagtactacttccggtagaaaatatatgacgttttgaagaaggtccagccaaaattttgaaacttctctcattaattttcataatacagtttgaaaacataaaaatgatatttgtagatttgtcctgaaaatcaatactttcatagtcctacagaacttactattagatttttttaacttatttgtaatacaaatctgtggtctaagttgttcttcaaagatcttaaaaaagttaaacattgtatatttctttactggagcattagcaaatgtgcttaattacctggataactgctttgatattgtccatggtgagaggcatgtcgagggcaccttccttctggatcctgaggagagtgtccagcaggtcctcctccatggcgccgccgccaccctgcgcagccatggcgtcccttacctgctcgtgctgccggatggcgctctcgatcagctcgttccccttccggtggctcgcctccgcgcggcgcgtcatgccgccgacggcggcggcgatcctcgacgacgggaacaggtcgtccaggctgaaccccgtgaagctcctcaccgcctccgtcatcgactccaggaactcctcccgcctctccaacctgtccccgatcaccacgcgcatcgtcgcgtccgccacggccgcggcgaccagcgcgctgacgttcacggcgtcgcggcgggccggtggcgacgacaacgaggcggcgacggccgcggcgaggttggcggcctcctcctcacgcacgcggcggaacgagcgcacgcgccgggcgctgagcatctccacgatgcacaccttgcggagctgccgccacatggcgccgtagggggcgaacaccacgccctcgcggtgggggcgcagccggcgcacggtgggcggccacggacgcgacgcgaagccggcgtcgtgcgtgcacgtcacctcgcggccggcgtggggggaggacgcgacgacgacggggacgccgccgagctggaggcgcatgagcggcgcgtcgtcgaggccgcgcgccaggtccgccatggtgcggtggacgacgggccgcggagcatcagctggtggaggttgccgatgaccggcagccgccacgggccgggcggtggctggcgcaggcgcgcgcngtcgccgccgcgcccgcgcttgcccccgatcctgacgaggagcaggagagccaagaaggcgcagatcgaccagcacgcggacctgatccatggcggtggaggccatggccatgcaatgcaagcgaccgcgttctggtatggagcggtgagtgcaactgtgcaagatcgccgtgcaaagctcaagcactgcaagcctatatagagaggacggaagtggatcttttgactttgtgcggtttacagctcagtaattaacatgtaaaccatattttactgtatttcacgtgtcagtgacataactataaactatacaaagtctaagggcacccacaatggttatctataggctctctataagagatccatgtcagcatattttcctacttggaagagattaaatgaagagagagagcaaagctatctactaacctggagatagtctatagagaaaaacgagacaatatattagagagctatagatacccatgtagacatactattgagatggtttactattaatttagtctattgctgagatgtacatgttttatagatagcaccttactttaccattgcgggtgctctaagaagagagttacatttacattccacgatgcgctacgtgatgaatgctggtgatagatagatactccctccgtcccaaaaaaagacaaaccgtgggtttccgtgtcaatgtttgactgtccgtattatatgaaaattttttataattagtatttttattgttgttagatgataaaacatgattaatactttatacgtgacttatctttttaatttttttataatttttttaaataaaatagatagtcaaacgttgaacatgaaaactaagtttcgttttttttcaacggagggagcagacggactgcatagccatcgcggtgtcgcccacaaaaagccaagcaggactcgaggtcaaaggaagccatatcttttgagatatagatatcataatgactactgatgcactgctatattggagatagtattcggtgacagcgtacaccatatcagtttcgtttaggtttcgttcgattaattcctcttcaaagaaattgagagaatcgatgcatttttttaggattaatcgaataagctcttatatgaaactgtttctcatgggaaaaaaatactctatacttgttaacagaaaaatgaatctattatgctgaaatttttatagagtaatgaaaaaccatttcaattggcagtagagtttcataaataattactagttctaaattcaaatcatcattacagtttgtaaagagtaccgtggtaatatagaaatatttcatatttagagctattcatttgagtagtgttgaaggttcacacactcacaaactcacaataccttcacttggatgtgatcacaaatgtaacatgtggccttgtaggaatgcgggtggtgataatttaggactttttttgaaatttggaattgagaaaacaaagaataggaaaagcataggccgatgatttgatcccatcttttgacatatagttcgagcctatttgactggaatggtttaggctgaaatctccctggtttggttcgtccggtttggtatttggaggtggggaagtagggtgggttggtttggtgagacttcatgagaaagtaaactagggcgattttcagttggatttcatcagcttattaatggactaattagcattaatcttaaaattcgttctgatgatgtgttacaccacccaaacatcaagtccgtgtctgttgcacttatactgggaaacaattataaactcctgaggggacgttccatcgttgtttgctacctgccttcactcgtcaagtaggcccgctaaagaaatatttgtatgtgcaataatgcataatccatatcacggttcacaactgagattaaaaattcgtctacaattggaaacaaagtcatagaatgaaaatgagaaccactttattaagtcgccacaaccatttatatataaaagcatgataatgcaaggtagagaacccccatggtatgtagcacaactacgacatagtagcttgttccaagggcacacggactataggatgcagataaagagcattcttcctacccacagtgatgcccatctcctctgtcatgtctagttcgttcggtgcaactcctttagggagctcccagtcgaagtggtacagaagcattgcaagcatgagctccacggtagcatgtccgaatgtcatgccagggcaaatcctcctacccgcaccaaacggtatatactcgaaatttgcacctttaaagtcgatctttccactgtgaaaccgttccggcttgaacacctcaggctcatcccagtgcctagggtctctgttaatcgcccatacgttaacgaacacggtggtgccttgaggcacatcgtaccccatgaccttgcatgtttgacgacactccctcgggagaagcaatggcaccacgggatgaagcctcagggtctccttgatgacaagctttaggtacgtcaggcttgccaagtcgtcttcacttaccatctgcttcccttgaagggtactccgaagctcgatttgtgctttgtgcatcgcttctgggttcctcattagctctgacaagacccactggaccatgtgtgaagatgtgtcactccccgcaccaaagatgtcctgtgtatatattacggcattatacaaagcgaaaatgacactattatcacccactactatagaacctggcatctgtgatgagtcatctgtgacgggtttgacgttaaagcaaatttaatgtatacataccaggagaacggctttgatgttgccggtggtgagaggcacgtcgaggttgtcttccttctggatcctgaggagcgtgtccaacaggtcctcctccatggcgcaatcatcaagatgcggctgcgcagccatggcgtccctcagctgctggtgctgtcggaaggcgctgtccattagctggtggcccttccggatgctggcctccgcgcggcgcgtcatgccgccgacggcggcggcgagcctcgacgacgggaacaggtcgtccaggctgaaccccgtgaagctcctcaccgcctccgtgatcgactccaggaactcctcccgcctctcgaacctgtccccgatcacggcgcgcatcgtcgcgtccgccacggccgcggcgatcggcgcgctgacgttcacggcgggggcggcgccgccgtcgtggccggtcggcgaggaggacgacgacgaggcgatggacgcgacgaggcgggcggcctcctcctcgcgcacgcggcggaacgaccgcacgcgccgcgcgctgagcatctccacgacgcacaccttgcggagctgccgccacatggcgccgtagggggcgaacaccacgccctcgcggtgggggcgcagccggcgcacggtgggcggccacggccgcgacgcgaagtcgaggtcgtgcgtgcgcgtcacctcgcgcgcggcgtccgcggacgacgcgacgacgacggggcgccgccgagctggaggcgcatgagcggcgcgtcgtcgaggccgcgcgctaggtccgccatggtgcggtggacgagcggtccccggagcatcagctggtggaggttgccgacgaccggcagccgccacgggcccggcgggaggcgcacgacgtcgcggcgcgcggcgcccagcctgacgaggagcacgagagccaagaaggcgcatgcgcagatgaaccagtacgcgacttgctccatggcgaccaagctgcgcgtttagatggatctgtgagtgcaagatagaattgcaaaagcctaggccttgcaagcgtatatgtagaggtgagagtgtgagatgagttgcatttctacgtgccgacgtagtggctgaccttgctgagagataatagatttaaataaaacccggcctctgtatcccttggatataatgctctatcttggagatactattcggtgaacattggtcatcttggagatatcttgataataaatgttaagaaatttctgttttagttacaattaatgttttaaagtttatggagtatatctgagtcttacttaaaaattaatgggccacatcacacctgttgtccacagggaataataagacaatactactaagacaataagttcacttgccatctcttatctttccgtcgagtttaaatcatatctctaaatcataatactccatccgtttctaaatatttgacgccgttgactttttaaacatgtttgaccattcgtcttattaaaaaagttaagtaattattatttttttcctatcatttgatttattgttaaatatatttttatgtatacatatagttttacatatttcataaaattttttgaataagacgaacggtcaaacatgtgtaaaaaggttaacgtcgtcaaatatttaggaacgaagggagcactaattaaattcgacgtaaaaattatgggacagtttgtggacttattccagtcaacaggccacattctcccacatgccttgattagatgggcctaaacccagctaatatacgtggaggcccatccatactaggccataagtcctgggagtacctatacatctttcgaaagatttttataatcgtatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaaggaaatgcactgtaaatttgagtgagaaaatcgagtgagagataagaaaaaatctttcgagtgagatatagcaaaatcgtaagtccttgtctattccgggctagggttttcggttcaaaacaacgggccgtatattatatgggccattatttagtcggactaccagcccatctccccctccaagcccagcacggcgcaacgcctccacttggcccgccatctcgccgtcccttctcacgagtcacgacgagcgccgcccccgccgccgccgccgctccactcgttgcctcctccatcctcttcttccccccccccccccccccccccgcgacgagcgtcggcgacggcggcggctggctggctggctgcctcactcctctcatcgaagatcgatttctctcctcctcaacccgctacctcgcctcgcttggatcgaagaaggtacccttctctcattctcctctcggcggctaccgaaccgggcagcccgccctgggtgggattggttcctttatttggcgatgaactactactacccttgctgatccagatttttttttctgtctccagtccatccagtttgctccggatttgattgctgcgtgcgtggagtactgtactgacagcggtttcttcccaagaatttttggggatttttggggattcagcttgagccttcatgctccaacttaggtgctgctcctgatgcgtcttatgagtgtcggatgccgccatggcgctgcgagggcgctgcaaccacttccactctgcagattgtctatctcatcatgtacgcaatctagccgagatgtcagcaatgttaacctcacggtggaggaagaagaggcggcgaggctgatcaagaattcgctctcaaaggcacgcaagtggagtgtacaggacttgattcagtgccttggagccgattgttcgggaatccggcttaccggaaacattgtggacaccttgctgttcaagtttggggatgactggaaatcggcattgggcttctttcagtgggcgcagtcgagggatgattacaggcacacggcttatgcctgcaatcggatggttgacctgcttgggaagatgaggcagattgaccaaatgtgggagctgttgtctgacatgcacggcagagggttggtcacggttgagacggttgcaaagagcatcaggaggctggcgggtgcgagaagatggaaggatgttgttttgctgtttgataaactggaggatatggggttggaaaggaacacagagacgatgaatgttcttcttgatgtgctctgcaaagagagaaagattgaagtggcacgtgaggtttttgcggtgcttagtccgcacattccgcctgatgcatacacgtttaacatttttgtccatgggtggtgcagtatccgtaggatcgatgaggcaatgtggacaattgaagagatgaaaagacgcggatttccaccttcagtcatcacatacaccactgttcttgaagcttattgtaagcagcgcaactttaggagggtctatgaagttcttgattcaatgggttctcagggctgtcatccaaatgttatcacttacaccatgatcatgacatcgttagcaaagtgcgaaaggtttgaagaagccttgagtgtgtctcatagaatgaagtcatctggttgtaagcctgatacactattctacaactccttgatcaaccttcttggtaaatcaggccatttgttcgaggcttcccaagtatttcgagtggaaatgccaatgaatggtgtgtcccataatctggctacctataacaccatgatttcaatcttttgctactacggtcgagatgatgatgctctcaatgtgctgaaagaaatggaagcacaatcttgtaagcctgacattcagtcatatcggccgcttcttagactttttttaagcagaagaggccaagctgataccgtccggcacttgttgagtgaacttaccagcaaacataatctaggtttagatcttgatacatacacccttctgatacatggtctttgtagagtcggtgataccgtgtgggcgtatcaactgtttgatgagatggttagtagtgaaatagcacctaggagtaaaacatgtgtgatgcttttggatgaagcacaaaggacaaacatggagacttatgttgaaagaatcgggaattacatgagttcctttggaatttctgtttaagtttttaatggatttattctcccatgtgattaatttattagtattcagcatattacatatatttttgcatgaaaaaatgatgcttgctatagtgattgggtgaagcatggacaatctgtatcttaccattaatgcataaactaaaagtcaggaagcatcttttgaccataaccataatagtaggttgttaatcagtagaattataggcaaatc

SEQ ID NO: 13922 - DNA, 24560 bp, Oryza sativa
  unsure (1)..(24560): unsure at all n locations
gcacgatcgaatatatacttctgtgtgaacaatctttttagattttaagcactaaatgtgtaaacaactaaacttgtatggattaactgcatataaacattgttgttgggtgtgtctagcaaaaaacttccacaatatatagctttgttactcttttgctagtatagtatgatgaaaactatatgtcgatgtatttattgtattggagaccatggagaaaaaaccatccacatggggatggaaagtatgtgattatattttggacgaagtctctcgcctgacaccttagaatactaccatcattttggtaacagagttgcaaggcatgttccattggcttaagaatcacagcaataataaccggttaacatgccatctctcctacataaaatgattgattcgattatctggaatagtggtctttatttactatttattgacatggagcaaatgatgcaaatggatcaagacttggatacgccttagcaagagcctggaagatttccaatcaggcgttcattattgataagtaaacaagttgctttacatcaacctctccctatttctatatgatatcagagaagagccgccaaattaatttttagctagtgtatgtgagtaccactaatggctggaaataaaattgtatttctttcgggagaaagaaactcaccaaactgacaccatgtttagatcccaattttttcttcaaactttcaactttttccatcacatcaaactttcctactcacatacacttcaaacttttctgtcacatcgtttcaatttcaaccaaacttctaattttggcgtgaactgttctatgaaactggtgctggtaatgtcctggtgtttgaattcgtgatgcctactgaatccactgttactttctccaggcaacgaatttctgcaccatctctgaatccatcttttgcatctttgtctacttgggggtactgagatacatccatccaaaagaagacataaccgtgcactcttgtactggtgtagttggagattattgtcatataggagtaggagtattagttttgtttgtccgagcttgtccaattcagaggtcatgtgcatctgaattatggcgcctttcacttgtcctgacctctgggattccgccggaccctctgtctgggtccctgtcgtcttcacgtaaactgaaccacttctactgaggacggcattactctgcctggtcggcatgtctgcccattgtcaaaaaaaaaaaagttactactagcatgtagttttgattgagtatttggtttacttttttaaaatggtttatatctccaatcctcgtcattaggcaggtcttgatactgaaataaaaggcacacgaggttaccacttgctaggtatcttcaatctgtcgttaggcacacatccggagtcctgactgatactgaaattttaaaaaaaaggtacatgaggttataacataaactttggtatcctttcgaatgataagttgataaccggttgaatcaacgctactgcatgttagcccttcatgggttttcagtttggaaattgctatgcattctacccaaatgtacaaccagcatacccctagtgtatgttaaggcacagctattgcttgtctggctcgcatggtaagaagcctgagcacggtgaatggtggatgtggcattgtcagatgtaagctgtatgatccagtcatattatagcacgattctttcagttatttgatggttttcatcaaatattattccaactagtaataagtcctttttttcaaacacagtataaatgcatgcgctcaaaatgcgcgtacactcatccatataaatgcatacaaacacaccctattcctatgagcatatccggaaaactggatcgatatattttaagattgacgaagtaaccacggacatctcgttatcgacggtacgtcacctatcactaaatgaataattagccgtaatgcagactagccttgactgcacgcacgtatgggttcgaagcatcccgtgcaaagggaggtgccgtcggtgcagccgtgcagggggagggcaaaggatcgttgcgaatgtgcaactgccgaccagtggcatgtgtgtgggggcggagtcgccggccgaaacgagcggaacttttttctggttcaacggcagttgattcattcatccctcctccagtccagtgtgttattttgggctaatagctgaatggcagaatgatccgaggtaagtaggaataaattattaaccattatatagcaaggtgagtatagcttaactgattatatttatttggtgaaatcagcccatctaatttaacacgaatgctcgcatttatggttatttatatatattttttggataggtgggatgtgcgtgtgcacccacattgtgagcgtcttagtttgcgctgtatatttttttaaaaaaataaatttcaaatagtgtttgagaaaattcatgtgtagaaagtttacaaaagttcacgcagtttgaagctcgggaaagcgcgtatatttttattccgttccggagaaaatgaacactcccggtcacatgtgtaggctctccgcgaaataaaaagtaacatgtctaggtgatgccgtgcacatgactaaggtagacgatcaacatgcacacacaacacatgggattcggatcaaatgcagtagtagtatggactgcaacttaaacagttgtagctgctacgttggatctaaatccaacggtaagtattaggtcggttactgtagcaaaagtaccaaaccataaaatattgttcagggtactgtagcacgagtactgtagcagttgatctgaactgtttatcacaaaaatgaatggctgaaaatgcatgcagtcctgagaattacgactgcacccgatctcaatcccaacacatgcgggggtccatcgttgtctgcacaagatgctaatctgcggtcaagggaaagctgataaacactgctccgtctctgacaccaaggttagattgatgatactcctacagattgttcgccatcatataatttcagatcaaaggcgttctctgtccacttcgcagcatccaaatcaaccacaaaatttccaacctgacaaagaaggaggttcattacaccactgattccttgccatttcggctaatgacaagtgaacagtgtggaatgtggttgccagcaatgccatgagatcggtgcatgaatcttcttggctttcttctgatcttcataagatcgatcaccggcgatcgattgatctggagcaaattgtttttaaattcgtcaggaacacgcttcaatttgggggcggtttcgctgccacatcaacgtcaaaagtaactgattaggagatgggcaacgcactttgctttaattctgcaacacatgccatagaatcattcatccagtagcttcgcaataactagccagatcatatcaccgactgtgcgcgccgactggttggcacatactaatcctatatcgttctaatatataagaacttatccaaatacgttgtacaattatgttcttgattcttatattttgaaacggaggtaataagtttgtgtgaaattgcaaaatacaagtagttcgaattatgtttgattcgactgcaaatctgtattaagatgacacattgcatcaatgtacaaatctgacgatgacagattattgtcgggcacagagcgtagtactagtaataagaaccatagtttaacaatactcaggcagagctcatattgaattcactaaattcaaaaacatttgatgctgcattgtacggagtactacacagtggcagccattgaatttgaaatcaagtccattattacctcctgtggctatttttaattacacgcatattactcctgtcggccaaaatagccatgattagcactaacccagtactgaaactacaaagaagaaatcgccatcaccatgatcatcatcatgcacatcaactatgtgcaggcctaccatcgctaaaaagcaagccaccaaactgcacaggacagtacaaccctttttgcatcattttgccaacccaaaccctaaaaccaatccaaatcaaaccaaccaccttcctgcgttgatgaccactgctgatcctggtgcaatggctatcactctctctctctctctctgtctgcctggcgtgcgtgtccccctcatcaatgacactgtttcgtttcacctttaattaaagattcctatcctctccaatgattctttgctctttttttttctctcattctgatcatgcaaaaatttccattgaattctctgtctccctgctttcagtgaaaactgaatactgaagaagagagataatgcatccatccatgtgtgtgtgtgctgtgttgtgttaagctttcctttacaaagaggaggaccacggtgctttgtcagtgtcactgcctcactgtttgtggtctcaccttttccctatcacgtcctcaacttacactagtctacatgccacctttatcactgtgcttgaaatccatggctattttagtggcctaatgcaagagtactcttcttgaccctggtggtgagtggtgactggtgagctgagctgagcttgcagttttggttcttggggtcttgaggagttgagctgtggtgcttaacacaggcatagctgcttgcttctttctttcacaaggtattctttgtcttcagatttgcttcattgcttggtcatgttgtatgtcttattatgtgttcctatgttcttggcttttcctgtcaatgtgtactagactactagtgctgttctgctctgcaatatctagtgttcttgctatttgtagaacagaatgtgaaaagaacagcacatttgtttaattttagagtttcagagcagtatgttcttcacctatgaaaaaaaaaactacaatctcctttcttggcagaaaagcagtggcaacaaattggttaattctattcttctgatctccattctgcatatggcctctccccttacagcttgcaaatgctttcatcctactagcagtgcaatagtgcaatccaaccacgagcaataaataattgtgtttttttcttattcttttctattaatgtagtcagctcacatggtgccatcttcttcttccactttggtgcagttgttggcattggctccatgtgatcgatgagctgagagagctcagctcagctcagctcactttcgccactgcagcatcggcgagctagagctgtagatcttgggaagatccagcaatggagaagccggcgtcgtgctgctgctacttcccgctgcggtgggagagcaccggcgaccagtggtggtacgcgtcgccgatcgactgggcggcggcggacggccactacgacatcgtccggcagctgctgcacctcgacccgaacctcctcatcaagctcacctcgctccgccggatccgcaggctcgaggcgctctgggacgacgacgcgcgcttcgccggcgcggcggggcaccgcgcgggcgtcgcccggagcctcctgctggagtgcgagtgcagcaagaacgggggcgccgccgccgccgccgagaacacgctgctccgggcggggtacggcgggtggctgctctactcggcggcgtcggcgggggacatggcgttcgtgcaggagctcatggagagggaccccttgctggtgttcggcgagggcgagtacggcgtcacggacatgttctacgccgccgcgaggggcgggaacgccgaggtgttcaggctgctgctggaccacgccatgtcgccgaggtgctcgacgaattgccccaacggcggggaaggcgcgcgcggcggtggcggtggccgctcctcggtgttccggctggagatgatgagcagggcggtccacgccgccgcgaggggcggcagcgtggagatgctgagggagctcatcgagcgccgctccgacgtgtcggagtatctcgacttccgtggatccaccgtgctgcatgctgctgcagggagagggcagctagaggtgaggcatctacttcttggccattgcttacttcactacttctgcaaaatgcaccatagtgaacttctgtttgtgccaatatgcatggatgacaaggtagatgcccatttcatcaggatgtttgggtgaaaatatttctaaactcgatatctttcaacgttatgaaaccaattttgccttttgatgcgctgcaggttcttacccggtaatcgatttcaacataaatattaaggaacaaattattttcattcgtcctatgtgatgattagtttgagcttggaaggatattgttcagctagaatgctgcgtgtaacccaaggagacattgagatatgtagatagttgtcattaaagaacattttttttatcttatataataagcataccacgcccagatgataaaggctcatttagttaatatcgtcatgctcaactctccagtgtattatgaaccaaagaataattataaagaccatactgatttggcctctttgacatggacttcaagttgtgcaattcatgaccagattttctttaggaattttagttagaagcaacaaaagctccaatcattgatctctctccaataattcgagttgaaaagtggatgtactccttgtcgatccagtttagatgggggtaaaatcacactttttagatatatacggttcctttctgtctcttgatgttgatattcagccaactttctttctgtttcttgatgctgatattcagccaatatttcttgccacaaatcattgtaatgttaggtgtgcaaagctccagttatatgcaaactagaatggaagtttccttctcccagtattatgcccttatgtatgtaaaacatacctcttgcaggttgtcaagtaccttatggccactttcgacattgtcgattcgactgataatcaagggaacacggcattacatgtagcggcctaccgagggcatctgcctgttgtagaggcattggttgctgcatctccatcaaccatttcagctgtcaacagagctggtgatactttccttcattcagcaattgcaggtttcagaaccccaggcttccgacggcttgaccgccaaatggagcttatgagacacctgatacgtggaagaacatcaaatatccaaaagattatcaacctgaagaatgatgcaggcctcacagtccttcacatggctgtggttggttgtgttcatccagacctcgtcgaactcctgatgacaaccccatcgatcgacctcaatgctgaagatgccaatggcatgactcnnnnnnnnnnnnnnnnnnnnnnnnnnnnctcttcaacatctgacaagctcatcaggcagatagtttccgcaggaggggtgctgaattcgactgttctgcgaactcggtcagcgatcgtttcgcagataaagatgcagggagggattgcaagcagccccggtacaactttcaagatatcagatgcagagatcttcctctactccgggatcggaaccgcggagtcccgacgccctagctcatgctctagcaatggcaagtgtgaccatgcccatcatggagatgcaaaatgcggaaatgctgaaaaccatggatcttcagagaagaggctgagctctgccagccgtgccaaggaccgtctcaagctgatgctgaaatggcctcgtcagaagatgtccagaggacacaagaaatccgacgatggcgacgccatggattccatcaagaagctgagcgagcaggccgtcgagaccccggccccgctcaggcagacattcaccaagacgacggcgctgaacaacaagaggaccctcgcggtgaagacctcgactcccagctcggccaccaagaagaagctcaacagcaagctcatccacggcatcatggaggccatgccgcacctggcgtctcgtctccggcgtccgccttcccgaggtcctccaccccgccgccgccgcagtccggcaagatgaagggcgtctgcctggaactggacgacgagaactcgatgacgacgccggtgttcggcaagctgaaggacatcgtgctgaacaacgacgacgatgatgacgccatgggcgagccgtcgagctcggggtcgtccgtgaacgacgacgcgtcggcggagatgccggcgcggcggcacgggtgcggcaacgggaggctgatcaacatctgcttcggcgcgcagggcctcaccgtggaggactcggccagcgggcagcagaccagcaagatgttcaagcagcagtgcctcagggtgtcctgactcccgagtgactcacacgcgcacacggtataattagcctgcttttctttggttttctgactcgaattgagcttgcagttcaacggaacatatatggtttctgcatgttgaactcgtcgggcttgtgtggattttgttggctgctgcgtgtaaccgtatccttgcgtggcgtgcttggtttctggttgggcttgtgttaacgccttaacggcttacttcgatgcaaatatatttggtgaatgtatcagctagttgtggtgagttagtcgatcgttttgtttaatttaaacaaacaaacagcagttattcacgtttccggaagaatccctgcacaaaacggaatgaggaaagacaagaaatatcttgtgtattgagaatattgaacatccacaacaaacagtcgacaaacatctgacaggagacaacaaattgcgctaaaagacgcatgaattttctttttttttccctgtaaacaagaaaagcagaagctttttcctatttgcccatatgcccagcaaacaactatcgcttcctccactacatcaaaattcgaatttacagcaggaagcaattggacaaaccgaaaactagagaacgaacgaacgaaaaatctataagccgctgggcaacaccttttgccgctgggagctttagcacctggatcactaattcactatgtgcaaagaaccatttggtcctctcattgcttacccaccttgcggcctggccatggcacttcaaagatggctacatacatacacccgacaacagctcggagtaccgcaagtcgcggccattatggctgtgccgtcctccaagcacatatgatgatttgtagggcaggttaccgcgatactccaggcgcataatttacgacatccagcagcatcaaaattgagggccttgttcgagctagtttggaagcagaaggaaggagcgtctaccatatgcacagctaattcagcaactagcccacaagcactgggactagttgatctctccttcctctgcatctttagtgctggggacactgctaggatcttcttcctcttcctcctcatctgctttcatgaagagtcccagctgttccaatggattgcctgatccaggaagaaaactgggcatgccatcctgggaatgctcaggactagtctcatcaacagaactcacaatatgttctgtggttgccgttccaagcatttccaaatcctttagatggaggttgtcattgatttccaccgttctctccatctgcattaagttaaaccactcaaattttagcgggaaaaagaaagctcgacaccagtaaatgcagtttttttcactagcctcctgcagggcctggcgagctttctccctctcaaggtcccgtttacgcttggcttcagcttcagcttcagctcttcgagcttccatagctgcatttccttcagccaacagccttgctttctctgaatacatagataaggcacttctcagggaaaatgtaagaaccatcatttaagagtaaacttcaggtggatatgcctgttaccttccttctggagcttttccagctcctcctgtttgtctccaccctgagctcaccaaatgttcgttccatgtcagaagcagcgcaacaaaagtgaacaaacaaaaccactcgatgaaactaatcacaaacctggctgagaatcccctgtgccttaacaatcacatcagcataacgactcctaaggagggctgctcttaagagcttgtctggggagacttgcctgtcgggttttgaattctcccctaaagtttcatagggaaaggatcagatgatccaatcagcttaatgcactgagaccccttaatggcctcatatgtactgcttgcaaattcatgcttaccctctggggcaggctttgactcgttatcctgctcacggagctccacatcatcagcaggacctgtgattttgaaagttgtaagagcattaagccaaaagctcatccaactgccacatgaaactacaaacttgtgctgctgtgacgattaaggtgcattttgatttctaaaggtaatttttttgtagattttaacccaaaacttggtcaaactacaattacatttagtgcataaaacataccaatagatttatatttcaaagagttctcacactgatattatgcaggtgcttattgttgaatactttttcaaatcaaaataagccttaagaagacgtggggaggtagtagaacagaaagggcacaggaatcttacggatggcatcgactggacttataacatcactcttttcttgctccaccagttgttcagatctcttacttccctaaattatatagatgacaactatttcagtgcaataacacggaagaaaaggaaaagttgtttcgatgagaagaaaaaagcaaccttgacaaaatgattaagagggatagatatcacattcaaaattgagcctaaatttctcaaagtaccacagtaatagattatttaaacgaacatgtctgtttctgaccaaattagacaataagggtatattaaattaatatgagagtcagcttatacagtatgcaggggctgatgtctgattatagatgcatagcaatcaaccggccagaacaaaatattcacaatttttcatcaagcacccaatgacaaatagccaaaataccttcggctttcctgggctaccacctttttcttgttcgctttcactgtcactgcccgactcagaatctgcattattggagtaaatgtgattgaggacacctcaagacaaactcatgataaaggaaggcttatgacaagtgggactagcagaagtccaaacaggaacaattacgcaaacatttagccacacaaacaagatatgatgcatgtattgctattctgaagataagataagattgttgcaaattagcacaagggtaaattgcaggatggtatcctgcttgttcgtcagttaacgatatgaataacagtaaccccagttaaagtttctataatactgataatctagtcccccagaagatcaaagaaagagggaatattgttgaatgcatgagcatgcatactgactagtgggcatctaatggtacagatgcacctacagtgaagtataattgtgcgtacttcttgttcagtgcctcgttagctaactcaactaaacatctactcaaaagtaattagcttcaagcttaaacgtcacagaagttaatataatgaaatacacaagtgtttgaagtaaccagatcattcttgcaaaaacatatttgtttacaaggacatatatcatactaaagagagtatgtaagcacagaggagcacagaccgctggaagaagatccagagtcactgctggaactacttgggctaccacacttgttaggattgttgtgtgcatctttttctatcaatataggggatgcattcccgcaaatatctacatcctcctcaactggatcaccacctgcagagaaaaagaagttgtaagagtactgtgatgttgcataaaactaagcattagcaaaggaccagggaaaaaaacctttgcagggatttgtagaggagtggctaaggccagatacattagcagcctcattctcagaaggctcagattttgcctgctggctctgctctctctcttgcaaatacttgtcaacatgtttcttcaactcgaatagtaggtcatcactgacagcatggatatcaatctctatctctccatcaccaagctgatctgtgttgttgtcaatgcattgctgcaacaaatcaatgatgtgtgaaggtacctccggatcctcagacaaagatgccaaacagttcccaaatgattctttctcctcgaatgtcatttttggctttacagactctgttggtctaacagactctgttggcctcacacactctgttgacacctcactgcagtccacagggggagtcttcctcctctttgagtcagccctgtcaacctcgacgtgcgcctctgtggcaatggaagccagcttcttttcaattgtcctccatcttgattcaaacatcttgtttagttgaatggcataatcatgcactacatgcccacgaggattgtaagtcatcgcatttgaaaaggtcagccgtacatcggctgcaaattcagatggactcgtgtaggaaccagagtcaagcttattcctgatagttccaagatccatcggtttcttgatgatttgaaaataatctggaatattcagcttaacagcatcaaccggggagtcgaatatgttactacatttctgagtcatcagctttttcagaatagcatcgcattgcttaaaaatcgcatcctcagtcaacaccgtggaagcctcaggtcggggctttgtaggcaagaaacgccccttggcaccacggaccacatggttaccacgctgtcccttcttacctcgaggggcagccgaggacgagagcgcgggagctctattgacagggacagggacagcaaactccggcttcttgaggagattccggaccgaatcaagctctgtgcggaacctcttccggagatgcctcctctcggaggaggacatcttggctgggacgaaaatctcccgcttgacatcgaagccgtcgctgtttaggctgatgcacttgcgcttgggggccgaagagtcctcggagtcaacacgaacggggctgcctgccgcgccctccgactcgccaacggtctccgcgtaaccccgtggcgccgctgacgccatgccccggaacgccatttcatcgtagccccgcttaatctgcctctgctgcccaaactccatgaggaccgtcggtgtcatgtgcccgggcgccagatctgttcaccattgacaaccataagagacccaagattcagtcacgcggaagggaaacttgaacttagcggaatcaaatgccaaatttgaacttcccgtacagcttgatgtaagagaacaacagaaacacaaaacgtattcaaaaagttccctccaaaaaccctaatcccacacctagacctaattcgaattcgaaccccaccccccgccacgcacgaatccgacaccgcgacccccgaatcctccaattcgcgcccagaacctaacggcacgcgaaaccgaagaaaccccaagagaaaaacatccccgaaaattcgaaacggagacggggggtcgcgagaacctgaagaagccggatctgaagagggcgaaaccctaggccggggatccgcggcggacggcggcctcctcctcccgtgcggccgccggcgagccggatctgctccggagacgggcggatctgagggtcgcgaggtggccgccggctcgagacgcctccccgccttatcctcttttttttttctcttttttcttctcttttctttttcctcctctcgagtcgagccgtctcctgcttatccttttccttcgcgaagcgactcgacttgagccgagccgaggtggagggagccgagccgagccggggagagccgaagtggagatccgcgcgggggaagcgagagacccgaaactgggaagcgaagcgatgcgagactgtgacgcgcgaggggcggacgccctcgcgggcggtatttataggcgggggtgaggccgcgggtcggatccgggccgtcggcttcgcggggatcggacggaccaggggttagatctgggcgtgggccccacccgggccgacgtgacgtggagcggggcgcgctttgactttcttcgagaaggtccgcgcgcggacgcggattcctacccgaactgaggatgacgtgtggggcctactatagctcgggaccacctgtcagtgaccttgaggggtcgtgttggggtgggtggtgcggagatcggccgtcttttatcgagcacgcgggatctgggtacggtttgggcgcgccggggagcgaggtgacttggaggagaaggcttggtgccacgtggaaggaggtgcgtggctgggttattggagggaaggatgtaacgggtacgggttaggtaccgaaagagaaaaaacggaaggttagtcgttcgctccattttccatgcgattttcctttttaataaaagggccatattcggcccaagaaaataagggcctaaattgtaggccttttgtataagaataagtccaccttgactcccttaaaagtgaccgaatctaatccgtgtccctgaaccgcaaaaccagatatcatggccccctcaactgttaaaaccggtgcaacttacctcccttagcagttttggagaatggctttactgatgtggtgtctttgactcgatccaactagctaactcagcttgtgggacctacacgttagtgtcacaattttatctctctcctttctttctttattcctctctttttcccacgctgtctaacagcaaccgaggcggatgcggattggcaacgatagcgccgtcgcggccacacctcacggcgcggggtacggtggccacctcgctgacaccgccgcgggtggcgcttctttctcccgctccgcatggtcggcctcgacctccgcgacagccacctcgcggacacggccatttgctcggcgactggacgtctcgcggcggcggtggcatcgccctcgcctctattttcccccaagcgtgcgtgcgtgtacaccacgtccacggcgcacgtctgcgtcaagaacgtcgcgccagccggggcacccacgtcaacagatgggttcgcttctccgccgcgtcgagagggttcagctgaagaaaaaaacatcctccccctgcacgttttcagtgacccagataactcctctgctcatattgagtttcttcatctgggttatgtctgcctgaacacagttgctaccactggtttgttggctttgccaacactcatcttaagttcattaatcaattgttgaattttacgtgtcgtacaccaccaccgtcgccggcctcccttgctccgcctcttcccagaccagctcatccagtgccaccgacccgacctcctccaaccgctcgaagtatgggccacggtggccgcccaagctccgttgggccgctctcgtcacagccgtcggagaacaccgcgacgtgcaccaacgacgaaccaaggcagggcttggtcgagccaacgacgaaccgcgtcacggcgacggtgcaccggacgccgccatgaccgcgaagacgagcagcaacggcggcggcgctggtgggaggggaggccgacatagcgtcgcctcgaggccgcgagcgctgacggctccctctcgcacgccgccgccactccgcctccgtcgccgaagagggagagagagagggagaaggaagaagggatagacctacatgccgcacgcaccgacggctccctcgagctctggctcctctcccacggcgccgccggcgcctacgccctcccgcccaccgctgccactccacctccgccgccaccgctggccctcgctcgccgaagaggagaggggtaagggacagagggagagggaggaggaagaaaggatagacccagtgggccccacatttttttcccgaatgacgaagaggtcccacatgtacgtttttagttctaatgctacataagcaccacgtcaacggcacaccaggtcaacactgccacatagacgccacgtcactaaaaccactctcagaaaccgctgagggagtcaagttgcactggttttaatagttgagggagtcaagatatctggttttgtggttcagggttatagattagattcgggtcactattaaggaagttaaagtggacttattccttttgtataggacgtaagtatggttgctaaggccctaaaaagcgactcttttgtggtcgtagcagcccagtatagtttaatttgagacctatgtgttctacttctaagagcaccaataagagatttgctaaattctatcccaaaattctgaatttggaatcctaaacggaatgatgtaggaagaaaattctctccaagagattaagtaaaattaattccctaaaaccaaaagtgggccccatgccaaactactaacacgagacagtttatttaccttcctcacgcgtgattgtgagttccggatcacggttgtgcgctcacggtaataagatcatgtgtctcgatgtatgtcgccgttgttcgctcgttcccaaccctcgctgcccaccatccgttccctccctaaccctagcatgtcattgtctcctccctcccaattctagttgttgctcatttctcacgactttagtgtacgtcgccatgacactacgagccacaatcgcctggtgtgggcgccaagaactgaggggatcatttttgtgtgggcatgggaacaagatgacactggtgggagttagagattgggaagtgtgcgcgtgaaaaatgatggagcaaaatctaggagagagaaaaaaacacaccctaagtgtcagggttacagataaggcatacttcatatcctacgacttatgtagtacacggatatggtatactttcacgtatacgaatcgttcctatatacgctgttggaatctgttataaattatgggaattatctccacgagacaggtgatttccaaagtcctactcggaagggatcgagtttctgttataccgtgcaagatccgatgtctccgagtcttacttgggataaaaatgacccacgatataaaagggaccccaaggaggggtgcaaggcatcatatctcatcgccaacacacccactgtagtttacgaagtcagagtacgcgaagccaagtcgccgggagatcttgtcgaatacatcgactacgatctttctacttttgttgtaatacgtggttttccatcatcaatctcatataaaaactggactagggctattaacctgacaaggggcctgaaccagtataatccttatcttttgtttgcttgatgtcgtattgcgtagatcatcgttccaatgtaccctagtacccaaatcatctggtctacaagtatcactcgtcgatactaaggtgtcttatgatgggtgagtatcttttacaaaatggtactatcattacaatcactgacacgtaggttccacttttctattgtcatccacgtcaatggctttgtttggatcctccaggctattaaatagccctccggaatcttactatttatgagtattaaacgtagattactaacaaaacccattccataacccctgaactattttgcgagacgaatctaacgaggtatattaatccatgatcaaactattttgtgagacgaatctaacgagatatattaatccatgatttattttgcgagacgaatctaacgaggtatattaaatattaatatacctcgttaaattcgtctcacaaaatagaccaggggttatgacgctataccctccgttacaaaataagactttctaacaatcaaaatttatttatctgagagtatacctatttcttcacttactcatcttaaacaattgcaatgaatgctcatttcatttctccaactaatcacattcatctcattcatctcttgtttagtttcacgtataccaaccccgtgaaaggctttacgagtacttatactttgagagaaagaggatgctaatttccaagataaaaataataacaagatgataatgtcaatgtgtcggttagcttatgcttaccgaacgatgccaggtatacacacagtaatgcccagatttttctcaccagcacacatcagatctagtgacataccaaacgaacagtaaaaaagacatcaataaactgctgcatacagcagcggtttccactcagcgtgtacttgcgcactagcgcgctcattgggcctcacaagtactacatggaaacacgcggcgtgcgtgcgtccatgagtccatccacgcgcgacgagctgtgtttgtgcttgtgcccaaacattcgagcacagagcagccaatcccttcccttcgcatgcgtgcccaaaaaagttgcacttgtcacgtggggcgatggggtgtcgcgcgcctcgccgccttggattctagccacgcagcgggggaacaaaaccacatgctgggcttagcttagctcccatatgcgcacagcagcacagctcgtgctaaccgacgacggcacacagtagcctcacatgagtcgctcgcggcccaaaagcacacccccaacacaaccacacgcactacctacctgcacccgttcgtgcacgagaaacaggggcaggaaggatggccgttagatctctacttccagcggccaagaatctcctgtgacgccgcaaagaaaacgaatgaaacaaccgaaagtaacttgttcttaacgatttaaaaactaatattaaaaaaaataaaccacgctaaaaaattattgaaataaactttaatatgaagttcaaattttgaatttcaattatggctgataagctactagaggctggagcgatgtagaatgcgaactggatgggagggtgaaaatgatgagcggggattgcgatttttttacttactttttttaacttaaaatcaataatatgtggaaccgctattcagaaaggtcatatgttagtgatcacgttaaaagaaaaagtaaataatacttcctccgtttcacaatgtaagtcattctagcatttctctcacatttatattgatgttaatgaatctggatagatatatatgtctatattcattaacatcaatataaatgtggaaaatgctaaaatgatttacattgtgaaacggaaggagtagaatcctgttgcgatgagcggtgcatcgtcgtggggagaacgtgtggctcgttgatgatcggcggtgccatgttttcagggaccgagcggcaacttttgtgctgatagcgtgcgtcctgccgggcgggcgtgcgtcgttatgtgagggcaaggccgcttatatgctgccgcaattaatcggaagaagctgaccggtgccggccctgaggacgtccacggtgcagacgtgcacacacagtacagtctccgcttgttacagtgaccgccaatcatgagctcaacactctctattcccttcctgattgctgacagctgcagctgacttccttccagctatagcagcagcagtagctgccgtcacttcgccaccacagtgttctcatctccctttcatatcccctgcttcctctccgtccatggaggaggtggcagtagcagctggcatcctcctcctctgatctcctcctcggtcacttcagtgcttacttgccggtgatgaggaggtcttctcaggggaagagctccagcggcggcggcgttggcggcgtacggaggtatgacgtgcacggtggtggtaacttgctggcctgctacgcgaaggcggcgaggccgaggccgtccaagtgggacgacgcgcagaagtggctctcccgggcgggcgacgacgactgcggcggcgaagctacccggcggaggagctcctgcgccagcgccgacgacgggctgctgctgcctcctccgccggcggcgcggaagggggccggcggctggcgatcgtggagcaacgtggaatgggagggcgcgcccgcggcgatggcgccggcgctgaaggccgcgcgcggcgacgagggggtggacaccaaggtggtggacgccgtgcaggcgtacgtgccgcagcggtgcgtggtgtcgctgagggacgtcggcacggagatgacgcccggcgggagcaaggagccgtcgagggcgaacactccccgcgtcgtcgcgccggcggcgaccgcccgtgtcgtcgcgcggggcacggcttcgcctgggcaatgcgacggcgggtcgcgtgacagcgccgtcgccggcggcgtggtggatctccgggcggctcgcaagcgcgccgatcaggggcacgacgaagtcgcgggcacgatcacggccgtgtcgcccgcgacggcgtggggcgacgcggagcgcgccaagtacatggccaggtgaccgatcgcgttccctgctgctcatcaattttctttcatcttatcgatattaacatcaatataaatataagaaatactagaataacttatattgggaaagggggaagcagttctttgcttgttatccgtctaaaaccagcaaattcgactaaaaatttagttgctcatctcctctctaaatccatggttaaaatcggtttgaactacgaaatcctgctgcaaaaatgcgctaaagctgtgctctgcatgtgcagtcaacagtgcgcagcattttctttcgttagcattttcttttgtcggacagcaccacatcagtgctgaactgtcagctagaagcactgagacaatgacatcctctgaaagcctgaaaccaaaagcaagcagctaccaccactatacttgtctactcacgtttgcatcgtgtgccattgccattttcgctttgtcaggtacaggcgcgaggagatgagaatccaggcgtgggagaaccgggagcggcggaaggcggagctgcagatgcggacggcggaggagaaggccgagcggatgaggctgcgcgcgcaggcgaggacggcggggaagctggcgacggcgcaggcggaggccaaggcgcggcgcgcgcgcgccgaggccgagctggcgctgggccgcccgggaggcggtgccaagggttggctgctcacgcggagcgcgagctggagcagcggcagcggccgctcgccctcctctctctcgctccggttgccgctgctgtgccgctgagaaaaatccactgccacagtcaaaaggctcgtgatcgatctgagagtttccgctgcttgttgaaggcggtttctgatgtactactagtaccaggcacagaagaattttatctttgtaccatcaatgaagacccgtttagtttcccaaaagtttttcctaaaaacatcacatcaaatttttagacacatacatggagcattaaatatagattaaaagaaaaactaattgcacagttatggaggaaatcacgagacgaattttttgagtctaattaatccataattagccataagtgctacagtaacccacatatgctaatgacggattaattaggcttaaaagattcgtgtcgcggtttctagacgagttatgaaattagttttttcattcgtgtccgaaaatcccttccaacatccgattaaacatccgatatgacacctaaaaatttttatttcacgaactaaacagtcccgaaatataatcttgttacacgaataaatcagattgttttattgtactattcggcatcaatcacggcatgttatggtccgtgccatttttcaattcaagcatgtggtatgtagttggactctttgaccaacctgtcaggtcggccactaccagtccatttccactctcggcgtcggggccccacctgtcatggacccgaatccccccgcgccgcgtacgcgaaggtcggtgggaaaccggcagagcaaaccgcacgataagaacgcggccgacgtggaccacgtggtgcgcggacgctctgcgtgcccgacttggctttctcctcctctctcctcccgcaacccgcgcacgattcggttccccctctcctcgcggccgcctcttcccccctcgaatcccgataagcagaggcggaattctccaccgcggcagcaacatgcaacccccagttcgattcggctgcgaggtgaggtcgtccgattcccaattcggtcggaatcacgcccaattttttgtctctactagggtttggtttcggtctgaggatttctagtttggtggagaatcgaggtccgatcccccaaccgggtcggaatcacgcccaatttttgtctctatagggtttggtttcggtccgaggatttctagtttggtggagaattacctctgggattttgcggattcgacgtcggttgctagggtttgtgaggggagcgattcatggctgcggggagccacggggggtacaggggctacgaggtggcgagggagcgggagcacgacgtgggggtctctaggaggagcaaggagcactaccaccaccgccacccgagccgccaccgcgactcggaacgccgccgtgacggcgggcgcagcggtggccgggagctgtcgaatgggtacagccaccgccgggattcgccgcgtccaccaccgaggaggcgtccatcggaagggaggacggaggacagggagcccggcgaggtctcaggtgggagtggctcagagaggtccggtgagcgcccaatgaagaccggggagccgagggagaatggtgtcacgcgagtcagcaaggaggaggcgaagatgtccccgagtaagaagaggaagcaatctccagtaatttgggacaggaatggttcaaagcggcaggctcgagaccctgtgaggggcattagagaggtagatgctgtagttgctgagattattatgcatcagtcgcattccttgcctgtcatgagctcactgtctagcataggcgatggacactcgccaatgattttggatgtgtcagttgataaggtacaggagtatgagaagaacaggattgtggatgaggaggaagagggatacccaacaatgagaaacattctgacctcaagatgggcagatgctggcgacgaggaggaaaatgtgtttgtgcccaagaaaaagaagagcgtgtcacctgtcgactcgattgaacgagggtccacaaaaaaggttacaagccctgagtctggagaggtgctggtgtataactcagtgagaagctcctcaaggtcatctgactcgggggtattacagggtagtgcaaaccgggaccttgaagtggagaagggtgacaacatagatgttgaggaggcggctgatgatgattatcctgctggtcatttgctggattctgattttgaaggtgaggactgtaggtctgaaacccctgagtgtacacggtccccacgtaggtgcattaacatgcttcaaggttgtaggagcgttgatgagtttgaaagactcaacacaatcaatgagggtacatatggagttgtatttagggtgagggataagagaactggtgagattgttgcgctgaagaaggtcaagatggagaaggaaagggaaggtttcccactgacttctcttagggaaatgaatatcttgttatccttccaccacccttcgattgtggaagtcaaggaagtagttgttggtagtaatgacagagatattttcatggtgatggagtacatggaacatgatcttaagggtgttatggagacaatgaaacaaccgtatagtcaaagtgaggtcaaatgcttgatgcttcagctattagaaggtgtgaagtatcttcatgacaattgggtacttcataggtaatgattgttaatcactaatttttcttctcctttacacattttctggaattggttttgatgttagattctaataattatgctgttccatagggatctcaagacatctaatcttctcttgaacaaccgcggtgagttgaaaatatgtgattttggactctctcgtcaatatggcagcccgttaaagccttacacccagttggttgtgactttgtggtacaggtaagtcattagacagtctatagtttcatacaatcagtctaactcaaaatttaacttatccatggtcttattacatgctccttatgactgcagggctccagaattacttttaggtgcaaaggattattctactgctattgatatgtggtcattgggttgcattatgggagaactcttatcaaaagggccactgttcaatgggaaaagcgagatagatcaacttgataaggtatatggttttgacttttgtctattccatatctttattttgattaaggaaatcttatgatgaagtgatttccattgcagatatttagaacacttggcacgcctgatgagaatatatggcctggttattctaagttgcctggtgccaccgtcaaatttggcaaacaaacgtaagtgccaactcatttcttgtttctgctggtttatttatttggatcatgcagtttctgtatcatataaagtcttaccactcattcctccctcaggcacaatagattaagggacaagttccgagctgtatcattcactggtgggccgatgttgtcagaagctggatttgatctgctaaatagattactgacatatgaccctgagaaggtaatacacttaatagagtgatccatctgattcttgtatcttcattttgtagctgactgaacatggttttttcatacagcgtatatcagcagaagatgccttgaatcatgaatggtttcgcgaactacctctgcctagatcaaaggatttcatgccaacatttcctgctctaaatgagc

SEQ ID NO: 13923 - DNA, 2631 bp, Oryza sativa
gcaagatcacttcagttgctccctgaagctgcttgaaaactagctaatttatgtaactggtcattataaaaatgatcctccactttctggaaggaaacaatacctgtcagatttttcaatatcacttgcgtgctacaatgatgtattactgactctatctacttctaatcttgtgtaatagaagaaccaatcaatttaatatcatttgcttgctacaatgatttatcagacaataactgactcttgtctacttctaatcttgtacagtataatagaagaaatcaataatctaaggacgtacgattgtattaatttatctttggaccatttgtcttgcatcatttttttgtaacaagtgacagccaggaagagttctttgtttttatttatttatttatattttcttctaatgatctacctttttaatgataggccgctagacttttatcaaccaaatcattattcatgataatggtgaaagatgtgaaatgtttttaactctgaggtgctggcttttccctcatgaaaaggcaatactcactgatctttgattcattttgctatcctgttgccgtatgttcagttcaaatcatttgcttgtgctttacagatgattatagtgaaatcagtgattcttatgatgtccattcttgcacttatcataataaatctacatgtcatattgacttatcactaaagttcttgccagaccagttaatgatgttcctttatgctagtttgaacttgctggagagttgattgggttcactgtaaacaactaagtgttctgtgacacatctgcagcttaagctgtggctataccgagacaggaagcttgatggacgtatctaattgacttatttgtggaaggcttcgagtcttcatctgtgatctgttactgttgtgaattctagtggtcagtctgctatcttatttctcaatatattggtgatcagtatgcttcttgctagtagcttcttttgtagctgtacacctgtttttttttttcaatgacagatatattcttgacatgttatattttcagtcctgcccatccacatatgtgggacatgattttagtacgagttaccagcctagatgtgtggatgaatcaggattttgggcaatccataatttcttgtatctccttgtgtccatgcctgcaagtacagctgtgtgttatcctgcagaacctttcgttcttttgttattcttttcaagtagaatcatgttgaagaattgcttgcatttgataaaataatattgagtctggattctgcaactggaaactcattgtagactggtagaaacaaggaaaactgtgcttttgtaattcatttccacaaatcatttactcttactcctacctttttcctttatgttttagtaagatgcagactgaccaagaacaacgttgaggcgcaggacttgtcatggttgtccagtattttcgaaggttgattctatcaattccgcctgccttttatatatatttacaattacccacattccttgccagttgacaccatgatcctactttttatcttctgctttacaatctttcagtgctgctttgctaattttctactgtgctactatcaaattgcatgctttactggcactattttcactaattatttctcttgcgcacctgtgaaaagtttgatgcccctgtggctaataacttttttagtgtcatgggttacttgttttaaacttataagtaaatattctattgagtgaaaggcttgaaaattttgtcaccaagatgcgaacgaccattaaatactcagcacagttaaggcttggaaaataaggttacatgtttagcatgacagtgcgtgaagtagagaaaaaagcgctgtcagcaattatgctttcctgaagcaaatcgatgtttctggtattcgaacttttagggcatacaaaacagtctttatagcaggctcttgggggtaccacctaagctcagttaatatcaactctctgtagactcttagcgccagataatagggaatttcctcgcatgaggctagataaaggaaagaagaataatgataaaaatattttggtggattcatggttagagcctctgttgtctcaattgttataagaggatagtctctaagatgatgtgtattaccaaggaacccatactaggctcaactgttgtacttgccatactacctccgttgtaaataagtgcatttctggtttcctaagtcaaactatcctaattttaaccaaattcatagaaaaaacaatactccaataattactattcaaatgagcatcattagttccattgtgaaatatattcatagttttacttatttgacatggtagacattattactcttatctataaacttatgcatttgatttagtagaaaactacaaacgcacttattttaggatggaggtagtagtagtttgtctaaatgagaaacgtatccatgacagtcacactcacacactttactccatttccttaatacaaagaacaatcttaccaaccatgcttggttctaccagtatcaacactctattcttcttgtcgtgtcatggatctgcactgcatcttttctaatgtctttgcatttacttgttttaactgtccctttgtttgtg

SEQ ID NO: 13924 - DNA, 3118 bp, Oryza sativa
gcccacgtggcgcgcgttggatggtggtggggttgaaattttgcaacggttaccccgcaacggctacttcaacggctaaaatttgaaaataaccgttggaggtcgaaaaaaattcaaaaatatatgaaaaaaaactcaaaaattaggaaattttttcctataaatagggtagccaacccaaacattctggctcatccaaacattcaatcttgtgctctcttgtggtattttgtgtgttgtaggttacgactttacggtcttccgaatttttggcaaaatttctctaaatattgccaaaaataaaaataactaggggaagacatatattcctatttgtaagctgcaaacaaagagttgaagaaggtaagaaattattattattattattattagtgttattatttacgtatatgttaattttgaaatttcagcatggacgatccgaattacccaatatttgacatgagcgagtacgacccaaatttcggcatggagcaaggtggcagcatccctgcaccgatgccggaagaacctgcaaccacacaggtggcttcagaaggatcaggaactgtggccgcgagtgggtcaacggcctcgtcctctaaaagatcgagaacttccaccgtatggcaaaattttgatgagatcaaggagaccggccctgatggtaaagaggtaacgttggctagatgtaaaatatgcagaactaaattatctggaaaatcttcaagtggaacaggacatttaagtcggcatgcggcgtcgtgtgctaagaagcaaggcatccaactgcgacaacaacaactgatattgaatcctgatggtacggtacgttcgtgggagtacgatcctcaggttgcacgagaatctcttactcgattaattgctagacaagatttacccctaaattttggtgagtcaactgcatttgaaaaatatattcaaactgctcataaccctaggtttaaatctgttagttctcaaaccacgacccgtgatttaagaaagttctataaacaaggtcgtgatacactgaaagaattatttaacacttgcacattttctgttagtatcacatctgatatttggagtggtaaggccaaggaagactacataagtgtagttgctcactttgttgatgataattgggaaattcagaaaagaatcattgctttaaaattaatagatgttgcacatactgctgataatatcgcggaaagaatttccatggttgttcaagagtttgaccttacaaataaaattttcgctataacactagataatgcagctgctaactctagggccatggaaattctacaacctgtattctctgtctatggtcaatcatttcttttacatcaacgttgtgcatgtcatatcattaatctgatagttaaaactggttttaagagggtatctacacatattgattctgtgcgtgaggcaatctcatggttatttgcctcaaacccacgggttgcaaaatggaaaagattttgcgatgcatcgggtatgaagccccgtaagttccgcacggatacagatcatcgatggaataccacgtacctaatgttgaggcatgtgttgccttataaggatttactaaccgtttttttgcagtctaataatgctacgaacagtgatgggcaactaataatgtccgagccaacttggtatgtagtagaaaagtttgctgcatttcttgagatatttcacgatgccactgttgctttatctggagtttattatccaactgctaatttaatgttgcacaaaatccttgaaattgctactttattacaagaaaatgagaatgaccacctactatctgctgcagtctttcatatgaaacaaaaatatcttaaatattggaaggaaatccctgtactgtatgcttttgcatttattcttgatcctaggggtaaattacggggattggttaatatgttgaatattattggagagataatgaacatagattatactaactattattctgatgttaagactaaattatatgagacatttgccaagtatgagaataagtttcagggacttcgcctacaaagacccccaactgtctctgtcgctggtaagaagaaaatacaatggggacggatttggggtggtagtcctcttccactcctgctgggagttccgcttcaggaacaactggtacttttcaaggcacccaagaattgtcctcctacttagacagtgactgtaccagcactgaagatctcaacgtccttggatggtggaatgatcacaagacccaatatcccgtgctctcaaaactagcacgggatgtgttcacggtgcccgtttctaccgtatcctctgaatcggccttcagtacatgcggaagaattattgaggaccgacgaagaaatctaagcagcgatatggtggaaatgctgctcatcgtcaaagactgggagctagctgctgaacgtgctcaacactccgcagagaacttggaattggttgctcagttcgaagatctctacatcgatacagatgcacaagattagctagttttttctaataattttcgacttataggctgtactcttttttctttgtcatggttttctcaaatatgagtttttacatgacaaagtttttaacgaggcagccatgtaatatcaaaattaataaatatcattattccatttttctcatattctttatatttatttagctttttcctattttttataatcatcttttttatatttatgtacctaatttcctatttttttctaaattataatcatattttttattttcccttttttccttttttttaattttccccctattttcccttttttttaattttttccctattttcctcactgttttttcatttttttattttttccctatttttccctcttttcctccttttttccccttttttttctctattttccggattcccgggctgcggccggcccacgtgcccccgccggcccgcgtgctgattcgtgcccgtgccggcccggcacggcacggcagcgtggtgggccgtgcctgggccgcgcacgcggcacgcgggccggcacggcacggcccgctacaggacacgtgccgtaacgggccgtgccgtaac

SEQ ID NO: 13925 - DNA, 6964 bp, Oryza sativa
cggtgaaattggcgtgcgtattcgcgtaactacatatctacatgtgctgtttgatcaatctcacgtttcggttatgtgcggtgatgaactgatgatgtagcttatctgaattctcatagcaatgggctttgttcgctatcagcaagcgttaattctcagtacagtgctttgctttagatgttcagttagtataaagctattgcaggttctgaggtgctcctgacctgcttccacaatgcaagctaaagaatccaaaaagtcaaggttagatccatctcgagctctcaaatgccaaatttattgtttgatttaaaataaccatttcttcatttaagttagtatactgttgtgtgcagggacaggggccgggaccgtgtgaaatggaatgaagaaaatttgaatgacattgagtcgaccaagccagtaagagaaaaaatcaccgagcctaagacgccatatcactcaatgattgatgaagatgatggtatgtgctttggagcttgcatatagaatcatgttttaatacagctaaagaaaaaattccggacaacatgcatctgatgcttgcatctggtccaagggactgtttctccaaaaagaactattgaagaatcagtggataagtccactcatgctgatgcgattaagactgctttgatggaagctgtttcaagtggaaaattatcagcaagagaacatttggaatcctgtagtaatgaagaagaagaagaagaagaagaagaagaagaagaagaagaagaagaagaagaagaagaagaagaacaagaagaagaagaagaagaagaagaagaagaagaagaagaagaagaagaagaagaggtggccatcaaacaaggcacaggttagtaatctgcagtcttttcttattgacaatgaaaaacgaaatatccttgtgagtggtatcttgactcttaaagtcttaattggcattttgtattttgatgcttgtgcaagtcgttatgatttcggtgctgtactgccatatagcatatcatgtctgatacatctcacataaagaagataaacacaggaaggaataatttcaggtatcctggtctcaggctatggggttgattaagtaacctgatcctgtgatctgtaaatctgatttgaattgtcacattttagaccgatttgtcttcctagctccagaaaatatctactgatagaaagttcaagactcccttttgtctgattactcctttatccacttcacttgtttttttttttaattcaaccctgctgttctattggcatcatggtatgccagaccaaaacttttgcttgatagcaaggtaagagctaatgcagtgtacaccagtaggttagctctagtcctggtttagtagctagttggaccatcaaaatttgtataattgtaaatagatataaatctcccgtgtgtgttttcccgaatcagttggatattttttgtgggatgatgaccattggggaagactggttgcaagctgtgttgctattttcctatctctagttcagattccggaagtcctcaaggcactggtggatacgcttcaatttttactatctatgtgttttgcaagagtaacctcaaatttcaccatcttgttttgtgtttttttttcaaagtaagaatgactgcttttacatgctttcatatagatttcgaagagcaacggaaggctcactatgatgaattccgcaagatgaaggaactgcgtcggaggggaacgccgtcacaagagggtgatgaatgatgactctggcaccgtcgcacaactcggaagcatatgatcagcgaatcctcggcatgttaaatattggcagtggcaggaatgttttacagatatcctactaaaccttaaaaagctcatgtgactatctgttctcttgcttaattattagtactggtcctaggacagtaccaggtaaaattttggctcttattatggaggtaagaaaatctgtatcgatcttgtactcaaaacttatgctcttgttcatgctgttgattacaaagttcgcaaatgtgacactctctgtggtaatctggtgtgtaatttgtgcaaattctaagcaaatgcaaattgctgggaatattatctatttattttcggcgcactttgctgggcatcgttcagaaatgccaacgtcccactctgtgtgcgaggtagcaaaatttgcattcagcacccgcagtttctgcatattgtcataacccccctatctggacacggtcacacgaaaattggagttattagaggggtttatctgcaaaaggaacaggataaacctggccactcccgttactctcgtcgtcgacctcctcccgctgctcccgttgcggcggtcgccgtcgccgccgacgatgacgagcttggaggcggccgcacgcccgagcagccgccgcgtggcaccgtgcgacccgcggggacgccctcggcttccgccatggcggctcatcctttccccctccccttcctcccgcaggtaaagcctctgcttccttcttcacgcgcttttaagtggaattggccttgctagattgatagctgagtggaaatggaagctgtgtgtggagtttcctcttggctcttgtgattccagactcgatttgttcacctgcgccattcacatggagctgcagttcaaacccttaggttttagcatctgtgtaatttggagagtaggtgctccagttctacttatagacgaaagattcatattatagtcctggtctcagatggggatgccaatgactgaggtcctgttagaattgtgaatttcaatgtcagaaccaattttgcctcctttctttgggatcaaaactggcagtcattcttttcaaaaagaaaagaaagagaaagagaaagagaaatggcagtcatttaatttgtttgtataaatgcaaaagggtctcaattttagttcatttgctacttttgttttggttggactagaaaaccatcaagctaaaacataaactttcaaaagtaaagtaacattgagtatttaacattgtccaataattgttcactcttattcttatcatgatatcatcatcccatacattcttaacgctgctatctgttctacaggctttgcactctaatttctagacaacttcccatttgcaatgcacaatcatgtgaggttacttatttatcccttcttaagatcttctccatgtatgtaagcaactaagcatgcaagttatcgttacagtgcacatcaattctctgtgatgcagatacggataatctgtggttagccagtggtaatgctcaaagctccgctgctgttcggtcaaggttgcttgctgcagaaagagaggaagcaaaagctgtgctatcactatttttaagacagaaaggtttgagaagtatactggctgcacgaattgccaataaggcagatggtttcattgaacacctagtttcaaagctccacattacttacagatcacgatatgctgaaggtttgctttcttgattgtgctttttgcatatctattggtttgaacttttaacaacacgtttatttttcaggaagggagctcagcacaccggagattagagatgctttgattccatatctggaagccctttctaaagaacatggagatggtttggttgaggtggtggagaatttccccgatccatttgctatggaacgggaagccttgtcttcttcaatggttcttacgcccacaagctcaaataaacacaaggcaatcgctcgggtaagcgcaccaacctcagggggagcccttcctgagctagttctctatctactggaccttggcatggatcatgaagagatcaagaatgtcgtgcggaaattcccagcatttgcatattacaatgtggatcgcaaaataaaacctctggtggcgctgctacttgagcttggtgtgccaaggtcaaacataccaggaatcatcaagaagagacctcagctatgtggaatcagcctgtcagataatctgaaacctatgatgacctatttggaaaacgtgggtatcaacaaagataagtggagcaaggtgctttcccggttccctgcacttctcacatatagcaggcagaaggtggagacaaccgtgagctttctcactgaactaggagttcctaaggaaaacattggcaagattctgacgcgatgtcctcatatcatgagctacagtgtcaatgacaatctcaggccaactgctgaatacttccagtcaatcggtgcggatgctgcgtctcttattcagaaaagcccacaggcttttggtctgaacattgaggcaaagctaaaaccgatcacagaatttttcctggagagagacttcaccatggaggaaatcggcactatggcgaatagatttgggattattcacactctcagcatggaagataatctgcttcccaaatatgaatatttcctgacaatgggatacccaaggaacgagctagtgaaatttccacaatacttcgggtacagtttagaacagcggataaagcctcggtatgctcggatgattgattgcggagtgaggttgattttgaaccagctgttgtcagtttcagatagcagatttgaagatattctacggaagaggatggatggaatatgagatggtcataatttcggataaccatggtttaggacaatctcatttgtaacaagacttgatcgctgccctggtatatagtttatcagaacaagtagtgtcctggaaatttgtacttagccatgcttggcagctgaccaattgttattgacagtttgatgtataacttggcggtttatgatgctagtttagctatttttgcatggagtactggcaaatgcattttgtacagctgttgtggcatgctaatgcccctttgccatcctgaagataatgcacttgtatttgatatcaggaaaagttgcagcaccagcacgtataacatggattctcttgcacatcatagaagccggaaaacagacgaagtacatattctccagtatacaactaaaattttagaagctaatcagctataaagagtaattagagagtacactaaaagcatgcagtgcactagaactctggtttacattacgaatatgtaagtgcttcgccatcactcaccactcatcaaggttagtgataaaatggataaaacacagggaagccctgctttttctttaacaacagatgtttgccagggctgcgttcatgaatgcgctgcaaaacgggctcctccttgttttcctgcgcttcagcgtcagcatcgcatgggtgttcgttgtacttcagtgctgaagtttcagatcatgaagattccaacaatagccaacctaataaaaaggaagcacatcaagaaatgctgcaaaatgatgtgatgcaaggactgtataacgtaatttaccaaatgcaactaagacattacactgatgaggaaatacacaaagcagagaagtcaatttgacagaatcagtaaggtaaaacatcagaatttttgcttcaaaattagcaaaaatacacagttgaaaatgcaacttggaagaaatattccaatgccatcaacactaactccaacctccacagcccaactcaaggagtcaaaaagaaagaacgttgacactaaatatcagctatttttaagctttaagtgttttaagtttttgactatttatgccatgaagggcaagtttttcctcaatgcgtgaaagcttctcaattgaatatgtgaaaaatccgcagtagcatgttagccaatttaaatccaaacatgcttttcatatcaaataaaaatatgacagcagaccttttatcactcaattggttgatatatatgaataagttattatggttcacggctaacatttcagcatatgaaagatctgcttgcatggagtttgataccacgtcccgccatgttcaaaaagatttattttatcatatgcagcataaacaaatgaatgatatgcacaacaatcaactaaccagttgcagtagaacaagtttgagtgtttcaattgttgaagacttgaagcagcgatttcaacctactttcaatgtttgcacacatgagcacatatatagtgcaactatgagatgaaaaattataagaggccaactattgacaaagtgcagctcttagcagaattaaggcaataatgaaaatgacaaaataacggactacaaacaaaaaccactatgctaaagcctcttgggtacatgactaaattactcccagtaaagaacactacatcagttgaataactcatcggaaccatgaaaagtaagaacacaccatctctcctagcggcgcacattgagcatctccttggcctcttcctgctcaacctgcagggcgtcgctggtgtacttgctcagcagctccttcttcttccgctccaacaccatccgctcaatctccttctcatcgggtagcggcacatgcgcgataaactccttcccagcctcctcgcccttctctctctccctcttctcctcctccagcctcctctcctcctcaacctcctcctccacctcctcgaacagcacctccctagcagcctccccgccgcgcccacctgccgaggccacctcgcgctcactacccccttcatggcctcccgccgcacccgctccacacggtgccactcagtgatgacctcattgcgcatgcgcttctcggcaacggcctcgagccgctctagcatgccgtcttcgtcgtcgtagtaaccgtagtaccctgcgttgatgcgctgtggatctcatagcgggtccgccgcttacggacctcgggtggcttgtcgaagagctcacggacgccagggagcttcttggcggcgccgaagtagcggacccggggccgcggccggaggggttgggtatggcgacgatgttgccgtcgaggtcggtcatgaggggcgcgttggagctgcgggagtggtcgcggccgccgagctcgacgatgcg

SEQ ID NO: 13926 - DNA, 3048 bp, Oryza sativa
aattaatatttgaattcaaattcaaatttgaatcgggtatgtaaacttttgacttataaactttgggtctataaactttagatgtatagaaatactatatataaaaatatttgaattcaaattcaaattaatatttgaattcaaattcaaatttgaatcgggtatataaacttttgacttataaaactgggtctataaacattagtttagatgtatagaaatactatatataaaaaatatttgaattcaaattcaaatttgaatcgagtatataaacttttgacttataaattttgggtctctattctttaggtgtataaacttatatgtgtaaactgaggtgtataaactttagatgtataaatctattaaaataggaaattaatgtggtgtcaggaaaagaagccagccacgtggggaggggtgatcgccaacaggattttcgtataatatacggccgggaatgctagataccaataagatcccatgcatatatagcgctcccaacggcatgccttctcctattttctcgacgcgagtcacatgtcacgcacggttcttccgctcggtgggccaatggtttttgctacgtgtaaatcacgacataataagttactcacgtcgctttcctagctgagcaacgacggcctcatcttttcactaatgctgatgtttatcagccaaatttaaaatttaaaatttaaaatttggagttgattttaaggttttttcatcgaagtttatttttcagtctttgctttagatcactaagaacacgtatataaaagttttgttcacaaatgatttttcatttgcaaataagtcaaatgatggggccgctaaccatatgacataggttctttctcatctttacctatttttctcctttttttggttaaatttcttatttatgagttgaaacaatttgattttttaagagaaatatatgatacttgtgtgacaccgatatttctcatttatttttttcttgaaaaattttcttttttttccaactagcatggtggcccgcgcaaattatatatatatatatatatatatatatatatatatatatatatatatatatatattcttaatttattattaaaatatattaaagtgacaacatatttttagttctgtactaactttaccaaactactaatgtgtgtaacattcatgctgtattgtatatacgtgatagttattaattatttttattatcaaatttaagttatttctaaattgtattcctatatggactctacgctcgtcttctaatattcctttttttaattccattttttttatttctagattgtatttctatatggacactaacctaattttaattttatttttttttaattccgaattttcattagttctaaattgtatatcggtatggactctagtttattctttaatattctctattttattaattctgaatttcagctatttgtaaattatatttctatatagactatgtttttctttttctctaattaatatgagaatttctaggttgtgagagcgaacgtggaggctcctttttctattagttcaataagttaatagatttatcaagcgatacatatgtatggttctgctaccttatgtaccttatattgtacaagtatcttatttgatgcctttatagatacattatttatctttgtcttttgtatgtgctaccagtacgtagaatattattcttggcaccaattgctatataatcaggacgggatcgggcatttaaatatttgccactttaaagatgtggtaattaagcatttgccactcgcgatctatgacatataggctctcatatacctatgacatatgggaccaatgacaaatccttaattgccacttgtaaaagtggcaaatagttaatatttgtgtggtactatgtggtaccagcccttgtacccacttgtatcacatgatacctacctagtaccactgtagtaccgaccaagtatcaatgggtattaattagctggtaccgacgagcatcagttggtgcctgataagtaccagccgatacccctagtacatataggataccagagtctgatactttatagatatcatcctgtctgaacaagatccatggtatagtagcccctataatatagttgcttgtggcaaactcataacaggtccaactctaaccacaacatgtgtaacttgcttacttgcagcatatatagtcttctttttattccaagatcaccaacattacagtgttctagacaggcgaagtagtaggagttcttttaaaaaaaatattacaaagctcctgataaaccggcatctagacagagcctgcattggtacatagcggctagaattttgaaagggttggaggtatccaaacgtagccatgggtctgcacgtagcccatcctcttgctcagctcgtcggcctctgggggtccccgggttcccggcttgtacggcagggccttcaccttgccgtcgtcgatgtcgtgcagcagcggagtgaagatctcccacgcagcctgaaaaccaacacggcgtcaggtattcattcagtcacaagcgagccgattgcaagtcacacagcgtcaattacacaaagcacaaaccttcagttcgtctcggcgaacaaagtgctgctgatcccctcttatcctgtcaaaaaaatggaagatgatatcatggttcatcctttatatatatataatggattaaaaacccggcctctacatccaacacggatagttcatcttggatatggcatgtgttgggaacaaggcgcaatgcaagtgaagaagttattagtgtagcagaaagaaatgggggaagaaggatggaacaggacgtacgtatccaggatgaggcgttcatacgcttctgggatcttcacgtcttggtagcgtaacccatatgacagatccagctcgctttggtcggttgccatttctagtccgggtttcttgacctgcaacaggtcatgcactttgttcagacaacacttgtttttttggagttctcttcaggcaaagatgaatagaca

SEQ ID NO: 13927 - DNA, 9444 bp, Oryza sativa
agttggaaaatgcagatatttgtttaaaagtgacttcaaaatactgtatatctgtatgttgtaaggtgtaacatataccttcccatctttcattgtttaccctcaatacaagagatgcaaaagtaggtgtgttggagtcatctggtaccgtagagtcatccttgtagccatcatattgcccaaggaccacctcatcatgctttataggtgtcactgactgaagaacctgacattgtggtataaaaacgcagaaggaagtattgtaagcaacgaaggatgacaaaaaaaaaaaaaaagatccatacaggtttcctactttcagttagagtagaattgtataaggagaagcaaaaaccttgactttttcatctcttatgtgctcaggcttaagagagacaggcttttccatagccaccaaacagaagacctgcagacaagagcgaaatcaatacagaaagggggcctcaagtcgtgaaagtggaaacagcaatattctcttttgaggaattataatgcatgacaggttgctgctctgcctcctcgtggtataacataagaatggtgatggaataaagcaccaatcattctgaatggtcaagtaaaatgttcagcagtccccacagaccacagtaagcaaatgctaatgtagattcacattgggaagtgaaagtgcacataaaactcccctagaaaaggcaagtgcatggaaaactatgctgcataccaaaaataaatatatttacctgcaacaaatggttctgaatgatatcacgaatgatgctgcagcaacaaaagcgaggtcaaatatttacatcagcgaagacgaataacgatgcacgggaggtcctctaggtgattatttgtctcataacataaacaccataatgcagttgatttattttaaatctagcaaatactgtattatcataaaaactaaagaagtttaatgcctagaagaaaataataaaatgcaatttgtatatttctaatggacaactgtacacgatcgaatgacttcatgtgaactatgggaaccataaaccatttacaatatatcaaagtgattttacacttttatagtatatccacagtcacaagcatatgtgcttacaacaaaatactttcagtaaaaggaactttcatgcaaaataaagttactcccaacatacccatattgatcaaagtaccctccacgtccttcagtcccaaagtcctctctgaatacaatctgcagcatatatttattatgttcaagcacatgttgttcgcaccatgataatgataaaactttccagaatttccaaaactaatccattcaactttataccaataacagaggatgtcatagatgtaactacagttgacaaataaaaatacaaaggactacatagaaaagcatattacctgtacattagcaatgttatcacgattccaaagaggtaggaacaaacggtttgcaaagcgaagcacaagctgaaatatattgaaatatgttatagtagcatggaatatatcgttcaactaactagacgaagccatacaacttaccagattttggaccaattcttttcctaaatagtggtcaattctgtacagctgttgttcattaaacagctctccaagctgggcactgagttcctctgcagactccaagtccttcccaaagggcttttcaacaataacccttgtccagccagaatgagaagctgaaagcacaatatgacagttacagaaggtgactagcataaaagaaatgaaactacaacatagtatagcacaacttctaaaaatcaaacttaaaaataattaatttgatttttaatttactatgaaccaacacatgactcaattaataactaagagcaaattcattgcacccaaattgcttccagaaaaccaaaactttatgtttcaaaagtcccaatgaaaaagcaatgtcaggaaaagagtcggcgactgctaggaattggtatgcttagaaagttgaaatagtagcaaagttccacaagcaaatacttagttaaataaagaggacaaaaggaaaatagtacaaacaagagtggatacaaccaaatatatttcctatatttgaaactctgttgtggataacttcactacaccaaaggaagtgcagcagctttcaaaatccgtaaaaaaggggaagtactcacatggattcatgcagtatgatcttatcattttgcatactgaggggtagactgatggaggcaatgccaaataaaatagtctacgtgagcttcctggtttgttgttcttcgaagtttcattctctgaaatggcgttatttaatgatgcaaatccttccccgctattgtaggaaccactaacatatttaatctgcaaagaaaattcaacgtgttacgaaatctaaatgcaaagaagctattcatgatatcagtgacttactaattgcaaaaattgtgaaatatgttcatctgaagctcctttgaggtatctgcgataacaggagaatgctatttaggcactagtatatcatcagacttaaaaacagagaaactacttcctcatacagaacatcccaatttatttttacatgaaattcttaaattattttatggtaaatgttggtgctaatatgtatctttcttacccacgaatgcgttctcttaatccatcatccgaaatatttgatcttgcatacccaaatatatggacttctccagattgtagaaatccctatcaacaccaaaggttacagttcagaactttgtacgtgtgtcaacctgacaaaacattatgtacatggcatgcaatagcaatatagcattataaagtgctgcagtagaatttctgagcaattataactcatcacgaatgcatcaattttatttctttttcactacaactctttcagaagtttgacaactatggaagaagctagtataccaaactatgtaagaagctactagttacaatcaaattacctgctgaaagaggtgaaacagcgctgggaatgttttcttcttagcaaggtctccagaagcacctaggaccacaatggacaagcaaccagactctgaagaccttctaggtccttcaaacctgacaaagaactgaagctagcccgccctgatgaaggggaagaatcaccagatcctcctgacatgatgaactgtatggtctcttcctttggagacaaaacctaagaatgtaaaaaaaagtactgttagtctcaatatgaggtattcacaaataacttataatctatccaaaactttaatctatgctaatatgaacaaaaaggtctattggttgaatgatggattcttgaactgaatcacctgtcagtacctaacagccaatttgcaacagagtgtaaatcaaaatgaatgtttgcttcagaaaaaaaaaatcaaaatgaatgggattaaagttggtttcatgaaatcagtactaaactactaatatagctaccctgaacttacatcagcgaactactcccattgtttgccaacttatagtcaaagttctcataaaacacaaacaggtactgtagttatgctagtcaaatgcttctatgagattctaatacagaaaaaaaaaagtatctacaagactacaaatgtaaatcaattgaactcggtgcccctacattttgtacgggtaaactggaacacatgcaacaactgaccactgcactcactagaagtctagaacacacaacagcccaaccacccaataatcccgaaataaactagaactgcaacttgcaaagcaaattctgttccgagagcttcaaatgattaaaacgaacctatacagcaagcgcatcagggcgccaggaaatcgaggagcacacgcagaataaacacagagatcatgaacacaaacacggcgcacagaacagaggaatttgcctgcgaaggctgcgatgagatcctaaggccgcagcgtagcacaatcccttccacggcaaatgaaatcaccaatggaaaaaccgatcgcgcagaactttgctacggaaccgatcaaccaccaaagaggaatctaagcagtgtggatgaggaggaggagggagactaaccagcagtggcgacgagatttgacttcccgaggtggaagaagaagacgacgacggcgaattgggcaatggatggtgatcttttccgggtgcgatttatagggggatcttcctcactcacacccgctttccatccacccctccactctcctcccccgccgcttttatactcgcggacgactcgtctctcgtcggcgttgttctcagctttgacccgcgcttagccgcctctctgctttgccacacgcccacacccaccaaccctgctcgcttactgttaccctaccaacatagtataaatcaccaatcttataagttattttttttaaaaaaaatagcgtcaatccgattgattgaactactaatataatccatccgtttcacaatgtggagagtgctagaatgacttacattgtgaaacggaggaagtatataaaaaatgtgaaccgtgaagcgtaacgctgtggtagaaccaagtcaggttcaagctctatatttactcccttcggattgataatacttgtcgttttagaccagggtgagatcaaatcttttattatgaatcatttttaaaatatttatctttcaaatatggctactatatgtataaattagtcttaaaaagtagtttaataaaattatatatttgttaatatttttatacacattataatgaaaaataatggtcaaaattatttttttaagactatgcctttgtccaaaacgataaatattatccggagtaacatggatgctcgtatttatcaatactgactttatcaatttgtaatgtatttttgtcaaggactacgtggcaacttcatcaatatatactgtgtttcaaataaaatatgaatgaaccggtagaaatagtttatcattaacatttaatatttgtatcacttgttttagcgatagaaatagtgcatcagtaacatttactcgctttatataagttaatagaaaataaaactacgacaaataaaaaatcctaaaatgaactctataaatttcaaattttatatttttgctgaagctgatatactgagatttacactcccgtcccgtaaaaaaaatatacttagatacatagttagaagttgaacatccataactaaatattgtttttttttctatggattgaagggagttgaagatgcaggcgataagtctgagatgagaccaaagcaatctgtggaatgccgatggattgtagttttttctatggattgtagttttcccgagtatcctcactctggtactctagtactctacgtggccgtgtttagttgtaatttttttcttcaaactttaaactttttcatcacatggtttaaatttcaaccaaatttttaatttttgtgtgaattaaacacacctagtgttggtgacaaagtttttcactttttccaacccatgaggccatgacatgacatcaaccaaatggcgccgcaaatcgagcatcgtctggaaaatcaattcacgagtcgaacggcgcggccggtggtatatctatcatccccatctctttgttctttttttttttctgtttcgatgatttaacaatggtcatcagcgacgtcacaaaatacgctaaaaagcaccacgttttaatcctcttgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggaggccctctagggggcatgatgacacaaactagatcgtcagatctataatacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcccatcaacaagcgcgatggaatcaatttcatgggtcgccgacttcgttttcgctttgggagttttcacttcctttccgtcgaccacttcttcaacctcctcttctctgacttgatccaaatcagtcagggggaaactcaatctgatttttatcattgtttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgtcggccaccaccgttgatgggcatcgtcatctacgccgccggtctgcctccgtcgccgccgactggtgtccccgcctatacggtcggttggtcacaccaccgttgatgggcatcgtcatctacaccgccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttcatgggcgtccacgacttcaccgccggcctgcctccgtcgccgcagactggtgcctccgcctacacggctggcctattatgccgccgctgttgggcgtctacgacttcaccgccggcctgcctccgtcgccgccgactggtgtcctggcctatacggttggttggtcacaccaccgttcatgggcgtctacgacttcaccgccggctcgcctccgttgccgccgagtggtgcctccgcctacacggtggtctattatgccgccgctgttgggcgtccacgacttcaccgccggcctgcctccgttgccgccgagtggtgcctccgcctacacggctggtctattatgccgctgctgttgggcgtccacgacttcaccgccggcctgcctccgttgccgccgagtggtgcctccgcctacacggctggtctattatgccgccgctgttgggcgtccacgacttcaccgccggcctgcctccgttgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgaccggccgcctcgtccgccgccgactggtgtctctgcctgcacggctggcctattatgccgccgctgttgggcgtctacgacttcatcgccggcctgcctccgtcgccgccgagtggtgcctccgcctacacggctggcctattatgctgccgttgttggatgcctacatcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggtgctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgaatagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctttatgccgccgttgttgggcgtctacgtcttcaccgaccggcttgccttcgccgccgccgactggtgtttccgcttgcacggctggcctattatgccgccgttgttgggcgcctacgtcttcaccgaccggcttgccttcgtcgccgccgaccgatgtcctcgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtccccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtccccgcctgcacggctggcctttatgccgccgttgttgggcgtctacgtcttcaccgaccggcttgccttcgccgccgccgactggtgtttccgcttgcacggctggcctttatgccgccgttgttgggcgtctacgtcttcaccgaccggcttgccttcgccgccgccgatggtgtcccgctgcacggtggcatttatgccgccgttgtttgggcgttctacgtttttcacggaccgggcttgcctttgccgccacagatgggctcttcggttggcagggctggcatttatcccgccgttgttgggcgtctacgtcttcaccgaccggcttg

SEQ ID NO: 13928 - DNA, 2126 bp, Oryza sativa
atcttcaacacatatcttcaatcaagcaataactattcgacgacaagaggctacagttttcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactctcctccaagtgaagcatctacaacagctataacattaatttgatggattattgtcactaacatcatcaccagcacctctgcttcatcgaccctgacatctctgctgttgctaatggatgattatgttttcgccgacttattatttcaccttgacggttgacctactatgcaaatgctgatgagcgtctttgtcattatcattggttgctacactgctattggctggatcaccgacatcgtcatcttcatcatgtcggttgcgtttgtcgtcgtcaactattttcttcatcttcatgattagtggatttcgccatcactgttgatgcgcgtctacgtcttcatcgtcggtttgcttttgtcaacaccgactgtttcttcgcctccatggttatgcaacttcattacctttgattggtgtcactgttttttactaccactgacatcttccgttacttctgatgagcaatttcgtcttcatgttggtcatttcatctccatgccgactgcgtcagctattgccaatagacaattttgactatgacaaaatgacaagctatatgctcaggggctcatcaactcaagcgtgaggattatatctccaattgggacttgttccggatacattccacatggattcatagtcatgagtctatcttctatgctcaaagactggaccaattattattccccgtaaaggctatcaaccgaatacttgcgccagtcgggattcaattattatatttattttggagtatcccataagggataatcattcagatcagaagctattcatatgagctacacttggtctatattacccagaagatttgttacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatagtcaaggtgctgtttgggtttatcaagcaattgattggatacaatatcattgctttttgccacgtaagtgtgcatttttattgaccaatattatggcttaggctgattatatattatggtcatttgtcaggcggttggtaaatcctttatgagtttacttactcggatgttataccacatatgccatatatttccaggtgtggtgaaaccatgtgtcttttagggacttaagcacatctgttaaagcagtgtgcgcatggcgtatgcccaatactttggaaatttctttattcacagcattcaagcttctttatagctattttgctatatcactcatcatattttacaaagcagttggtatatcacccggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaacgtctcaggggctactgtggatattatgggtaccccataccca

SEQ ID NO: 13929 - DNA, 11732 bp, Oryza sativa
cagatctataatacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacacctctatgacctaaatggtcttatgataaactaaacgtcttcgtcctaatctcgctgacgtctcaacgaacccataaacaagaactcaatatccagctcgctagtacggagtactacgctgtatataacagtaaattatacagaataatcaccattcatgtactaatgtattatgtactccgattagtgcatgaaccacatggctaagctgaccactgtgctcgcagatctaagcatgttcctgatgcacgtgttaggttctttctttttactgccacttgcccggagaatttttttcatttttaaatttttttcttttaatatttacagaaataatccatgggcgcaaaaaattacaaaaatagaccctgccgccctctactaaggcggcaagctgacgtggcaaacggggagggacggcggtgacggcagacggaagacggagggtttttttttgcacgaaaaccattgccgccctctgttagggcggcaagggcccccatgcaaaaaagacagcccgggcctagtactttttggctggtacgtctagtagggcggcgagggacccagatgcaaaatgtacgagccaaatgctgcgaaaattgcatttagccccttgccggctaaatgcaattttcgcagacggccgcagacggcgccgtcgagccgccgtctgccacgtcagcttgccgcccaccactagggcggcagggtctatttttgtaattttttgcgccgatagattatttctgtaaatattaaaagaaaaaaattaaaaatgaaaaaaattcctgcccggagatggtctccacggagtcgccggcccagctagctgcagcccaaggccggagcaggccggcccacaggccgtatccctcggcccagtacgggatcaagtcggacttgcgggccaggtcaactccaattcggactcttgagctcgtcgcatcgcagtgatcatgtcggagtcaacgggttcatcatcatatccgtggcgctataaatttgcagcgagcacgtcgtctccctctcttcccatcttccaagaatccatcaccgagctcgcggcctagctccgcgcccagagcgcgccatggattatctctatctggatgatgccgacgccgacgtcgaggctatgctccgggagatcgcggccgccgtcgccgccaatggtcccggcggagcggctgctggcgacgagacggacgggagctactgcgccggcgagagatgcgcctgcgcggcgtggacgtacgacgccgacctgtacgccagcctccgggccatggagatggccgccggcgagcggtcgtcgccggactacatgaccgcggtgcagcgcggccgggtcgacccgtggacgcgcgcgtcgctcgtggcgtggatggaggggatcacccgggggcacgccggcctcgccgccggcacgctccaccgcgccgtcgcctacgtcgaccgctaccagtcggtgaggcccctggaggcggtgagccaccgcctgctcgcgctgctcggcgccacggccgtcttcgtcgcggccaagtacgagggcgacctccccgaggagaggctgagcgccggcgacgccgccgccggcgccggcgccggcgggctcgccatcgccaggagcgaggtgctcgacagggagctcgacctgctcgacgcgctcgggtacaggctgggccgccccaccgcgcacaccttcgccgaccacttcctcgccaggtacggctactccggcggcgacgccgtgcacgccgtggcgcaccacctcgccgacctcacgctgctcgaccgccggagcctgaggatcccgccgtccgtcgtggcggcgtcggcggtgtacctcgcgcggtacgcggccaccaccctggcagatgccgggctgccgccgccgctgccgtgggaggacgacgggctggaggcggtgacgggatacagcgtcgtgtacctggcacgctgcatggaggagatgtacgacgtgcatgagatggcgtcattgtggccgggttacgacgagatgaagagcagattcgccattgactacctgttgcttccttgcagacttgtggtgcccttagtcttaatgtgatcatcgtaaggggtttaattaattcatagtatataggggatcgacgattagctaggagagtcaagagaatcaggtagcagaaaaaagaaggggttgatctggaaggggaaaaaattgccggcatttcgatgctacaagcagaagtccgttgcaaacgtgtgaggtttcatcaacgatgttgttgattgtggtaaacctctttgtaaccattaatttgatcttagtaaatttctcttggccgacgaacgccttgttcgcccgtaaaaaaggtggtgcatgtaattgtagcttagcatctgtacgtaagttttttttaattgaaatgtgaaatgagatgtttggaaacgtcgtaagttcaatttctcgatgacgtgtatttgcttacttctaaaattttatttcggaaaaaaatgcttttcattgtctacaaataataccatttaaatttaaacataataattacatctttctagctttgtttacactccgttttagccttttaggcctccttttagaacagatagttttcatataagtaaattttagggattaaacgggctttttagctactttattggattattgtcacagattatttactctaggtctcttaaatatgttttctatagatcacttgttcgaagccatttataaagtttacttttaaaacattaattcattcataaatcaaatatataatcggcagtaacaataatccaacgagtaatctgttaaacttatctttttgcaagaattttgtaaatttgatgtgttccaacatataaactgggaggccgttccatgtgcaacgtggcgtccccgggagaagccacgcgactgctactgtgcctttatttcagctgtccgtaaccacgccacgtatgccgagagcacgaaaccatctcaaaaactatccgcataatcccggtccactcactggcacactgacaagtgggtccagaacccccacccgggcccacacatcagcgaccccacagccatctcaccaccaccagataagctcccctccacggctttatcttccctcctcttcccctccactgcttcttctcccaagtcctcgtcggcggccacaacacgtacaccacacagcggcgcgagaccggaataggaggtttcaatggaggtggtgggcggcgtgtcgtcgctgagcgcgtcttcgccggcgccggcgcgggcgcggctgcggcagctgtcgcccggcgaggcgagcggcggggggagcttcctgctgatgaggacggcgccgaggagcaggctgcaggcggcggcgaggccggcgaggcgggcggcgctggtggtggaggcgagggggagggggtggtcggaccggcggtcccagcagcagcgcatgccgcagctgcccaagatcgaggacgacggcaacccgcgcttcgtcatcttcatccgcaccgccaatgtccgtgctgccctgattcttgttcttcttcttcttcttcttctccattcctgatcccaatgcttcgcgtgcgtgtgatcaagatttgtgtgggtttttttttctggtttctgcaggtgtacttctggtacccgctcaacatcgtcaccggcggcacgacggcgaagatcatgctcgcggcgaaggacaacttcctcggaaagtacatctacaaggacacgctcgccaggaaccttgccgctgtcatctacaaagtaattaacagcacaatctgtttgcttacacaaattgtcacacaatcgtgtttgaagagttgtagaaaagagaagatttaaatgtgcgtgtttcatgatttgatttctgaaggatgaggatgacataatagacacagcaaaagagcagtacagggtgctgaagaccgacaatgagtttcgatatggctacaaagttgtggtaattttctcagtcctcatcttctgtgcgtgattgtatgttgttgcactcgaaaaaattgagaattgcaatttacctgtctcatttgggtgagcaggagaatgggaacctgaggtctgcgctgacgacaagtaatgtgatcgaagtacgtttcgctagcgccttttatctcctctccctgtcgaattctctgcaagttatgtaggagtagcaatttctcatgaacattagagctgaaatctctgaaaatgtacatttcagacttgtatcttgctttatcctaggctgacattttctagagcacaaccttcaaattattttggcctagtactagatagtagctcagaaaatgttgtcctggaaaagaacttctatgcagttaagtgaggatggtaggcatttcttatagtaaatgtacaaatgaccatgttttcagtaagcatgtcttgagcaaaggtagcaagtcactaacagtaaaatgttttgattatcccagctcccaaagaaagaagagctcaaaactgtggttgacaaggtgaaggacttcttcggcgacgtaacctctggcgccaaagagtcgtttgcgcagattacaggatctgtcagcgcagaggcagaagcgccagtggaggaagagaagccctgggtgaagaggcgaaacgagaggaagcggaaacagaaggagaagcagaaccagaagcaggggatcagtaagtaaagagagacaatgctcctacactaaactacattactgcttcctgtgattttgcttgtgtgaatctctaggcctttgtatagccatcaaacacagacgttctgacctgcctgcatggttaccatttctgatctgcagaaacggagagctgattgtaaagcgcagcataccagagatcgtcaagtgaacagccggctgtaattttccagtgtgctcatttccctgtcccagattagctctgtgtagttcctcaatacttcgagtttttttgcaacaaacaatgtgtagcttgcctgtgactctgagtaacttgctttgttcttccttactaaatctgcagctagagtctcctgggatattagaaatcggtattttatggacttatggaacggcgaaaattactgttgtatattgacctcgtttctgatgagttacagtggctgtacagtgtgtgcgcgcgattgcgtatgaccgaatgctgtttatctgttttctgaaatgttgcatctgaaaacaggctcagaacaaaaggaattacgcttggttctattttgcagttctcttttgagactagcatgtcaggctatttcaagcatatagagacccataagatcaaacagtgcggaaccccaaaaagacatcgccacaagacttgaaatgaacgaacagattcatctcagaaagacatgcactcttctcgttctacaaatctaaagcacacttactgaaattgcacacggaggttctctttaaaacctttttgctgtccgcaataaaatcaaaccgagataaagatcatgttctcatgagcctaggagtacaagtagaacagcaatttcagtacggtttatgtccatggggagctttgcagggatctagaaggatcacacctccaacgtccaacgtagaccattgaatttacaagtcaatgactcgtgacagtttctggatgcggttcagcaagaagtccccttgcttgatggtcgcttggtagaaggcattcctagcgtcaggtcggtttgtctccagaacaccagcaaccttatcgatcttgcagtgaagcttcccagctgcaatgaaccgcgacaattccctggaacaaatgaaagggagatattatctccacagcacaggaacagaaaagaatgttttgtcctacacaggaatcacaaacataaaactaatgcggatgggtgacagcacttactggtctatgaaatcaacagtcacaccaaatgctgcggccatcgcttccattgtcacactcttgtatgactccaaaaactgtgaatagacaacggtccgcacttccctcatatagtagcggaaatgaggctgaagatagcgatccaacttaatctgctccgtcatgccagctgaaaagaagtttagaccatatattcatatagcccagccgtacagactgtaacagtaaaactatagacagcttatcaagatactttacacttacagaatgcaacaaaaaatgacttgtactggcaattgtaaagggagttcagaaactcagatagatgaggtactttgccaatcactgccaaaatttctggtgcatctaccacctgccatatttcttgttagtgagtcaattaagaaaaagaaaagagagtgtaagaagtgaaattaccttttgttttagagatacacgatccaatgtgattatgcttgtgatgactgtatagaagacaaaagtatcatatggaaacaactcgtaagttgtgaaagttgagatggaatctaaaaataagctggcagctttcttgaagtttctcgttgccatgaagtataggccttcatatactttcaatcggttctttctctcccagtcgcctccttcctcaaacaggcttcaatcaacacaataaatagtcagatgtcattgctccagtatagatggcagaatggaacttcacaaaggcacaatcaaagctataacttacttctttgccttgtcaatggattttgagatgagatcaaagtccatgtggaaaaggcctatttgcaaagtgtagaacacaagatccattttctggccaacagctacagttttcccttcagtaactttaagctgctccagtgctttttcctgcaatattgatttcaaagaatgcaaatagctaaatctcaagcacacacttaatgtaaagtatagaagcacacaagtttataccttctctccaaccctcatgaagtacaaggatttcgccagatgggcctcacgcacttcgctctcacccaaattctcttcagcatcagcaattcttcatacatgaaacataattacttagttacttccagaggaaccaaatgattcttatcaaacttctagtaactgaaatattagatacagatgcgaagagcaagatcagaaagtagaaacaatgaaacatgcaaatcaccaaaaggacatatcttgactggaacctcaacttctcaaggaaactatttctaacaaatttcaacatgccgttcttccttcacattagtttacactggtattttgtctcgagaagttgcgtattgtgatccttagcaatctcaattacttctctacatgctaaattacacattgcagagaaaatgtacaaaatcatgaatatgtacatgaatctaaaacaaaaatgtggaaaaagtttattattatgtagtatagatttgcatagaggtgaattaattggccctaaacataattcataaattacaactaccgaatcaaatgcaagctatctaccagttttagcatctacatctcgcaacacagagtaagctaggttagctaaggcaaacggaccatatcaacacctgagttatcgcaaaacttatcgcatacgcaacacagcaaggggcggcctaatttttggggggctaaaaatctactactacttaaaaaataagaggtgcttccatcgtccgtcacaaataaataaaaacagcgaaaaaaacaggaaaaaaaaagatgtccgattccctggcaaaaaaacacccgatcccttaaaaagggaaaaaaaaagtccgagagacaaaccgtttaatgaataaaaaaagcgaaaaaaaaagagtccgattccctggagaaaaaaaatctgatttccctggaagagatccgatctgtattggattggagaaaagaaaaaaaacacttctctaggtgcttctgtcgtccgtcaaaaaacgggagaaaaaaaccgagcgaaaaaaaaaaagaaaagtccgataaaaaaacctggcgaaaaaaaaccgggcgaaaaaaaaacaaatatgtccgacaaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcgtggagcaaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaatttgtccgataaaagaaaaggaaaaagctgaaaagaatctgactccatcgacgcggtaaaaaaaggcgaaaaaaaactttccgataaagaaaaaggaattatatgtgacgcggtaaaaaaaataaaaaaaccatgcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccgggcaaaaaaaaatctgtccgatccaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaatgtatattatcattatgttttttcacccgttgcaacgcacgggcatatttgctagtaaaataaaatcagaagagaggaagaatccactcacttctcgtcgagcttgcggacctcctcgtcgatccgcgcgcgcatctcggcgagcagcgcgtcgtccggctccaggacgcccgcggcggccagcgactcgaacagcggcgccatgccatcggacttgacggcgtcgagggcgtcggagcggagggcgaccttggcgaggtcgtcgaggtcggggtgggagaggaggaagagcttgtgggccagcaccaggtggcgctcctgcttcgcctcctcgccgccggcgtccatgtcgttctcgtcggagttgggggttcgcggttaggtcggctcgagacgaggcgaggcgaggttggggcttgggtactgggttgggtgggtgagtgatgccgagtctgttgctgttgccgaactgatgaaagaggagtgcggcccgctacggcctaacagcccatgggccggattcagatacggtccccatgggccggattcagagccggtctcagcaggcaacagagctaacttaaccaaagaggtggatttgtctccggttttatttatgtatgtatgtcatccgaaaattcattaaagattttaaagataaattaacatgtaggagtaatatattactcaacagacatgtaagttcaaattcaacatatacaaaacaaaaaacaacaattttaacacacgaactttccgccttgttgaagatttgggggtgctacctgaagatttgaatggatggtcatcactatcatgaacaaccgagattcaatgagaattcgccctagctttttgtctttgacataaaaaaaagtttttcgtattattcacaatcaaattacttagttctaattctacttatatgtgtcaaatttaagcttgcatatttgtggagtgatattatttattcgatctatctcgtccttttctttttttcaaactttttgatgagtttttgggtggcatgcagcagaaggaattgtccttcagggacaaatagacttccccgctaaaccaagcacattactgattacatattcaagataactagaagaatgaagagaaaatttggttaaaagctaagtattcagaaacggggcaagtcataacccagcagtatgtacagatattcaaaatgaacaacaacaaaaagcatcactagatcaatcaccttcacaactcaaaaaccagtgagcgagatttcgtagacagttaattgaagttatctgagtctgacaagcaaaatcttaatctcctatgcaaagcagcaggcaaaaaccacaaaccaaaggtagcagaaacaaactactcctatcaatgcacagtgctactaccacctatgataagtatcatcctgcatgcatcatcacacatcatcaaggtagcagaaacaaactactcctatcaatgcacagtgctactaccacctacgataagtatcatcctgcatgcatcatcacacatcatcttcgacttgctagacaaaaatcaagtggaaacgaactactccttccgaatcatagctatagcttctggcctttcctgatctggactcaaactctgaataagattgatacgtgcgggggggacttgtccgggttagaccgggggaggtcgtcctcgtccgggaaggttgggggggacgtcgacgccgggggtaagtccatgtcctgggagtaggtcagcccgtcctcgtcgtcggtgtcaactagtgcgccatgaggaggattgccagtgccctcgtcagcagccacggcagtggtactgctgctgccgacggcagtggcagtggcgtcgaccttgacctcgtcgccggtgttgctgtcgtcagacccggcattggcagtgggatcaacctcgttggcggggtcgttgttgtcggacgcggtggcattgttgctgccggtggggtcgacatcatcgtcaatgtggctgtcagtgtcagtgtcggtgtcgaccggcggaacagcagggaaggcgccgggcttgaacagaaccaggatgacggtcgtgttgtcgcccgatggcaagccaaactgaacaagctcctcacagatgacacgcgcttctgcaccctcctgcatagcgatattaattggtcacagcaagtcagcaatatttggccacagcaaaaggaacaacagttttaacaacgaaacaatcgagcatgcaagatatttttttg

SEQ ID NO: 13930 - DNA, 18453 bp, Oryza sativa
tactcctcctgcattctgaactctctctctttcagactcactgtctggtttatgatcgacggataatgcactggccttttgacacaacagaaacaagcacaaatgttaggcacgaaaataagtgagcatgcaaattaggtaccaacaagaaattcgataaggaaatagtcactatacctgaccatttcttgagagtacacaacgagaatcaccagcatgcccaacaatcaattggtcacctctgatgacaaccacacatgctgtgctcccttcatatgatggcgcagtatatgttgcctggaaaaagaagaaagaaactaaaggacataatagagaattccaacatagtagagatacaggttaaccaagaaatagctcacaaaagcaaccagacaaagaaaagcatttctgaaagccaaaccagtgtatatgaaagagataaccatagaagagatgccgcaaacaatacctcagtttagggtagtgccatactatgacaagaaccaaggtgcaataagaacttaataacctgtcaggcgtccaactcaccaaaccaggcaactgataagtaactaactggacctttttttacaggcgcaattagttgaggttagggttaaacatatctcttccaactccaaagtacatctcaagaaagaacaatagtctcgatatcacacacattcttccatttcctttttcatagatacaataagcactgtccaacaaatacagttttgagtaacttcttcaacatatggatattataagatgtttaggggttaaaggatcactacctgcgggaaaggcgaaaggttagcacagacaccagccttgataaaatacatccatccattattacgaggaataactaactccctccaagcatcggacagttgcaggtcctcatccatgctgcagaaattacacaggaacaatgatattccaaatttgcaagtgcagcatcattcagtgcaacaaaatgatatagactaggcgaaaataacctgtaaaacgcactcctcatcgcattacttagattgctgtcgtagtcttcatgattgcaaagctcaatatgaaatcgttttgcacaatatgatgctacttcagctcctgagatagaaaataaacaactcagaatggtggctcaagattactcctatgtgcatatagaagcttataaagcaaaacaatgtgatgaacacagcagatcagcacttcataggtatcataagaaaaatagcaccacacataaattaaccaacatgttcatcagtggctatccttttaattatcatgactgttaatattaactcacacccatgcagtgttttatccctcgtaaattaatattctgtttacgcagttcatgttatcctagaaagcacaccgcacataggtgattagtactaattagcaaacttggctcattatccagaactgtagcttaatatttatttgaaaattgacaggtaaaagtttcagcataaacagtaaagttctcgaaacatgcacatagataaacacatgacacacaaagacaaacaaagcatgatgtaaacagttatgccgacaatatggaggatttgaaaccaaaaaaaaaggagaatgaagatcaaacctccatggccatcataaacaccaaagaatgacgtcatggtatcatcaagatttagaatagctgcatgctagagaatatagagggcatatgtcagtcacagtattttacacaattacttacagatcagtaagaaatttttgcagaactatccttttttttgtcatacaaaaggctgcaagtttactcacagcatcttccattttctcaccccatccttgcatagacgacacaacatacttaattctgtcattctctttttcatcagtgaactttgattctacaggaaggctgttacccatagcagacctttgttttgctgaaaattaataacatgaatacaaatatacaataactttattgacaaatatggagaaagagtaaagtgaatacaattacaaaacactacagatcaattaaatacataagagctttcgtaaaaacacgaaaaggagtcaactagacataacatgatatgacactatttatcagggcccctaaatgcatttttgagacatataacatgagagtatcaatcttcagttgcaatgctgcagtattttgcacattaatcttatatcttatacaagaatcaagcaaagaataattaaaataaaatattactgtgaacaaaatgcatacaaggttttgtaagaacgccatataagctttactgacacaaatcataacaccaaattccaaagtgaaatgaagaggaaacaaacagaaaaggcgtattgtacaaggacaatcaatttcctcccggtatggccacctcttcggtgtattaaaacttcaataattcgaaacagagtatgaagtgaacagaagaagaaaaacagagacagcagcgtgcacttatagtagaattcagcaaggagaatacaacatgacagcgtcactgagaagtaaaatataggtaacaaacatgaagaaattgtacaatcttgcagaaccaaaaccgttgggcttagaaggatcccaaatctaagattcaagagatgaaagcttctttgatatgcaaagaatcagaagatttctcatcaaaaagggaaaaaaaaacaagcagtttaaccaagctacacatgcagaaatcattgtatgaacagaacatggagttctttccaaacagaaactaaaccaagataacacgtcagagagaacatggagttctttccaaacagaaactaaaccaagagaacacgtcagagagacacatagagaagaagcatcctgcatcaggaacagcgaaaagaacaagaggccgaaggcggcatctggttaataaattttcagaaactgaactcccgcaacacaccaaaattaactgaacaaactggaaaatacaagcagacaagagaaacgaattgacgtggtctaattttttgcgcacgcactggtagagactttgagacacacacagcaagatcaatacaccatgaagcttcggtgctcatcagcctcctcctccaactcagaaaaccacactccacctcaaacttcaaaaccatcgaagcaacaaaagcacggtacgggaagcctacaagagagggaaaaaaagatcaaacagctgtgatccttgccccaagtttcggatgacgaaacgcctcaagattcaaagagaggtcaagacgcggttgctgctcgatcaaatgccacaacagcgaaagacatgatcgaaccagaaaaaaccgcgacgcccccaaacacccaagcacgcagaaaccacaccaccaggaggagagggagaacaccaccagaagagcgagatcgaaggaaagggagaagaatctcacggcgctttgggaggacgtagggtttagggatggaggaggaggagaatctcacaactcacctcgcacctttcgccgctactgctcttgagatgagtacgttgcgagagagacagagagagagagagagagaggagagagatgcggaaaagtggttgtgcagcgaagcgcaaggagaagaaagcatcgcgcttaaatacctgaaccggacgcatctcggctgtcggatcgtctctcgcggctgatccaacgctcgaggagtgcaccgcccgtgtctggtggtccccacggagcacgcgccctcctcctctcgccctgcatgacccacattgcatttgcaactatagctgtggtgtccgttatgcacatcccacagctgacatgtggggcccacagtctcgcttctgtctcttcttctcgacgcataggcctctctctccgcgccaccgacgcgagctgccgcttcctgacagccgcgccgccacccacgccaccaacctcacatagtgcagaagccggagtggctttgttcctacgtgacaatcaaatcaatatttttttaaaaaaatcagtgggacccaactattagagagggaggggtgtgagagggaagctgatcaaattatcacaaaactatatattcgttgatcaaattatcatacattgatcgaatttatatttctaatccagtacattgatcatcaagttcgcgaatgtatgatggtatcaaagcttacaaggcagagacctgctgctgctgctgctggcctggccttggtatgaattgtgatccaccgattccagtgctcgtgatttctgaagatctcggaatagagctgcaaactggtcatgttggcctgcaaagagacaaacaagccaatggaggagttagattgaattgtgagaggttactgaatttccagcttactgaaatgggctctctttatgagtaaaaaaggagcttactgaaatgggctctctttatgagtaaaaaaggaatgatagagtaagtacgttacaggaaactaagggcccctttgcctttgatttgtaggaaaagtgttcaaaatttgaaagatttcaaccctttggaaaaaattcctatgaaagcctttgaaacaaaggattgaatcctatactatccttcaaaattcctatggaatggctaatcctatagagattttgaaggaaagttagcaagaggtccaacctcttggaaaaatttctttgagtctatctctctcatccgattcttgcgtttttcctgtggtccaatcaaacggttattcctgtgtttttcctgtattttccaatcctctgttttacacctgcattcctgtcagaatcctacgtttttcctattcctccgtttttccattcctgcgatacaaaggggccaaacataatgtgggagttatttgctctttattttcagatagtgaaatcatctcgcagtaaaattgctcttctttcaggctaaaatcaaagtagatgaaaatgagatattgtataacgtttacgctgaacacctgtatttctttgttggttgaaaaatgaccctattaatattgtgcgctcagccaataccataattgctctctacgttgacgaacaaaatacaaactagtgatccataacagatatatccccccatagtgaccagaatacttactgatatgcattatgtatcaggatcagcttctgcaacatgaagagcccatatgcatatcaattccaaaccagttggaatgtcctgatttctttctataagaactgatgagacatacatcaggtgcagcgctatcaatttgcaagaagttgcaaacaacacatagaccttctgacatatgcttcaggatgttgtgaaacagctctgttgaaacaaaagttaatgtcaaaattgtacctaactaataaagttccttaacacaggaaatgtctgtttaggcttggagtacccagatcttattgtatcaagaatagctgtggcaacagctgatgcttccggatgcattgtcatgcacttcatacagacgccaagcatgcatacaatttacctaggacaacaaagtagcgactgagcaaatcgataccatattaccatgtgatcttttatcatatcattgcatgagtgggagcataaaagcagcagcataaaccaaaagcatacaaaggaaatctattttttgaccactccgactgcaaatctttagcttttccaagaccccatttacgagattttcctgatttaagtatttaacttgacatgatctagatggaacctcctctttcataccagtgtgaacaattcagaagtgtcctgattctaagacttccctccaaggacctgcaacaggacaggaggtcccctgtccctgaagtagctaaatttcgagcatgtactatgtcaaccagaccacagggtaaagtatagaaaaatacagatttataccttctgcctgacacttatgaagtacaaggattcagctagatgggcctcacgcacttcaatcccacccaaattctcttcagcgtcagcaatccttgatacatgaaaaaaaattactttcagaggaagcaatgattcttgtcaaacttgctagtaactgaaacattagatacagaacaaatgcggagagcagaacggaagatatatgtgaccagctaaaaggggatgtgttgatgactggaaccacaattatactatttatgctctagtgaagttatatatcttgattttccttcacattagtttacattgggtttttttccttggtgaggagggtgcataaattacttttatattggttgggaagttgtgaattgtgatccttaggaatctatattgcttttctacaagcccaattacatcttgtaacaatgaaccaaagcatgcattgatgcacatctgtgagcctggaatcaagatacacgaacactggcaatatactgaagacagaattaggcacttggtatgcaaactctctcaagaggaacctcatacaatacataccgaccccattctgaaacataattcataaattacatatatccagtcaaatgcaagtgatcgacaagttccccaaagtaacctaattacctaacctaaggttcgttgaggaaaacgtatcgtagcaaagacttgagttgtcacaaaatttatccccacatagagagtgctacagcctacagctataagaacagcaacgggcaaacctaattttctgggcaataccgcaataagagtaacatgatgccaaaattgaggggaggaagaacccactcacttcccgtcgagcttgcggacctcctcgtcgatccgcgcgcgcgtagtccggcggccagcgactcgaccgcggcgtgcaggcggggagccggccgatggatagatggagagagacggcggatttgacggcgtggaggacgtcggagcggagggcgaccatggccggcgaggtcgtcgtcggcgtcgggatgggagaggaggaagagcttgcgggccggcacgagcaaccaggtggcgctcctgcttcgcctcctcgccgccggcgtccatgtcgtgccggtcactgacgagtctctcacttttttcagaacattttttttttttgagaacaacgagtctctcactctcttgctgttgccgactgccgagccgaactgaaagaggccatgggccggtttcagccacgaaatgcttttcagttcgaaaaagttctctccacgtcccttatgtacgaggtagagtttcaatcgcgtcgcccaattctaaaaccaggtataagcagggtttcttttcggaaagcaaaaaaaattcggtaggcaccattccgaacaaaatattttgaaattttaacacattttttttactaaatttgaataaataaacaccaaattcacaaatatttggaaaaagcaaaaattcaaaattaattttaatattttataacttattttgtcaaagaaaatttaccaaatcattctcttaatgcaacgcgagaaggtttcataaagtttcaaagaaaaagtgctcccaatcacatagtagagaacaaaacttaatgaaattaatagacatgatatagccgagctatcattactgcaaattctgaaagaatgagttaattaaaaagccctcattgagttggcataaaaattcaagttcgatcctccatgtagtgcgctcctacttcttcatacctagaagacgtttgagcggctccaagggaaagccacaaccatggtatgagttcttcgtttcagggctgcttgccccttcgcctcgataaggaggtcttccagccgtagaccgcttactcttcttctgatttattaacttatctttctgctttgtcactctcgtattctgaataggaatcggcaaacaggtacaaccatcctcgaaaaatcgaacaaccctcttcaccttactcaccttagtgtcttttacctcataagcattttccataattgttggccctacctgatagatattttcaacacttcgagttgttccgccatgatatccagaaaatgttggcatcaatacttgaggcgactggtgatacggaagatttgtgccgggatcgattacaaccgtagttcctcgttccatgtcgtatacacacaacactttcccattgaaccccgagtagtagacgcagttccctctcaagcccgttccctccgtatcaagtgacgctccaaaactgcctatcttaacgaagaacgctctgccacctagcgaatccaccttcacccacgctgctgatctttgcccctgcgttgtcgtcagattaatgctcaacctgtaaacgcctacacgcgcgacaatccggtcacatccgatcgggtgagagaagacaacggagtgcagctccccgtttgattccacgaagcaagtggtgcgtttcttgtacaccgttggtctcctgtcgtcgtcgacgccgtgtacggcgatcttggtgagcgtcagctccggcgagaactcgaggacgccgacaagcccgtcatcgccgatgaggagttcgctgtagaacttgccgtcgatcgccgtaaactggcgtaaaaacctgatgatgacgtcacggtgctcagtgttgctgtgctggtacggatgctgatggagcctcacccagtggttgtcgccggggcggcaataccagagctccgtgtcggcgaggtcgatgacgaccacgacacagctggtcgggtccatgggaccgcagcatgagaggaggcacctccggagatggctgccttcggcggcgaggacggtgccgtcgtggtcggggggcagcccgacacggcggccggtgaaagggtcccataggaaagtgcacggcgagccgcggtgcgccatgagcaaccagccctgcgccgtggcccaccagcggtggcctctcatcatgtcgtcgacgccgccgtcgcccaccctcgttggcgttggcgttggcgccagcagcgctctcttcggcacgctgtagaggaacgtggcgtcgccgtggccgccgaacagcagcagaggagcaagcttgggatccagagcggcagatgcgtcgactgcctcctccatgatttcaacggacggctggccgatcgatctttcggtaattaatccttcgtaggagacggccggtcaatctgtgctatgctttataaacgaggagagtttgtggcagcccgatttaagtgttgtctcgtgatttctgttcgaaatcatccgagaggctttgagaactagtatatatatatattggcatataggaaagagaaacgaagaaatctgcacgcctaaatctgcagcgcccatgtaagtaaatcaggaaaaggaaacatgaattcctacacgtacggcatcaaaattcaaaccaattataatctgcaccgccggtaaatcagttttttggcacggcatagagacggatcctccacattactatgcaaccgacaaaaaccaaccgggtggggtacaaactattacaagcggaagctgacctatatgtgatgcgagtccggtggaaacacgtttccgaagaagcagtgcagcacagaacgcagcacgccatgcaggtcacacgcgtgcccgaactctcgagattctccaatctccaatcacagaggcggccgctgcgacgacggcggcgcagctgggacaactgccggactggtcgtctctcccgttggacatgctcgtgctcgtcctgggtcgagccacccgagcttcgtgtatgatcagtatcatccgtcgcatgcagatgcagtgcatcatcacacatcatctccgtcttggacatcaaaattgagtggaactgtagtgaaccggtgacctcctcctgaatcatgaatcatgcatctacgggctgtcgtcaggagccgtgccctcgtcatcagctaaacttagtcatcagctgagtgactaagtttgcatgtttccgctgacagagatcgattcagcgcggctaaggattcaagatgccgttcctatcaatcaaggcggcggcggcggcacagagagagcaagcgagcgacaagctacggcaggaaggagagaagaattctagcacccggtgttagtatgagtggaagagggaaggacatggcttaacgatgccaaggggcgccggggcaagatgacggcgttcggcctcggcgtgaaccaaggagtggcgccacgggcaccggggtcggagaagaggaaggcaaaagcggcgagcttgctctggtttggcggcaaaacggtcgcggcggacagaggggtgacgcgcgcgcgggggaaacggcgagcggcgcggcggtggagcgggagcgccgtccccgtccgcaccggcacatgcgcgacgcgtgcggttgctgggccgtgaccgagcgctgggctgggtcgacatagaaaggaaaaagtacaccgaaggtccctcaacttgtcatccagttacaaaatcatccaccaaccgaaaaaccagatataacacaccccctaacttataaaccagtaaaaactagatccgacgtggcgactgagtcagtgtgggccttatatgtcagaatgccacgtcagcaagccacatcagcaggccggcctgtcccttcctcctctctctctctctctctcactcactcttctctctggcaggccagccggtggtggggaggaggtcgccgaggcgaggaggtccgacagccggccggtgatgtggcggcggcggcgacgcggtggcggagacacgggagaaggggagggcgtcggtagggcgaggcggcgttggcgggcgagcgcgctggcggagaggcggtggcagctgcaacgtgggagaaggggagggcggcggcggagacacgcaagtgccgcttccccacgcgcgcgtgcaggagaccgtcgccgccagctacgacaaccttgtcgccgcggcgcacgggttcctcgcccgggagggccacatcaacttcagtgtctccgccgcgttccccgcctctccccatcaacttcgaagtcattagtcgccgcttcgagctcaaccaaagaaaatgatctgtatgctggaatgcccagagcttccaatttcactgtctgagatatgtaacctgtttggttgttccaggtaaatgcaacaagaagttagtatttcagataaagttccagaaaaaaaaatggcgctatcaagttagttactctaacactaggcaaagttccagagaaaatgacgccaaagtaaacgaatctaaaaaagagcaaaagagatacagaagtttcagtcaaagaatctgaaattcagcaaaagtttcagagattgtgccaagttggtgactctgaaattcagcaaaagtttcaatgaatgactgaaatttagcaaatgatccagctaatgactgaaattcaacaaattttcagttaataaatctgaaattctaggaccaagttacgctgacagggacaagtgaagcaccgagtggaagatcagcacaagaagataactctgaacagacaggactttttgcaagcttgcaaagtgcagatgccaatcctcatgacatctattcttctttggttagagaaggcctgtttgatactggtgatgagattctgtctatggatacaggggaatctgctgatactcctatttcaggcctagcgtcaggtttagcaaatcttggcactgctgatccagctgaaaggggctactcaataaacgagactacaaatgaggagggatacttgattgaaggggatgatccatcaccatcaaacaaagacgaacaagatgaccaaactgatgcacatggtgagtctacgccagaggcccagagccacaagatggctgctccatctcccccagctgccgcccatcttcgccaccgagcgccgccgccgcgcttctccccgtcctccccgtccgccgactccatcctcgctgccttcgtgacctgctgccgccgccgccgccgacatgcgcagcagtgggatggaggcgaagaggctagtcaaggcgcgattctcccgtgcgctccgggagagggccttcttcctcgccggcctccgaccgctccccgtcgcacgaaccctcctctccgccgcgctccgcccccccacccccccccccccccgggcgccggcgcgcccaccgggcgcggccctcctcccctgtcggctatgctcctcgacaggacgactagagaagagagaggaagagacgtggtgactgggaggctcttccccgtgtgcaattaagaaagatagtatgggcttgtttggtttgaaaccctaccaaaatattggtagtaccaaaccttaggcacattttggcactaacaaattttttatagtacagatttggctccactctattgatttggcaaaatttggctccaatccaaaatgctaacatgtactattcaaaactaccaaagaattggtagggcaagaattggcatcaaaccaaaatggccctatatgtccctgtgccactaaaatatttgagccctccctttataccattgtcgaattttatcgcgccctccacaccgttccgttgctattccgtttagatttaactatttggcagctctgacatatgggcccgggtagaaaaaatgtcgctcttgccctttcactcagtcttctccctcgattcccctcttctccctcaggcggtcaggccgccgcccagctggggcaccgcgccgccgtcgcctcggcccggtcgtcgtcgtcctgatcctcgtcgtcggtgcgctgttcctcaacctcggtccaaccggctcctccagcttcaccatgccgtggatccgcatggagttcaacgaaccagtccacgttgcggtggcggctccgcctccgccgctgacgcagatgcaagccggcgtcaacacgagcggcgaggacctccggccgacaacctccgcctccgccctgacggcgcgctcgtcgtgctccacgtccagccgccgccgagcatcgccgccgggctcaaccccggacccatccccttcggcggcccgagtaagcaatctctcgcactcgtcttcgcggaaattaggacggacacttggtcctgtggctgtgagctgtggttcttgcgaattttttcggtcgagctgggtgggtctgatggcttcctggatgtgccgcgcggctgatcaggcgaggtcgctggcatcactagtagcaagcatcaatagtcctcgccgccgtcggccgtcgttgtgctggtcctggcatcactagtagcaagcattactagtagcaagcatcaacagtcatgaacaccagtagcaagtatcaatagtcctcgcagccatagttgtgttggtcgtcgtcgttgttgtcgcagcgctgccgcccccgtcgtcgcgcagcactgccgccgccgctgtcgtcgcagcgccgcccccgtcttcgtcgtcgtcgtcgtcgcagcgttgttgccgccgtcttcgtcgcgcagcgatgccgccaccgtcgtcgtcgcagcaatgccgccgccgccgccgtcgcagcgctgcccccgtcgtcatcgtcgtcgtcgcagcgccccgtcgctgtcgcagtgccgccgtcttctcccctccgctccttggctgctgctgctgcatctgaggggagagaggagagtgctaggagagagcatattggaccaaagggcaactaagtcattttactgcgccattacccaccgttacaacaaaaacagacggaatagtgtggagggcacgataaagtttaacgatggcagagagggaggcttaaactttttagtggcacagaagcaggcaccatctttcttaatggcatataggaaaaaacctcgttgactggtgaggaagagacgtggcatccagaaatgtggggctcacgtgggtcccacgctgactcagccgccatgtcaaataaaaccagaacaaaactactaaaggatctaaaatgaacgattttgtaagttgaaggatgtcatatatctgattttacgggtgagggatgattttgtaactcgatgacaagtcgagggaccttcaatgtactttttccacatagaaaggagaggctagctaatcgagtggaacgatttgatcctcaggctagctaatataactctgtcaaatgaaaaggactgctttgtatggtcgctctataagaatggtcaattttccgtcaaatctatgtatgtcgcgatcatgaactgtaatgttcggatcaaaaagagaattctgtgggacttgaaaattccactggagatcaaggtctttatgtagtttcttcacaagaaagtatttctaacgaaagataacctgggtaaaagaaaattggagggggcggagacaaacattgttctttctgctatacacaagagacaatccaacatcttttctttgagtgtcatgttgctcagtttgtttttggagatgtgtgttttttgtttttaatatccccccaccccgtaacgccaaaaacattttcgataattggcttagaggggtatctaggtccattaagaagatgattctaattggagctagcgctgtatgttggtcaatttggcgttgtcgcaatgataaagtttttaatggtaaacaattatctaaccctatgcaggttatcttcatgtcttcctactggctccacttatggtctacaatgctaccacaagaggagcaggatactatgcgcaatggtgctacactcttggaatcggtagccaagggtctcttattccactatgggtggcgtagtttcataagaattgctagctaaaatattttatgtggtttaacattagtcaataataaaggggagttggggatttgtcccatcaccttatttctcattttgatttacttttatcttacatttttattactattaaatttatggctgtgtgtcttatgacagaagccggagatgcaatccatttccattatctaaaaagaaaggagaggcagcccaccagaggggaaaatgtttgaccattttccaggaaattatttgaagaaatttggggtctggtttgatttggacttgaattcaaattggatatttgaactcaagggttcaacaaggagtcaagaaggtaaactgaggtccccatcggttggcttttttcctacggcttattaggaaataaaaatgaatttatagataaaacttttatatacgtgtttttatgacttaaaaaccaatggtgaaaaagaaactacgttgaaaatatcttaaaattaagtttgaaaatttaacatttggctttttctttgactgattaggccatccgatgggagcgtgaatatgaattcgatatttttggaattgggagaagtagatggcaaggattcataggaagggatatttaattggaaacctgaattttgagattcaattttggaatcaaattcaacagtacccaatacatagaactccctcctgcatcgctgttgcctgttggtttcccgcacgatcaagcggacgggtgggcaagtgaacgcggggaacggaaatgctactgagcgatcgcccagggcgattagatttccccctcctctccctccctccctccacctaatttattttttttttcaccatattactttcctattttagtaaatttatacacctaaagtttatacacctcaagtttacatatctaaagttttttttgctaaaagtttatatatccgattcaaatttgaatttgaattcaaatatttttatatatagtatttctatacatctaaagtttatacacctaaagttcatagacctaaagttcatatatccgattcaaatttaaatttgaattagatctgatttaaatttgaatttaaattcaaatatttttcatatatagtatttctatacatctaaagtttatagacctaaagtttatatacccgattcaaatttgaatttgaattcaaatattttctatatatagtatttctatacatctaaactttatagatccaaagtttataagtcaaaagtttacatacctgattcaaatttgaatttgaattcaaattttttatacataattttttctaactttctgtttttttttaccccccgcgcggggaaggcggaagagagaggtcgcaaattcaggatatctcttgaaaaaaaggagagaaaattttcgtgccttaatcctagttacagattcccgagaaaagattttgagtatcacagtcacagagactagaagaatgaagaaaactttggtcaaaaggaaactgggaaaaatactactagtagttcataaaccactaccatgcacagagattcaaaatgaagatcaacaaaagcatcactagatcaatcaccttcagaactaaaaaggctagagatgattcgtaaacaattaattcaaggtgtctcagtctagcaaagtagcacaaccaaactactactatcaacgggtcggtgctattactcgtctaccactaacaggatcagaattcagaatatataagttcccaatcggaaagaccggaactggcagtggcgtcgaccttgacctcgtcgccggtgttgctgtcgtcagacccggcattggcagtgggatcaacctcctcgctggtgttaatgaagaagtagttgtccacaatggtgatggttgcagtcgacaacgacaccacggtggcttcgtcggcagccacggcggtggtactgctgctgccgacggcagtggcagtggcgtcgaccttgacctcatcgctggtgttgctgtcatcagacccggcattggcagtgggatcaacctcgttggcggggtcgttgttgtcgacatcatcgccggtgtggctgtcagtgtcagtgtcggtgtcgaccggcggaacagcagggtaggcgccgggcttgaacagaaccaggatgacggtcgtgttgtcgcccgatggcaagccaaactgaacaagctcctcacagatgacacgcgcttctgcaccctcctgcatagcgatattaattggtcacagcaagtcagcaatatttggccacagcaaaaggaacaacagttttaacaacgaaacaatcgagcatgcaagatatttttttgacgtaaacatgcaagatattagtcacagcaatattgatcaaggcaaaaggaacagcagttttaacaacaaaagaatcgaacaatcacaaagcagatgacagtgtacttattagcacttgtttttttcttttttaaaaaatcggatgctttatattgcctgagtgaagtcatttcctagaatttgacacaaaatatttttgctattacagtaggagatctcttgtcctgccaagaagacaaactgagcaaaagaaaaggactcaccaaaagacggtcatgtgtgtgatcaaccacattttgatttgtcatgttgcacctgcatggaaaaaacatagtacagtaggtatgcaactataaatgaaactatatatgcatcagcaggagaaagaaaacagcatcacaaagagtactagtgacatcaaaatgatcaaataataattattgtcagttattttttgttcaaaatttaccagaggccttcagttgctatcacaagaaactccatgtcatcagttatgtccatctgacacagaaagggggattttccatcagaccccacacagcagtacaaacttcaaattcaaccaaatactaaacaaacatagttgcacttacagtcaggatgtccggattacatgtcagcatttgatcttcaggaggtaaacgttcgttcttcttgcaagcgaagtcccctgaaatgtaagtgggtacaacacatcagcaaatcacaacataatatgtttttttttcggtgctattatctgcaataaacgaaaaacagatccaggcaagactataccaattgatcttgagattgatactcttcccttaaaatcagtgaagccccattgtttcttggttacccacctccccattattttacgataactatacccaacagctactcctcctgcattctgaactctctctctttcagactcactgtctggtttatgatcgacggataatgcactggccttttgacacaacagaaacaagcacaaatgttaggcacgaaaataagtgagcatgcaaattaggtaccaacaagaaattcgataaggaaatagtcactatacctgaccatttcttgagagtacacaacgagaatcaccagcatgtccaacaatcaattggttacctctgatgacaaccacacatgctgtgctcccttcatatgctggctcagtataagttgcctggaaaaagaagaaatgaattggaggacataatagggaatcccaacatagttagaaatacaagtcaagcaagaaatagctcaccaaagccaccagacaaagaaaaacatttctgaaagccaaaccagtgtatgaaagagattaccatagaagagatgccgcaaacaatacctcaatttagggtagtaccacagtatgataagaaccaaggtgcaatgtgaacttaagaacctgttgcctccaacgcagtaaaccagccaattgatatgtaactaactgaaccttttttaataggagcaatt

SEQ ID NO: 13931 - DNA, 1414 bp, Oryza sativa
cagcgtcaccgagaagtaaaatataggtaacaaacatgaagaaattgtacaatctcgcagaaccaaaaccgttgggcttagaaggatcccaaatctaagattcaagagatgaaagcttctttgatatgcaaagagtcagaagatttctcatcgaaaagggaaaaaaacaacaagcagtttaaccaagctacacatgcagaaatcattgtatgaacagaacatggagttctttccaaacagaaactaaaccaagagaacacgtcagagagacacatagagaaaaagcatcctgcatcaggaacagccaaaagaacaagaaggccgatggcggcatctggttaataaattctcagaaactgaactcccgcaacacaccaaaattaacagaacaaactgaaaaatacaagcagagaagacaaacgaattcttcgcgcacgcactggtgtagtctttgagacacacacagcaagatcaagaccaacgtgttccaaggagagaagcgaacggagatcaccatgaagcttcggcgctcatcaaccttctcctccaactcgaagaaaaccacacccaacctcaaacttcaaaaccatcaaagcaacaaaagcacgggtacgggaaaccaagaacaagagggaaaaaaaaaagatcaaaccgctgtgaaccttgccccaagtttcgggtgccgaaacgcctcaagattcaaagagaggtcgagacgcggttgctgctcgatcaaatgccacacagcgaagacatgatcgaaccagagaaccgcgataccaaacacggccaagaaaaatcgtagaaaattcggattccgaaacgccttaagattcgagacgagaagagaacaaggcgcggtgctacttgatcagtcgtaaggaagacgggcgtataacgtattgcatcaggaacagcaaaaataatttggttgatacaaattcagaaagtgacacctccgcaacacaccaaaacagaagcgaaaaaaaaaagcagagaagagaaacgaattcatggcgtctaacttctcgcgcacgcactggtcgcgccaggaaccatcaagatcaacctccatgaagttccgatgggagagaggcgaacggagaccaccatgaagttccggtgctcgtcaacctcctcatccgactccaaaaaaaaccacgcctcaaatgcatcaagcaacaacatcacgggtacaggaagccaagaacacgaaaaaaaatagagaggatcagagggcggtaaagaggttcaagtttcggatgacgagacgcctccagattcaagcaagatttcggatgtcgctcgatcaatgccactcagcgaagataagaacgagagaaccgcgacacgaaacaccaagcaaacaaacaccaccaccaatggaaaaacgaattgatgtggtttaatttct

SEQ ID NO: 13932 - DNA, 7984 bp, Oryza sativa
ctacacccacaaaacccatggataccctccggagtaccccgttcgattttttcaccataaatgataaactaaaaagtccctaaatggctcaaggttgaagaaactgtgtaattgaactcccccaatcttttgttcctggatccgcccctgcctgtaatacgatatgatcaagcctaagcagaactagctgagcaggaatttacatggcaagataagtatatgtttatttacaacttaatctagtacatcgattcacatcatgttcgcaaaatggtatgatgatattatcaagcttagaaggtagagagacctgcttccgctggctttgctgtgatccgccgattccagtgctcgtgatgtctgaagggccatctcagaatggagccgcaggcagcacatacccatctacaagacaaacatgccaatggaagagtcagatgacactgtaaaatgttattgagtttccagcttgattggtttctctttatacgataaaaagaagtcctgtttttctttacaaattgctgaaaagatctggatcactgaatgagtataatattagactaaaggaatgagaggaaggagtaggttactgaaaactaaagcatatgatgagtgacattagctctttatttttcagattgtgaatcatatcacagtgaaattatccattctttcaaactaaaatcaaaggcaatgcagacggaattcgatataacatttgtccttcatctttcgccgctactgctcttgagatgagaatgtgtgagagagggagaagcagaaaagtggttgtgcagccagccaagcgcaaggaaaagcagcattgcgcttaaatacctgcaccagacgcatctcggccgttggatcgtccctcgcggctaatccaacgctccgggagtgccctgtcctgtggctggtggtcaccatggagcatgcaccttcctcctcctcctctcgccctgaagacccgttcacatgtagtaattttcttttgctcaactaatcagttcaaagttttcaaacatagtagtaatctggaacagacgtttcacataaatcaattcatgttgggaattcatgttctatgtataaatgacgaaaaatgtagcactctgaatcccaaatacattgatcgatttatatttctaatccagtacattgatggtatcaagcttaaaaggcagagacctgcagctgctggccatgctgtgatccaccgattcagtgcttgtgatgtctgaagatctcagaacgaagttgcaaacaggtcataatggcctgcaaggagacagacatgccaatggaggagttagatgacattgtgagaagttactgagttccagcgtactgaaatggtttctcattatacgtttttttttttgaaaaaaaagagtccgaattttctctacacattactgaaaagagctggatcactggttgaagtagaagacttaaaggaatgatagaaagaagtatgtcacaggaaactaaagcataaggtgggagttattagctttttatttttcagatggtgaatcatctcagggtgaaagcactcttccttcaggataaaattaaaggcgacgcaaatgaatttgatataaagtttaccctgaaaacctgtactttgttggttgaaaaataaccctgttagtattatgtgctgagcctattgtactataattccccccccccccccccaatagtgaccaaaatacatactgatatgtgcattctgtatcaggatcagcttctgcaacatgaagaacccatatgtgtatgtagaatgtcctgatttccttctataagagctgatgagacatacaacaggtgcagcgctatcaatatgcaagaagctgcaaacaacacagaccttctgacatatgcttcaggatgttgtcaaacagctctgtagaacaaaatttgatgtcaaaatggtaacttaccaataaaattccttaacagggaaatgtttgtttaggcttggcatacctagatctgatcatatcaagaagacctggggcaacagctgatgcttccggatgcattgccatgcacttcatacagacaccgagcatgtatatcaatttacctcggacaacaaagtcccgattgaggaagtcaataccatgtgatcttttatcatattcttgcatgactaggaacataaaagcagcagcataagcatacaaaggaaatttgtttttggaccactccgactgcaaatctttagtttttccaagacgcgatttacaagatttccctgatttaacttgacatgatagatgaaactctttcataccagtgtgaccaattcagaagtgtcctgattatgagacttccctccaaggacctgcaacaggaggtcccctgtcactgaagtagctaaatttcgagcatgtactttgtcaaccaggtcacagggtaaagtatagagatatacagatttataccttctccccaacccttatgaagtacaaggatttggctatatgggcctcacgcacttcaacctcacccaaattctcttcagcgtcagcaattcttgatacatgaaaaataattactttcagaggaagcaatgattcttatcaaacttgctagtaactgaaacattagatacagaacaaatgcggagagcagcacggaagatatatgcgaccagctaaaagggcatgtgttgatgtctggaaccaaaggatactatttacgctctaatgaagttctatatctcgactttccttcacattagttcacattgggttttatccttggtgacgagggtgcagaaatttttatattggttgggaagttgtgaattgtgatccttaggaatctatattggcatattgcttttctacaagcccaattacacctgttcgtttaggcaaacgaatcgtagcaaagacttgagttgtcacaaaatttatccccacatagacttgagttgcctacagccataagaacagcaacgggcaaacctaattttctgagcaataagagtaacacgacccgtcgatccgcggcgcgcgtctcggccagcagcgcgtcgtccggcagccaaccccgcataaaaaaagaaaagaaaagaaaaaccaaaacacgtcagctaccggcgtgcaggcggggagccggccgatggatggagagagagagagggagagagacggcggtgcggtgccgtacggcgtggaggacgtcggagcggagggcgaccatggaaggcgaagcaccatcaacccggtggcgctcctgcttctcctcctcgccgccggcgtccatgtcgttctcgtcggagtgggtgttccggttggggagggattgagggtctctcacttttttttcagaacttttttttagaacaacgagtctctgactctcactctccggtttcaggcaggaaatgcttttcagttggaaaagtccacttccgtctcttatggaggaggtcgagtttcaattgcggccctcaattctaaaaccgggtataagcaggattttttctttctaaaaagctagaaaatttcggtaggcaccactccaaacgaaaatttttgaaattttaacacattcttttactgaatttgaataaattattgccaaattaacaaatatttggaaaaacaaaaggtcataattaattttaatattttctaacttattttatcaaagaaaatttaccaaatcattctcttaatgcaacgagaaggtttggtttcataaagttacagagaaaaagagctcccaatcacttagtagtggccaaaacttaatgaaattaatagacgtcatatagccgagctaacattactgcatattctaaatgaatgagttaactaaaaacacactcatcgagttggcataaaaaggtaagttggatcctccatgtagtgcactcctacttcttcgtacccaggagacgtttgagcgcctccaagggaaagccacaaccacggtatgagtttttcgttttggggctgcttgccccttcgcctcgacaaggaggtattccagccatggacctcttactcttcttctgatttattaacttatctttctgctttgtcactctcgtattctgaataaaaatcggcaaataggtacaaccaccctcgaaaaattgaacatccctctttaccttatttaccttagtgtcttttacctcattagcatttttcagaattattgtccctacctgatagatgctttcaacacttcgagttggtctgccgtaacatcctgcaggaaatgttggcatcaatacttgaggcgactggtgtcacgccccgaactagtcccgaccggaactagcccgtgacgctccaaattaacctgttattcgataccagtcccaggaaacagtgctggtatcacagggagacagaatatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactactcatcagcagcttccgcttcatcttcttcagcaactggggggggaggattatttatatagagcaagggtgagtacgggagtactcaacaagccatgggaaataagtgtttaatgcaggcttcgaggaaaggctgttgtttttgcaattgattttatttgaactcttttctaaaaacaactaagtgagtgcttctcaaacgacacggatgagacagtgcgtctcgtccgctcggagtatgtgcaatgtatcagtctttagaattgaatcaaggttggcacccggccaacagtttttcaaacggccacccgggccaacaactttcaaacggccacccgggcctagctgatcccatcagctgcagatttttcaaacatcgaacccctttccacaaccgtaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtgggaatcagccacatcgggagacctccaagctttcataacaaggcatttccaaagccgacacaggtttaccatatgccgacgagaggggtcccagaccaacaacaggttaggtcccagaccatactgtgccaggaagcccagagtcctccccgacaccacctcggcgaatccacatgtctctcggcatcaaggctcccctgataagctagttactcagctaggggtgtcccattccacccatatggtcgtacttgtcttatgtttggatgaaattccaaggaaacggtccttaagtgcaagagcgggaaaccgtactcccggtacgttccccggtccgcggttttggaaattcatttagttcgcaagcaccgacccaggtgccgggttttccaagtcttttgtaaaacccaagttttacccaagttgttattcaaattttaagtttgaaggcgtccgtcgatactcgcacagggtgcacgaatatcgagacacaactagatggatacaaggggacatgatataacaattaacaaaggaaggatcaaatgcaacaaactaggtaggtccgccaatctgccttgcagacgggacaaacagattaagtgcggtcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttatggttgggaagatattgaatttctaagattattggatttttggtctaaaggaaaaggatttaattaaatcctttttgaaaagaaaataaaagaaaagaaaagagggagggaatatagacttttctcgggcggctagggcgcggcccgagagaattggggcggtctggccgagctaaatgggccggccggcccaaggcgcgcgctcgcgcgggagggaggagagagagagagccggtggaccgggctcaccgcgcgtggtcccgggtgggacccacttgtcggtgactccgttcaccgtgcggagcgagcacgcggcgcgcgcgcgcgggcggggctgggacgcggtgcacgcgcgcggttcgcggaggaacggatgcggcgggcccacgcgcagcctcacggctcgcggtagaacgtgcgcacgggaggggctgaccggggtcggcccgacccgacctcggtcgagctggcgccgacgtggcgcctacgtggctgccacgtgggctggcgggaggaagacgaaggcgtcggccgcgaatggacggcgggcggtggcggtttctcggggacgccttgcgatgatgaggggcgacggggcgtacaccgggatgacgagggagagtgagagggagcgagctaacggctcggattcgccggagggagtccgtcggcggcggattgcggcggcggcacccggcggaaagaaaagggggaaacggcgacgaggtcacgaggggccaaatcccggcggtgagagcatctacgcggccacgggaatccgttgctagcgtcggattgggcggagctacgccgagcgaggccggcgacgagcgggtgctacggagctcgggcggcgacggcggccagcacacagcgagcgacggcaacggtcggggcggcgccggctagctacggggaggctactcgagctactaccgaaaactaagggggggagatggagcgaggaggaagaacggagggaggcactaccgagatgaggaggggcgctgtgacgagaggccgacggcgcgagagtaatctctccggcctcgggccggggaagaggaggaagacgagcgcccggagtccccttccgcgtcctcgcttgtgccggttcctccgacgcgcgcaacgacgaacggcgacagcgaaacagaggggcagcaacaatggagtggaggcgatgggaggagaagagagggagggcgcccggggccttaaagggcggcaatgtcggtttggaaaccgacttgggcggtcaaggcgcgagctggcgctcggcactcgcgtccaatcggcgacagggcggagggaggatgacgccggcgggaggaaaaggggaaaaaggagggagagaaagggggggctcgcccctttcttctttgggaaaaggaggaggggagcgggggcgtcgcggcagagggaggagggctctgcctccgttccttggcggcttgcgcgcggagtggcggggccgaggcgatgacgacggcgatgacggcggggcggtttggagtggagcggcgacacgggcgacaggcgtgggcaggcgctgacgacggcggcgaccaggcggtcggccactcggcacgcgcgcgcggcttgcaacgggaggcgcggcggatggagcggcgcggctcgggcacgcgcgctggctgcggggccgagcggcggcgcggctgcaggcggcagggcagcgggaccgggtgacgcggacggcgtagacggcgcggcacgggcggcaaccacgcgggcgcgcgcgcgaacgagcgcggggagcggcagcgagggagcgaagaggagggctcggctcggcgcgggcggctcacgcgcacgcgcgcgggcagagcggagggggaggggcgctcggcgcgggcggctcacgcgcatgcgggcagagcggagggggagcgctcggcgcggctcacgcgctcgcgcgtgcagcgcgcgggcggagcggagcggagggaga

SEQ ID NO: 13933 - DNA, 13195 bp, Oryza sativa
  unsure (1)..(13195): unsure at all n locations
atcgaccccgggggaggcaaactagacttttgcggaggaatttgatttggaaggatttggattcggaattgaactcgatgatagatcggggatttgagatctgagatggcacggacactacacaacgagcaaggaaacaaatttcgcaattagggtttttaagagataattttcccgctaggcgccacgacggaacgggcgctacaactggtgatacggaagatgtgcgccgggattgattacagccgtagttcctcgttccatgtcgtatacacacaatacttttccattgaaccccgagtagtagacacaattccctctcaagcatgttccctctgcatcaaatgacgctccaaaactgccaatctcaacgaagaacgctctaccacctagcgaatccaccttcacccacgctgctgatctttgctcctgcgttgtcgtcggattaatgctcaacctgtaaacgcctacacgcgcgacaatccggtcacatccgatcgggtgagagaagacaacggagtgcagctccccgtttgattccacgaagctagtagtacgtttcttgtacaccgccggtctcctatcgacgtcgtgtacggcgatcttggtgaacgccacctccggcgagaactcgaggacgccgacaatgccagagagttcttcggtgtagaacttgccgtcgatcgccgtaagctggcgtaatccccagatgatggcgtcacggtgggcagggttgcggtactggtacggatgttgatggagcttcacccactggttgtcgccggggcggcaataccagagctccgggtaggcgaggtcgatgacgagcacggtgcagctggtcgggtccatgggaccgcagcatgacaggaggcacctccggcgatggctgccttcggcggcgaggacggtgccgtcgtggtcggggggcagcccggcacggcggccggtgaaagggtcccataagaatgtgcacggcgagccgcggcgcgccatgagcaaccagccctgcgccgtggtccaccagcggtggcctctcatcatgtcgtcgacgccgccgtcgcccaccctcgttggcgttggcattggcagcagcgctctcttcggcacgctgtacaggaacgtggcgtcgccgtggccgaacagcagcagaggagcaagcttgggatccagagcggcagatgcgttgactgcctcctccatgatttcgacggacgactggccgatcgatctttcggtatacgaatttgtgcagtgttttagaaatcctacaagtgttgtctcgtgatttctgttccaaatcatccgagataaagaagcgatttaatagtagtacaagtctacaagagataaagaagcgaagaagtatgcacacctaagacctacaatcagtaactcctaccaattataatctgcaccggcctgtagatcaggaaaaggaaacatgaattcctacacgacatcaaaattaattgtactagtactccagtatgcatctatttggagattggatagcaaactaacaaaaactacaagcggaagccgacctatattacgccgtgcaggccatcgcggacacgcacgcacgcacgcacgaactctcgcgtgtggaacaccagccaggccggcgaaaaagaagcggaagcagatggactggtcgtctctcccgttggacatgctcgtgctcgtcctagataggctcgggtggtcgagccacccgagcttcgcgtcgacgtgccggcactggcgctccgccgtgtcgcccttccgacggcggcggattgcggcggtgttcgtcggcggcggcaaaagagggaaagcacgacgtgacgacgagggttcgatttcttgaagctagagcagacacacgaccaccgggactcgttcctagcgtcggattggacgaagcagagccgaggagggcaagcgacgggcggcaatggcggcgagaccatgccgagcggcggcggggcttggggtggcgcctactagctatcgggtgtgctacggggaggagggagagcgaggagggggaacggaggggataccgcgacgggacagggcgccgtgaagagaggacacggcgcgaaacgtgatcgttttggccgaggaaggggatgaagcgggagcgcggagttcacgtcacgcgtccacgaacgcgccagctcctccggcacgctcagcgacggacggcgacagcgagacgacaatggtgtgcgacagcggtggagagtgaaaacaagagagattgggatggcgatgtcggtttgggaggggagaaccgaccttgggcagtcaaatggctcggctggcgctcggcgcacgcggccaaatcggcgacagaggatgacgccggcgaggggaggaaaaagaagaaaaagaagaaagaaagggggggcactccttgccaaaacgggaaaggaaggagggagaaggagcgatgaggcagggctctacctccatcccttggacgcacgcgcacggagggcggggccggagtggatgacgccggcgatgacggctaggggcggtgtggagcggagcggctacagggtggcagcgcgggcacagacggcacaggcgcggcagtgttagatagtatagggagagaggatactgcgaatattggacacattgtattgagcctcaggggggccgatatatataggagtacatggggagaagataaggaagaattacatatatggaaggaatccaaacaaaccaatcctatcctaatatgactctaactaccatatactctaacatcccccgcagtccaagcgtgagcagcgcggacacttggactggagaagaaaccggaaagagtactcaacacagatgatagccctttgtgccatagtcgatgtaaccaaagcgaaggagccgagagagccgtggttgatgaagccgtgcgtagagtagccgtggtcgatgtagccgaagtcgggaagtcgatgatgtcgaggtagtcgagccgtaaggcgcagggggcgtcgtagagtggtcgtggatggacgggagggcatcgtggaccaatggtgcgtgaggacgcgctggagacgaagacggtgatacaatcgcggcggtcgttgaggaagatgacgccgaagagccaatgtagtcgaaccgtaaaggacgagacgttacacagggcttgccagaccccgggacaactcgggacaaacgcgcgcgccggtgttgccaataccgcgcgggcgagacaggagaccaccatgaatcatacgccaatgtcggaggagactagcagagaaggcctctgggacagtcgcagcgcgagaacggcgtagagggagaattgccggagcagcacgcagttgccggagaagagcgaagtgtagtcgaggaagatacggcgacgctggcgatgagtcatgctggacaaagtagaaggcgaaatagcgggaccaacggcctggacggcgacatcggtagccatgtagaggtagctgcaccaccggcctagagtggcgacagtggcagcttggagatgcggcggcgatgcttgaagtagaggaaggagaccccgagcggctgactatgaccagtgcggacgacgaggttgtcgatgcgcgaacggcgatgaagacgacgaaagtggcaaagctatggtccgagaggacagcacagctgcagctccatgtcgatgcagcggcgagaagtccaccggcggtgaggccacgctgagaagggcgcctctcagcgttgcaatagccaatggaggtgtggaccataggcagcggcactgcggcccaaggaggcgacacagcggcaacccagagcttgatggcgtagacgcatgctcgatgacgatcggttacagaagtcgttgtagtcggacgcttgaacgggtgatcaagccgaagatgcgcggggcaggacgacgaagtcgatgccgatgtcagagacgcgtagatatcgacgaggcggtggacgacgcaaacccgatctctgatcgggaaaaaaaaagatacatgcagcagcaagcagcacagtaacaaccagccctacgtgctcaaatggtccgtagaccaagtccacgtccagcaacctctctgcctcaactgtaccagcagcagcgacacatgcacaatcggttccctccacagccagccagccagccaacaagctctctgcaaccatcttctctctctctcctctcccttgctaatcacgtgtaagatcacagcaaagtgacggacaaccaaacaatacagggagcgagaggcaagatagacgcggacgcgtaggggctgaccggcggcaacgacgagggagctgagtccggaggcgtcgaggccgcaagcggcgacaatggtgcagatcctggcggcgaggtgtcgggccgcgcgcccgtgccagagacgccggaccagcagcgtcttgccggcgacgaggcagaaggcaggcggagaggcggtgaagacgtcggtccatccccccggcggagcttgatgaagacagcggtcgaggcggagacaaggtcgtccgtcggccgcggagcccggcggaggtcgataagccgacggtggccatcggaggtaggggcggtggaggcggcggaccggaggtggaggacgaagtgcagactgatgatgaccggagactctgctactgccgcttgatgacgacgcaagcgtccgagagatcgatctctctcgggacatcgacttgacgacgcgaaggaaaaaaaaacggtggccgccccaggagattgaaaccctcccgagggcgacgagcggaagcgtgagagagaggcgactagatcgtctgctctgataccatgttagataatatagggagagaggatactgtgaatattggacatattgtattgagtctcagggagccaatatatacaggagtacatggggagaagataaggaaggattacagatatggaaggaatccaaacaaaccaattctatcctaatatgactctaactaccatatactctaacaggcagggctgacggcggcggcgaccggccggtcggccaccacagtgcacgcgcggcaacaggcggcgcggcaacttgggtgtcgttggcgggaaatcggggagagagagaacaaagagagagcaagaaaatgagagagagggctctctctcggctcggctcagcgcactcgcacggcatgtgcgagaggaggggatgggctgagggagaagatgtgccgagggagggagctcggcccacaaaactttagggaggcgaaatagacttctgtcgagagatttgatttggaggggacttgaagttggaattcgaacttgacgatggattgggggattgggatctgacgatgttagctaggcgctacgacggaacgggcactacacaacgaggctttctcaggaagaaagcagattggggagctgttaaacacctaaaagaaaaaagaagatggtttcataaaatttcagagaaaaagagctcccaatcacatagtagagaccaaaacttaatgaaattaatagacgtgacatagccgagctaacattagtgcatattttgaatgaatgagttaactaaaaaaacactcatcgagttggcataaaaggtaagttggatcctctatgtagtgcactcctatttcttcatacgcagaagacatttgagcggctccaaaggaaagccacaaccgcggtatgagttcttcgtttcgggactgcttgcaccttccccttgacaaggaaatctttcagccatagacctcttactcttcttctgatttattaacttattttgaataggaatcggcaaacaagtacaaccaccctcgaaaaatcgaacatccctcttcaccttacttaccttagtgtcttttacctcataagcattttcctgaattgttggcccaacctgatagatgctttcaacacttcgagttgctccgccatgatatctaggaaatgttggcatcaatacttggggtgactggtgatacggaagatgtgtgccgggatcgattacagccgtagttcctcgttccatgtcgtatacacacaacactttcccattgaacaccgagtagtagacgcagttccctctcaagcctgttccctccgcatcaagtgacgctccaaaactgcctatcttaacgaagaacgctctgccacctagcgaatccaccttcacccatgctgctgatctttgctcctgcgttgccgccgcattaatgctcaacctgtaaacgcctacacgcgcgacaatccggtcacatccgatcgggtgagagaagacaacggagtgcagctccccgtttgattccacgaagcaagtagtacgtttcttgtacaccgccggtctcctatcgtcgtcgtgtacagcgatcttggtgaacgccacctccggcaagaactcgaggacgccgacattgccggtgtgtagttcagtgtagaacttgccgtcgatcgccgtaaacttgcgtaaaaacctgatgatggcgtcacggtgggcagggttgcggtactggtacggttgctgatggagcttcacccagtggttgtcgccggggcggcaataccagagctccgggtaggcgaggtcgatgacgagcacggtgcagctggtcgggtccatgggaccgcagcatgacaggaggcacctccggcgatggctgccttcggcggcgaggacggtgccgtcgtggtcgggaggcagcccgacacggcggccggtgaaagggtcccataaaaaagtgcacggcgagccgcggcgcgccatgagcaaccagccctgcgccgtggtccaccagcggtggcatctcatcatgtcgtcgacgccgccgtcgcccaccctcgttggcgttggcattggcagcagcgccctcgtcggcacgctgtacaggaacgtggcgtcgccgtggccgccgaacagcagcagaggagcaaacttgggatccagtgctgcagatgcatcgcctgcctcctccatgatttcgacggacgactggccgatcaaattcataaatccttataaataactattggcataggaaagaggtatgcacatctacgacctacaattagtactcctaccaatcatctgcaccacccgttgatcaggaaaaggaaacatgaattcctacacgatatcaaaattcaaaccactacccaattctaaagcaaaatctaaatactttgcatatatggagattggatagcaaaccaacaaaaaccaaccggggcgccggggcggtatacaatctccaagcggaagccgacctataaggcttattggctcgctggtctctctttttagctttttgagaatgaacaaccttagcaactaacttttatttattttagaaaaatctttgttcaagctacatggctaatggcttatttcagggcatgtttaatgctgacctaactacctgttttagcaagtgaaggattgcccatgtttcgaatttgggttagcggattaagctaaccttgcctagcaaaactctgccagtcggtcagcttgtataagtttaacgcatgacttcaacacagggcatataatgactgcataaagactatcatactttagttactgtactgccagatattgaaaattgccctttgataggtgatcgcgtaatcacaatttcacaattataagtggagttcacaatgaagaagtagatttgcttaagacatattgttcaatcagtctatcaccttgttgatttgattagttgataacttgatatggcttctttgttccatctttgtatttatgagctaaatatttattttgtttgaaaccatcagttatttcttgaaatattctgttgtctgcagtctaatgttagttattatttagttttaataatcttgctacatatcatgcatagatatgctttctgatggctatctttactgaatatgcttcaggaaccgtgctaacaatcgacgcaattattattgaatcagttggatttcatgatgttttggggatttattatattttcctttattattattttggcttgactgctatataaggtctccaaattagttgataaggtcttatccagttgttgggtgttatggtatcaaacttaattcattattcctctagtagatttctatgcagtgaaactgccatgtttcttttccacaaatgggctgaaaaatatgtgccttacaccgaccatgttgataactactctatatctataaggaaatccttgcaagcaaacatccttgtatgagcccctctactccattgtattaatgatgccaatactctgtacaacatgcaacttcatgcatctaatgcaagctacctgcaatcataatccccacaatcagtcatttacaagtcaaatgtgttttttactcagagtttacttattatgtccaatagctgtccagaatcttctaaccttgacatgtctttatttgattattcatatttccaataatttttttatgggctatcttttccttatccatgtgtttttttaatgatttatctgtatgtttaagcataacaatttaatttatgaggtgattttttttggctgacactgtaacacttttgttataccaaacagatagggctgagaaggctagttatttgtacaataatgatggagagaagagccatgctccttcattaaagaaccttccaccaattatccctcatgagacttttttcagcaatcctcagaatgattacagtcaaacaagattaatacccttggagggatgttgtgccagtgaggctgcccagcttctcaatgaccgtatgtttctcagagaccaagctgcccttttaaatgcttgtagaagttctatgatataagttcttatctttttgactttctgggaattgttgcatgttattgtggtagtgatacattatgtctacagtaataagatattactcattttgtcccaaaatataagcatttttagcatagtgctaagtcaaccatttttaactttaactattaatagcaaaaaaataaaaaaaatcaataatgtgaaattgatgttactaaatttatcattaatcaaactattattatatgcaactctttttatttaaaccattttatttttatagatattgttggtcaaagtagcatctcgaatactatgtcgtggtctaaaaatgcttatattttgggacggagggagtaagtagtaaaagcacatgcagtatattacagaaccgcccattgctttaataagtttacacaggctgataatccaatattcagatactgtaagttgtaaagaaaaatacgtggagcacctgttgtgatttattttggggttctctgcatgttagtaacatggaagaatattcaaactgtgtacctactgcttatcctatcttttttgttcattaatcataccatcaactgttctctttatgtgcaattgtgcatatgccaccggtaatttaccggaagttaggcaacttttaatcaaggatggtctaggcatatataacaaagatgtattcctacagttgctgtactaattttgaaccaactttatttacaaccattcttcttatgtgataataaacctttgctgcttttcccctgtaggttgggctgcagcaatgaacttgtacaatgatcagtcatatgattcccctggtgagtccttaagcaaattcaggccgcatgatgggagatttactatgtcatgaatcatggtagaggaatctttagatattttaggatcaatttctacaagacctggcatactatcctagacctatgtttaatttagattaccgtttcataagttatgatagaaatatggaggtgaatataaagtgttggcaacagtagtgacgccgcacaattatggtgctagcaattatagtattgtatagcaattcgtgatgttaatatgttactatgaacaccatcaagtaccctgtgcactcaagtgaattttcatgtcagttgtaccaacgggaagcactaaaccaaagtaacctattaaatgctgttgatgttttgccagataagccggtgatgtactctggatctagtggatcatcatggggtcatggtcacatgaaacttcctcatcaggtatattgaacctgcgattttgtcatactgttctcctacgtcttagtttctgtactctgattccttttctgtggtcattggtagtacagatgaacttctttgaggagttgcgccgtgccctagatgagcaaccagtcacaggaccgtctgtcaacacctggaactaatcaagctcaagctgcattggagtgctaagatttacaaaaaagcaatctattgccagttcgctgtgtgttgtatcttgtactccctccgtcccaaaataagtgcagttttgcactattcatctccaacgtttgaccattcgttttatttgaaatttttttatgattactatttttattgctattaaatgatagaacataaatagtactttatgtctgactaattttttttaaaaaaatcataaagttttcaaataagacggacggtcaaacgttagacacgaatttccacgactgcacttattttgggacggaggtagtactgaaactgtatgcatgatgtgactataaatgctttattctaacttgcaactcctttggtttatctcaaacagaaacggcaatcctgcccatttgtaaccttatggatggaaagccagcctgctgtatcatgtggagtactttagcatgcagaagtgcagaaccaatgctatatatatatatccctctcttaagggtgaacttttgcagttttgtcagatttgttgctgcgaaagcatttttttgagtaaccttattcatacctatttatttaagtgaataatgcaatttgatgtaacagggcaaaaggctcgaatattggcttaaagtgaacagatgtatgataaatacacaagacacatctattcaccactgaattttgtggagcagcatctccaaacagtcattgcagagaacagtaaatagtagcacagcaaaatggatcagctattagtgaagatgaaaaatgtcggttttaggcaaattaacatccacctgttgtccgcttgaatgatgtttaaagtaaacagagaggccatgcatctcaatctacaaggaacgagattttcgtcgataatacaggtttgtgactttgtataactacacgacttaagagcctgcatggatttgataacgcttgacaacgggtgccggtgggccgaggggaattagttcccctcggcaacctccggcgagaactcgaggacgccgacattgccggtgtgtagttcggtgtagaacttgccgtcgatcgccgtaaacttgcgtaaaaaactgatgatggcgtcacggtgggcagggttgcggtactggtacggttgctgatggagcttcacccagtggttgtcgccgggacggcaataccagagctccgggtcggcgaggtcgatgacgagatcggtgcagctggtcgggtccatgggaccacagcatgacaggaggcacctccggcgatggctgccttcggcggtgaggacggtgccgtcgtggtcggggggcagcctgacacggcggccggtgaaagggtcccataggaaagtgcacggcgagccgcggcgcgccatgagcaaccagccctgcgccgtggtccaccagcggtggcctctcatcatgtcgtcgacgccgccgtcgcccaccctcgttggcgttggcattggcgccagcagcgctctcttcggcacgctgtacaggaacgtggcgtcgccgtggccgccgaacagcagcagaggagcaagcttgggatccagagcggcagatgcgtcgactgcctcctccatgatttcgacggacgactggccgatcaaattcataaatcttaactaatataaagaatcgtaattttcctttggcaaaattttcctttcgtcacaaaattttcgtgcgtcaattccgaccgattcgtccgtcgattccgactgagtggccctctatcttcgctattttacagcggccaaagaaagaaaaagagatcgataaaaatcctaacgtgtgtagtccgtagcccaggtcgttccaaaatcgaaaggaataagactctaatccacctaaataaaatctgaagcatgatccataggagaaccccaatccagctgtgtttctaaattccaaatttctaactagaacacgaaattaaggttcgagtgaggcgcctggaggggataaggttcgagtggtgggaggagatagcgcctgggaaggggagcgagaaaacggttcccattttctttatttattttctttcctttttaaacgctacggtcctccggttagacatgaaagtctattgaaaatatctcatttgctaaaatttataaagacaactttaagtaaataagaaaaatacaaaatcaattattctacgtgaaagtaaaaaagactttcactttactttcacgtcaatatagcgttgagaacaggttgtattttttttcgaaacacagtatagatacatgcattcatataaacacgtgcacattgatccatatgaaagcacacacgcacaacatatctctatgagaatctccaagactaagttggtatattttttagattagagatatcatcacatgcgtctatcgaatcttgtttaatctttctattatctctatctctactacttaaaaaaatacttaaaaaattgaaggtgttttcgtcatcgtgataaaaaaaaaggcgaacaaatatataatgataaaccctgagctccactcaagatgctcaaagctgttgtttggaccgatctttcggtgagttgagataactacgatttggaagaaacgttgatgatccgactacaaccgtacaaggcattgcgttgcgcccttagcgatcgatacacctctccgattcataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13934 - DNA, 581 bp, Oryza sativa
acaatgtgatgaacacagcagatcagcacttcataggtatcataagaaaaatagcaccacacataaattaaccaacatgttcatcagtggctatccttttaattatcatgactgttaatattaactcacaaccatgcagtgttttatccctcgtaaaataatatttctgtttaagcagttcatgttatcctagaaagcacaccgcacaaaggtgattagtactaattagcaaacttggttcattatccagaactgtagcctaatatttatttgagaattcacaggtaaaagtttcagcataaacagtaaagttttcaaaacatgcacgcagataaacacatgacatacaaagacaaacaaagcatgatgtaaacagttatgccgacgatttggaggatttgaaaccaaaaaaaaaaaaaaaagagagagaatgaagatcaaacctccatggccatcataaacgccaaagaatgacgtcatggtatcatcaagatttagaatagctgcatgctagagaatatagagggcatatgtcagtcacagtattttacacaattacttacagatcagtaagaaatttt

SEQ ID NO: 13935 - DNA, 642 bp, Oryza sativa
tgcatttacttgttttaactgtccctttgtttgtgtcccctgcaaacctcgtgcaaagcgacaatgggccatactccgagttgcagaggcaacaagttctctacgtctcctatcgtatgtctgaccattttgtaggagcggagttcagggacctttgtcaaggcaggcggccggatttcttgtttccggtgctgcaatatgctcaggcgcgttccttttttcttttttttttggagaacttagccactaggtaaaggttgtaaaatgccgtagcatctgttctctgtaaatacgactgggtgaatacagtgaattggtatgtttcactttcgtcgatttgttggtttgaaccgtgtctgaagttcacaaatctgtacactatcatgctgcatcagtcgaatctctgggaaacggaatggtcatcagacgtcttttgagaatttgagatctccgagcactatgtataagatgtattagaacgtgtctttttttctgaacacgtacttgaattccaatcactatactttgtcatttcacaaacaaatatactagattgaaattgacgagaaacgcatccccagtttccctacggagaagtgccatgcaaacaaccatgcgtatcgaggtctgaatatgcaaaac

SEQ ID NO: 13936 - DNA, 1007 bp, Oryza sativa
tctcgccaaggtgtttattctgatataatttggcgcctgctcctgtcgcatgtagctactactggagttttaagctaacattttgtcttgttacaggtcatcaatgacagatttggcatcgttgagggtttgatgaccactgtccatgccatcactggtaggcatcactttgcttaatattaatattggactgagtaaaacgtttggtaccatctatctgatctgatttcaattcaagtgattaacatttgaattcctacagctacccagaagactgttgatgggccctcgatgaaggactggagaggtggaagggctgctagcttcaacatcattcctagcagcactggagctgccaaggtataaacttgtatttctgtatgtattacattgttgataatgtttcgttatcagacatttgcacctaatattgatatgtttcaaggatctcgtggtatcgttttgtatttactttataatgcaagtataacattaaaaaattgactttccactccttgctagtttgccccccttttcctttgcaaaattaaggtttgtttcgttgcctgccaaataacagtagcggtgtttaatcagatggaatgatggatctcacaaaatgtggcaaccaccttatttttgttgtgttttgttaaaactacactgaaccttctgtatcgggcaccattaaacctgtttatcgtgtactcaattagttttactcaatttctcataggctgtcggcaaggtgcttcctgccctcaatggaaagctgactggaatggctttccgtgttcccacagtcgatgtttccgttgttgatctgactgttaggcttgagaagcccgccagctatgaccagatcaaggctgcaatcaagtgagtaattcttaacaactatgggctctgtaaatctttatgaacttttgatttttggaccgagaagaatctgcttgtgttttcagaaaagaaaattatttgctgccttgaatgtttcactaattttg

SEQ ID NO: 13937 - DNA, 588 bp, Oryza sativa
gcctgcctccgtcgccgccgactggtgtccccgcctatacggtcggttggtcacaccaccgttcatgggcgtccacgacttcaccgccggcctgcctccgtcgccgcagactggtgcctccgcctacacggctggcctattatgccgccgctgttgggcgtctacgacttcaccgccggcctgcctccgtcgccgccgactggtgtcctcgcctatacggttggttggtcacaccaccgttcatgggcgtctacgacttcaccgccggctcgcctccgttgccgccgagtggtgcctccgcctacacggctggtctattatgccgccgctgttgggcgtccacgacttcaccgccggcctgcctccgttgccgccgagtggtgcctccgcctacacggctggcctattatgccgccgctgttgggcgtctacgacttcaccgccggcctgcctccgtcgccgccgactggtgtcctggcctatacggttggttggcacaccaccgttcatgggcgtctacgacttcaccgccggctcgcctccgttgccgccgagtggtgcctccgcctacacggctggtctattatg

SEQ ID NO: 13938 - DNA, 1024 bp, Oryza sativa
atgccgccgttgttgggcgtctacgtcttcaccgaccggcttgcattcgccgccgccgactggtgtttccgcttgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctgccctttatgtcgccgttgttgggcgtctacgtcttcaccgaccggccgcctcgtccgccgccgactggtgtttccgcctgcacggctggcctagtatgctgccgttgttgggcgtctacgtcttcaccgaccggccgcctcgtccgccgccgactggtacttccgcctgcacggctggcctattatgctgccgttgttgggcgtctacgtcttcaccgaccggccgccgcatccgccgctgactggtgtcatcgcttgcacggctggcctgttataacgccaactgatgctatcttcttcacggctggctacatcgctgtcactacttataggcatcagtatcttcaacacaagctgcctacgtttgccatggctgccgactggtttcttcacttccatggctgcatgattctgccagtgttgattggccttaccatcttcatcgcctttcgtctcgtctgctgctgactagtgccctcgcctctacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgact

SEQ ID NO: 13939 - DNA, 1743 bp, Oryza sativa
cctagcgcccgatgatctatggatcgatctgcctcttgcggctcgtgcacgcaccccggattctccgcatcgccgtcgtagtcgtctcgctcgtcaggctactgctacgcccgcgcaatcacatgccccgctagcgccgtgccgccacaatcgctcgcacttacgcaaaggcaactagccagtcattctccagcactccgcagcctaattaggctacatggccagaccaaagtactatcgttctctgccattttattctgaacaatttaatctgaagatggcaaaggtacatgcagcaatagattagtacataatcagcgcatgcttaagcatggactagtcgtcacttgtcacacagcttgatgacacaagccagtgccagtacatgaccatcaggtagagatcaaacattaacactttaacactgacaaagctaactatctactgtactatgtagtatttgataccgccacacgcgcctagtctctcgtgaacacagtagcaagatgcaagggacgcggtagcagctgaagtgctgaacgggaatcgccgttgcgcgcctattctctgtcgaatcacgctggcgccgttgccatggaatcgcgcaggcgcacgtatgagaaccaacagcgcaggcgaacgagtactaattaataggattggattaactctgaaccataaaattactaaaaaatacttcctaattttttgccaaattcctaacatgctcttacaaatactgctagtatatactgacagtataatgtaccgtaaaaagttctccgtcgttttcgtcttgccacagtcctcgtgtgtcatcagcgatccactccgacgacgacgattgatgttgatgtggtgtagatgctgaacctgtgacagagctgcatcgtgtatgtgtagctcaggttgactgttaaatatgtgatcttaatttaggtctacaacatattcggattaattttctagtaaaacatgtgttttcctactaggtgtttttcttttatatatatatatatatatatacacacacacattagcaaaagtgcccgagcattgcaccgggtgattacggagtgtatatattaaccaaaagtgttgtttggtttagcaaaagtgcccgtgcgttgcaacggaaagaaaaaatgagaaaattaaattaaaacatattaaattctaatttaatgaaaaataaattttctacaatattaattacacactttgaaattttagcaaaagtgcctgtgcgttgcaacagaaaggaaaaaaacaacagttaaattaaaacatattaaattctaattaaatgaaatacacattttctggaatattagggtatttttatgttggtaggtatataattaaattaattttcaagtaaattaagtgtgagaaataaaatatgatggttggatttaatttttgttaaattttctatattaattacactctttgaaattttcttggaatttacatagcttaattggtaattttgataatacaaatatcatttcagcatttatttaaataaaaatcatttttctctatgggcctttttcaacccattttcttctttagcccgcaagcgtaaaagtctacttaataccccatactcctcatctcacttgctggaccaccggcccgcgtgcggcccaaaccctcgatcgatttgagccgttcgttttgatggacggctcagatcagttagaaattgatgaaaaccataaccctaaccctccttct

SEQ ID NO: 13940 - DNA, 4105 bp, Oryza sativa
ctccccctccccctctccccaccggcgccgcttcttctcccctcccctccggcggcgccgctccctctccccatctcccgcctcttcccctctcccatgccggccgcctcccccgccaccggcaccatctctctctggcacggcgcagcgacgacggggtgcgccggagacagcggcgacggttgtccctcccactccccctctccctctccccgtcggcctcgacggcgatggcgccctctcaacggcggcgtcgatagcgacgacggcgtcggcttcgtccgcgggtgaatccgtcagcggtggcggatcctgcagcggtggctccctccgccgcctctcttctccctccagcggcagtggtggcgttggcggccaccgtttttttttttttgcaattttttccatggctattgctaactgagacggattgcgtacgaacaggacgaaaattagatgtgacgaaaggaaaaatacgaatatttatattagttatatagatatggtttagttaacatgaaattagatgtgacgaaaggaaaaatacgaatatttatattagttatatagatatggtttagttaagatgaaattcatcgttttaatttcgcttggatatatattttgttagaaaatcatgagctgcaatcgcaattaggagttcgatcgtctcaaattaacatgcaactttttaaaaatgatttcttataggattccttatatatttttaaaagcgaacaaacttaaaaactgactcaaatacggatctgtatttctaaaagcgaacaaatttaaaaaccgacctatacatgaatgacgtatcaaagtaccggcaaaaacatcttcaatttttatattatatatttttaaaaagtaaagtagtataagtggaagagaagattacggacgataatttttttttggtagtcgtagcttttctcaaggagtcgacgttttttttcttttttttcacggtagaagttttttctcttttttttttctccacaggggagtcggacgtccatttttttttctcttcgttttttgttttttctctccttttttttctaacagaggtgtcggactttttttttttgccgattgatgtttctttcctcttttttgtttttctcgctttttttttcccaaacggacgatggaaatttcttttattttttattttttataagtagtagtagatatatatatatatatatatatatatatatatatatatatatatatatatatatatatatatatatatatacacacacacacacatacactcttgttgtaagctgtaaaaaagggtgacgttactattgttattcctctacatttgtaatcaactcatcaatactgataattgccggtttgatgctcgtggttttttaccacaatggttttccacgtaaaattcgtctccgttgtgcatctattttcgtaataataatccgcacgcctcctttttgggttcacaccccccccccaataaccgctttctttttactcttttcgttgtaacctcctagccttcatggctattgtacagcgtttccctctactttaatataaatatatcccgtggggtttaaacaaaagtgtcggcggcaacggaggaggacgtctcggcatagacggagtaaattcttttacaacttgcccaaacctgcacctttttacattttagtcttttttaaaaaaatatttttggacccttcaaaaagtcttattccaagaacggacatttttctggtgctagtgacccagacgtcaaggccgaccacaccctcgcctcctacggaagcgaagctaagtcactgcggtcgtcaccaatggcattcaaccgatttttcttgcaaaaaggtatttggtgttaattcattgatattgaggatctatttataaaaaatcatttatatttcaatttttctgaatttttttacaaatagatcctcggcacaatgttattggcatcgacccctcacattagtgacttagcttcccaagggataagaggtaagagtgttggcaccaatgtcattagcgtcaagacatttgtcagcgccaatgaccctaacgctgagaaaagggtgtatttctaaaataagtttttccatatacctatttataaataagttttttttaaaagaactaaaataaaaaaaaatccagttctgcaaactccactgtacggctagccaccggcatcgttcaaaacagccgttcaaaacaccacaacgatgcagcttgtccgccctcttatcatgtgctgggcaactgcccatggtggttgggcattggctttgccactgatcatcgcactgtaagaataacgataagccatgtagccttgtattgctaagtcaacccaagccatctttgaaaaatatataggaacaagccattaatttttgttaatggcatacatagaatatcttgctcgttacatcgatagaacttaaagatcaaactgaagaagaaacaaactaaagaagatacggtccaactttttttttaattaaatatagagttttaatttatagctgcagactaacgttgatgtcggcgaaaatacttaataaattaagagccaacagacaccgcagaaatacaccaaaaagccctcagtttttggaaggggaaaaacgacatgtctatgaaaactctgatttgcactagaatggagagtagccattgtactaaaataaaattttgcccattccatagttcaatcttttcataactatcacgcaggagaatgatatagcacataccctaggagctctttttcatacccgtgcttttgcaacggggttaggagaactatgggtgaatggttttattggtttcagttttatctctcagtttctaaaaaaaaaaaaatctctccgttttattaatttttgattattttttcgtggaaacattgttttcttatgtggtggctaatatggttggagaagagaatgacgactctactctttacagcagtagagaaaagtataacttttgtctagtaaactaactagagaacagagatacacataaagccctattttgtgggtgttaagatttaaggtagaatcatgaactcgcaactccaccttcttcccacgctctattgggtttaaaacgtttttttaggtaaagttacttaaagcactttttctccgtcttaattgtgatcttgtattattgttagtttggcgccctttgccaggtccaaattaagaattacccccctgttgcctaacccaaaacacccgacaagccagcaaattaaatagttaaattttgagcataaacctattcttttagacaattaacatacctattcctttcacagagtttaaattttcgccaagcttgtacctttacgcggcatttgatatatagcgggttaattacttagtcgatcgagagctgaaattccgtggaggagaaaacgtacgaaaacgctttaaatcgggcgtccgatgccagcactctcccctatcttctctccccacccactttccccctttctctgtcttcttctctccaccattccccttttctctctcacctagcaacgagaggaagcgagtgtatgcagagcgacgaggcggcgacggtgccggagcggaggagggcgacgttgcggcggccgggggaggcggcggcggcagcggcagtgctggagcggaggagggcggcgttgcggcggtcggggaggaggtggcggcggcggcggcggagcatgtcgttggagctgaagttgcaggacttcgggttcaccttctccgaggacgacgtggacgccgagctcgtctccatcgtgagtgggcttcggcggcagcgctcggatgaggacgacgccagaaaggccccggccttcgcggtggcttccgccgaggaggaagcagccggtcgccggatcggctttgctccgaccggcgcctcctcgtcctcctcaacgctgaggaggccgcacctgtcggaggtgtgggacgaggaggaggaagaggtgaggaggatgctgcgcatgattgttgcacacacgttttttttttttttttttgcacatagtgtattcgtgatgttgcaatttgtcttttta

SEQ ID NO: 13941 - DNA, 3206 bp, Oryza sativa
aaagatgaaacatccagaacaatttatgttgaaatattttttttcgagtaatgaaacattgtaacattttttaacgtatagtgcaacatcgtccggacgtccgacccatagtcctctccttaaacgtacggtacctcaccgcgcggcttacgtacgatatagaatgatcgtgcgtatatcgaggaaacgatcgatcaatcgatagccaataacgcgcgattggtatgcgcgcgcgcccggccggcgtggcgccagcgctcgcgaccggccatgtcgtcacggcggcgggagcgggacgagcagcgagaggcagccgacgagccaggccacgagcgccgcgaacagccgtggcagcggcgtcacgggcgccccgacgcccgcggcgccaacgatcacggtcgccccgaacagcatgaggtacagcgcggagaggcgcatcggcggttcagcacgccgccgtccgcgggcaacggcgagctgctgcggcggcggcggcgcatggtcgtcgttgctgctgctgccattgccgctgccgctgccagtgatgttatcctcggcagccatcgcgcggtggatcagaacgcaccggccacggcggctgtggttgtctagctacttaattaattttgtggttaattaatttttggaagcgagcgcgaggcaagctagctagctagcggagccgtatagaatttataccaccctgatcggcggttgctatcgatcgatcgaccgggatgatgatcgataattcgatattactgaccaggtgcggatgaatccgggacatcaagatggaagggaagaagcttcatcggaatttcgatcgatcgaggcgtatgtgggtcatggccgggtgaggtggccagggacgaattttctttgttttggtttacttatatctatcttctatctattatatatatatactaaataaaagtccattaaacttcctataaacgctctcaagccgccacgtggcactcctacaaacgctcctagaccgccacgtggcaatgtctaattacatcgtcgattttcacttaatcggtggacccaataatttagaccattagattagattagatgtattatatatttaaaaagaaagaaataccttactgttcaccagaaaaaagaaaacaaagcacatgtactccatatatccatatataggtacgtacgtagtatgtaaagactaaaaaacaatcaataatcttacctactgttcatcgtaaggaaaaaaaatacacacacacttactataaaaaaaacaataaagccaaaaaaaaactacgtacgtactaccattaaaaatctattatttttaagatagatttttttctactatttaaagataaaacctattactctataaatttaagcaaatataactgtcgattttaacttaaatgggtgaatctaatattttaaccattagattagatgtatattattttaaaaactaataccttattactatgtctacgtaaacgggagaaatatataactgttaggctagaaaaagaaagaaatcacataatcttatcgtcgtttttcacttaaataagtggacccaataatttggaccattcggttagattagatgtattttatttaaaaataaactaataccttactgttcaccagaaaaagaaaacaaaaacaaaagtatatactccatataggtacgtacatacataagactaaaaaacaatcaatcttacctactgtttataaaaaaaaaactatgcacagacttactatagaaaacaataaagctaaaaaaatatacatacatagtaccattgaaaaaatcaattatctttaaaaatggagtattctactatttaaatataaaagctattactctgtaaatttaagcaaatatcaccgtcgatttttaacccaatattttagaccattagattatatttattttattttgaaaacaccatattactctatgtatgtatgtatacgggaaatataagcagtcagtacgtgcaaatgacctgggaaaagaaacgaggtttacctactgtccttcggaaccaagaaaaatctactcacggtggttttctgaaatagtattttcaaaatcacttactataaaaacaataaaaaaatatgtatcattggaaaaagatcgatggtctttttgaattagtattatctactatttgaagataaatatattgctctacaaatttatgcaaatatacgtagttaaactaaatttatattataaatataaaatattccatcaatgatctttattcgttctatcttaacatacaagactaatatatataataattaatgctatgatattttttatttcatatcatattttaaggtgtcaaatatcacttgatgaatatacaacgctaatttaaatgaaaacaatttagttgtttcattttacaccattagattagatttattattgacaaataatacaactctcctatatacggatacatgaaaaatatataactgttgatcggaaaaagtactctgtacgtagttatgattgaaaaaaaacaataatgcttacatatcgtctgacggaaggaaaaaaaatacttatgataaagtaaaacaatcggaggtctttaaaaaatatttttctacaatttaaggataatacctaaaaaacaatttaaggataaaatataataatcttcaaatttacacaaatgtaaatataaaatatccaatcaatgattttaagcgttctatcttttaaattattttaaaattatatatctaatttgtgattcagttgtattcctttaaataaataaactattaatatctataaccctaaatacatcacaaatatggagccggcatgtaataattaatgttatgataataattccacatcacattttagtgtaagaaaccacttgacgaatatataacgctaatttaagtgtacatatgtattatccaaattactaaaggtgtctcatgtgattagaacaataggtgctgaaaacaaaacggacactgaactaacatgcactaccctatagatatttgtcaaagtatgataccgtactttggattatcgtgatagtatttaaaaaaaatcactttctctcagttacatataaattcttctattattttgggataaaagttaactccttcgatctatgtgacggtggtaatataagtctatgtttaattagatg

SEQ ID NO: 13942 - DNA, 413 bp, Oryza sativa
cgtttcccagagattcgactgatgcagcatgatagtgtacagatttgtgaacttcagacacggttcaaaccaacaaatcgacgaaagtgaaacataccaattcactgtattcacccagtcgtatttacagagaacagatgctacggcattttacaacctttacctagtggctaagttctccaaaaaaaaaagaaaaaaggaacgcgcctgagcatattgcagcaccggaaacaagaaatccggccgcctgccttgacaaaggtccctgaactccgctcctacaaaatggtcagacatacgataggagacgtagagaacttgttgcctctgcaactcggagtatggcccattgtcgctttgcacgaggtttgcaggggacacaaacaaagggacagttaaaacaagtaaatgca

SEQ ID NO: 13943 - DNA, 272 bp, Oryza sativa
aaccaaacccaaattccatgttcgctacgctcagcatggcaagaacagccgcgcgcgagggatcacatgaacaagtggcgcaaatgattagcgcgaggaggagaggaggcggggggggggggagcaactcaccggccggaccgacacggtacgttgggaagcgcgagtggccaccggttcgccggagaaggcggcggcgaagggcgggggggagggggactgggtggagtggcctccgcggaggagaaggccgcgccgcggagggggggggg

SEQ ID NO: 13944 - DNA, 9132 bp, Oryza sativa
tcttttcgatgaagcagttcagagtgcgtcttcacactagcttaggcagttgtttgttactgttgtgcttttttgctctgttggtgatgttcgtgctttctttgaaaaatattggttgtccatgacagatgacatacaacataggttaaaaaaggcccttgataatccacgttgtattattccgcatgaacacttgcttactctattgatacatgaacttacttataacttaccccaaccaactttctctccacaagtgccctttggtaataggcttattgaagaagaactttcagctgatgcattaatgatgtcgatgcatgcagattccttggttgcacagattaatactgatcaaaaaacaatctttgacaccattgtaggccgagttgtagcagaacagccaggctttttctttgtatgtggtcatggtggtactgggaaaacatttatgtggaatgctttgattgcgaaaataagatctagaaataaaatagttcttgctgtagcttcgtctggtgtggcttctctactgttgccaaaaggaaggactgctcattcacgcttcaaaatacctattgaaattaatgaaaccagtctttgcaatgtaaagagaggaacgatgcttgctgaactacttgaaaacactttgctcatcatctgggatgaagctccaatgacacataggcgttgctttgaagcactagatcgcacactgcgtgatatcctttctgaaacatgcccttcaaatggtgttgttccctttggcggtaaaattgttgtgctaggtggcgactttcgacaaattctaccggttgtgcctaaaggttcacggtcaacaattattgacgcatctattacaaattcaaaactatggaaacatgttgttatgcttaggttgaatgtaaacatgagattgcttaacccttcacttccaaacacacaaaaagaagagcttaagcaatttagcgaatgggttttagccgttggtgatggcactttgcctaaaaaaaaagatggtgagagctatcccacatggatcacaatacctgatgatttgctgattatgacagatggtgacagatggtgagagctatcccacatggatcacaatacctgatgatttgctgattatgacagatggtgataaaatagatgctattgttagagaagtctatcatgatttcctgtcatgttacagagaccctgagtacctagcttcccgtgcgattgtctgtcctagcaattcaattgttgatgaaattaacaactatgttgtaggtttaattccaggagatggaaaagaatacctcagttgtgatacaatctcaaagtgttctgaccaaataccagattttcacatgttatatcccactgaactcctcaactcaattgatgcgaacaattttccaacacatagacttgtacttaaagaaggtgttgcagtcatgcttctttggaatctaaaccaatcaatgggcctttgcaacggaacaaggttattggtagtcgagcttggagagtgtatcttgagatgtatcatactaactggttctaacattggtgaaaccgtgtttatccctaaaatttcactaactactacgaaaatgaaatggccatttacattgcagagaagacaatttcctattcgaatttgctattccatgactatcaacaaaagccaaggccaaacactgcagagagttggtgtctatctaaaaaaacctgtttttacccatggccagttatatgttgccttctcaaggacgacttctcgaccaggcctacgaatattaattgagaatgactatggctcatgtgggatagaaacaaaaaacgtagtttatcatgagattcttgttgctacgttaccagcggtactgcagcctgcagctcttactgtgtacatgctactttagtgcttatgattggtctctcacaactaaacactaataaaatttcaggctgtgccgccacttccctgatacctaaataaatatgcatgcgcacgcagtgcacctttttggggtcttttttgagcattccgctggttatttggacgcagtgcaccgtgtgaagaatgcaaacaggagctacaagccagttgccaatgaactaatgatcactttcactaggtggacaactgttgaggagtgcattgaagttcctattgatttccctactgtggttttctccctgacacctttcgatgatgttgctaagtttgtggacaataatgatttttttattggtgagccatgttagtcttatatttctattggtcttatataatactttactgatcaagtgctaaaatcttcgtatttattcagatgttatgggtgtcattactgacatatctacacccacaatgcttcgtcctagatcaagggatgctgacagcttgaaaagaactattcagatacgcgatgcaaagtattctttatgcctcttattttgttccttgcttatttatttatcctgaccactaacaactaataaaactagcacaaacacagccaatagccactctaataaaatttattgatattcttaacatgtacaccacatttttcctgtttttttacacaaatagcaattctaccttgaatgtgtctctctgggctgaacaagcatctgcgtttgaggctgacgctatacacaaggctggtaagagtgaacctcagattattctgtttgttggaactcttgcgaagaactacccaggcataggtaaccaataaaactacaacataactcatatttgtatcatgcattctaaccaatcaatttaaaattgaaggattggcactatctggaggttctgcttgcaaatgggacattaacattgatgtacctgcgatagttgaattaaaggacaagctagcatagattatattatttcaatgtataactccatatgtcttctacatgtttcctgatatcaatggaatttacaggactgggacaaacttccagccaatcaattggattgaggctccagccagagcagctgttgatgaagtcgctgagaacaagactgtgcgtgaacttctagagatcaatcctcacaagtgcaaggtaaatgctaattgcgatagatcaaaacaacatgtttgtcttatgctatttagacctgctcttactctgctaattgctccatttgttacagaaggttcgatttcaagctcatgtaaccgttcgaaggatctgcaatgataagtgttggtggtatggttcatgtcaaagatgcttcaaggttgcaaaaccttatgggtccacctataaatgcactagctgttccaacatcgcagtggcagtaccaaggtaaaaaaaactgttaccatttatcttgacattgcaagtgctttccagatcttctcatgcttttctctacgcgaacataacttgcacgtacaggatagtagtcatagctggagatgactctgatgatgctatgtttgttctctttggatgaacagcccagcgcattgtgcgaaggccagttgaagctcttattgaggaagcaccagctgacagtgattttatccctgatgaaataacggctttagttgggaagtcgtttgtgtggaatgtcagcttcacagaaaatacgcttaagtttggggatatctcattccaggtcaacagcattgtctccattgatgctcctggtgaacctcttatgttgatgtccccaggtgcttcccagagttcttcagccatgatttcacctggaccaagtggctcattgatgtcaccatcaaggggaagtgaacttggcatagcttcacccggttcaactgcagccagctctccactgccaaggcgtgttattaccacggacaaaagccaagttgtgcacacaccaaccagcaagtgctctgtcagcatagatcaggatgacatttctgctgctttttctccaccaatgtcccaggtagtgactgataagttattattttgctacttctatagtctcctacacatttatggtcttgcttattgatcatgatagcaaactaataaaattctttgcagaaagtgcaagctccagctattcctgatgatgatacactactggctcatgcatctggctcaaagagcaagtctaggaagaggtagattgttttttttttttcatttgacatgtggttcttcattttttttttaaaaaaaattgctttcctaaaacatggtctgatgttaacagaggtcctccttctcaagcaccaccagcagttaagaaactattcaaggaaggtgacagcgatgagaaagaaaccactgttaggtatattcactggtttagcttggctgctatttgtgcatacagtatataattcattcttcttgcagcctgtcagctgacgcttgatccagtatacatgcatgcccactcaagcattttggccaccaagttgtagcatcttcgtctgcctgaaccgaagcgcatggaagaatgctgtctttgccatatgtctgaaccttttgctataaactgttgatctccagctattacttcttagtgactttcgaaattattgttcccatctcttttggaaccatctttagcaatgtttgtaagcttattatggttacattagctatagtccaaccacgtgctcaaagtccattacagttgccaatatgtcagtacggcaatggactttgaacagttggcattggcttagctccatgataccttctcaggtttcgcttagtaatgttagaccaatcttaagactcatccatgtttcttgagtccatctcctcatttcttattatgtcgcatgcatggcattggcattttaatttgttgcgataactaggttgtagcccgtgcgtttcctgtcatcataacttctctgcttttttatgttgtttgcctgatggtagggcgcgcaaagcgcgccttattacctagtataaattcacggcgcggtagttgagctcgagctatacctccacatggtaatggggaatttcttttgccattttcttctttatttctgtcaagtgcaaccagggtgcggaggccatttcaagcacatggcgttgaagctggtgccggcggagctcccgtgcaagcacggcactggcgagtggctcactttgtagtggtggttcttcctgcccatgagtggagagagaaagagaggagagagggggagctatagaggtagaagaaacagtccaaactaaaacaaccagtgaagataggtagtctaaagtgaacaagtttgttcacccctagtccaaattgcaacattggtaaaaaagagtggcccaagatgtaatttactcaaaaaaataattacagaatctactaatctcaagctggccattctgccagcattctattgcttcaaatggcactgtaatttaattatacgtggagcaacgagataaaagacatgctgtgcacagcgatctgatgtactgtctcgcaactcgcaagtatatctttctggatctctcaaaaaaatgcttctaatcgcccgtccggtgggaagccaaatatcggacgcatcgctgctgctgccggggctcacacgctgcctgttgtgccgcccacgtctctctcacgcgcgcagagtcctcatgctgccacgtatccccaccacatattccgttgcaataaatcacctacatattttggaaaaccctcttttaagggaatctgtttttttttccactaaaaatgttacacctagtgtactcacaatgtttcactatgtatagatctaatgttgcaatgaattgaaacattcttttgcaacaaatcacccatatattatggaaaccctttattaagggaactcgtttcattttttgttccacaaaaaatgtttcacctagtgtattgataatatttcactatgtatggatcaaatgttatagtgaattaaaacatcctttcgctattcgctgaaacattattttcatataaggtgaaacagtgtctgatgaaatattttcgatctagttagttaaacaattccgatatacttggtgcaacagcgtgtaacatttaaaaataattcaataataagctcaatttttttcattggattatatccatgtgtggtcttgttttaaagatttaattgcaatggatttaatagtgcaatcagatcatgatttggataaataatttaagagaaaaaatagtttaaagttcgcttagatgcatacatgcaggatgacatcatgatgacatgggtgcccgatttttctaaaaaaaatgggacttccgatttgtagctctctccggatctcttgcatatgcgcacccagccgcagtgcatgcatgtgcattaataattagaatttaacattaatatcatttaaaatctaagacaagatacatctcaaaagaaaaccaattatttaaatattaaataattaaattaaatatataaaaagagtagcaagtattgaaaacaattaaaaatgaaaaaaatgtgctaatccacaaattttactttttttaaggtaagtcagttgaaaaatgttccaataaatatgataagtgacattgtttaaattcaaaataggtaacttaaccaagttgatatcccatatctttaactattataaaaattcaacatgtttttatcaacaatttcgtacgtcgcccatacgattcgcacgcgtattttcctgtgttgtccgactcttgatcaaggcgcacgaatttttgctgtgaaaatctcttttctgtttgattcccttactagataacatccgtatttttcacacgtcaggatataggcctacgtagcttccattcaggcctaggcccactaatccaatttgtttgcaccaaaaacagatacaagcatgatctactgacgagaacccctttgagcggctaaaaaacatcttcgggaaaaattaactcctattatatatatatctatatacctaatttatatctatacctaataaaaaaaatgtaataacatctcccaggccgcgccgtgcctcggcccctcctcctccttcgtcggaagccgtcgggccgccgtccatgtcgcctccccgaggagcccgctgctgccaccacttgctgccgtgcccttttggccgccgcccctcgccagcgccccatggtgaggaccccctccctctcccatcccttccgctgctccgcgcgctgccactcaccgccggtgtcgccgctggtggccgtccggctacacgccgccgccgcctagtcgagttggccggcgagccaacccgcccctctgccacgcaccactaccgtggactcggtctacagtggaccaaatcctttgacccgctgatgtgtggggcccgccctttgtggacttggtccgcgcctctctccttgttgcggcagcaaatgccttttcctttgtaaaattaattaataattacgcaataaatcaataataattctagaaattcatttaaatggctcaaaacttctaaaattcatatctaattcatacgaactccgaattgagccattcaacttgcaaaattcatctaaaattgagatatacatgtttgtttactttttatgttatttgtttttctagtccgttagtaaaccgcgagacaaatttattaagcctaattaatccgtcattagcaaatgtttactgcagcaccatattgtcaaatcatatagcaattatgcttaaaagattcatctcgcaaattagtcacaatttgtgtaattagttactttatacatgtgttcaaacgttcgatgtgaaaagatgtaaaattttggggtgggatagccttactaatactaccacatgtgtttctcactctacttttcggagttgcactgctcaaccgcgcggcggcgcgggtgttgggtggacttcgacgcgcgcacctcgcttgtcaacgtcaccatggctcccctcgagctgcccaaaccgaggacgccgctgctctccgccgccgtgaacctctcggccgtgatagaagacgaagcctacgtcggcttctcctcgtccaccggcgtcgtcgcgagccgcgcgccactacgtgcttgcctggagcttcaagatggacgggccagcaccatcgctaaacgtatcaaacctgccggcgttgcctgtcacgatcggcagggctccgtccaacgttctgaagatactattgccgatagcctcgatcggctgttctcgtcattcaccggagacgacgtaggtatgcggagcttaaagaggattgggaggttgcgtttgggccactggttctcatacaaggatatgttccgtgccaccaatggtttctcttatgagcgattgcttggctttggaggatttggaagggtgtacaaggtgagtgcttctggtatcccgagtggagattgccgtgaaggtgtcccttgaatcctctccctacacccattactgccccctcaatggtgaatccttccacctcacctgcacctgcggcatacccgctgccgacgacttcaacctctcctccttctgcatcattgacaaacccaacatcaaacccaatgacgcctgctatcagcatgccacctcctgctctcaccacaactccacccactgccccaggtctttccgggcagcaactatggtgtgtggccaaggctgactcagcagatactgcacttaagaatgcactggactaagcgtgcggcattggaggagcagattgcttagcaatacaaccatcaggcacttgttattatccaaataccttaggtgcacatgcatcctatcactaccggagaagtgatctttgcctggtggaaaaaaaccacaatagtcccagttccaaaaactatctttagccccggttaaaaatctcacaaccattatatgatctttagtcccgattggtaacaacaaccgggactaaagatggttcatcccctgtcagcctgtcagggtgctaatgatctttagtcccgattggtgcaccaaccgggactaaagatcactattttaatcccggttggtatttctaaccggcactaaagattaagatgatcattagtcccggttggtattaccaaccgggattaaaatctaatgcgtagtatataatcactctcccttattctctcaaccacacttatccttttaacccacagatccggcccct

SEQ ID NO: 13945 - DNA, 11303 bp, Oryza sativa
atatttccttggcaggcacaggaacctgtgttttggcatcgtcaatgtcgtacccatcaaggtaaaaatcatttcaactctgaaaaggaattgtgatggtagggtttttggaaggaacagtgatgattattggtgctgggtttgtagatgggactgtgattggcatcgttggattagttgcctgttcatcgtgggcagtttgtttgcctgcagttttaactaacaaatagttaattagtcattgagtgtcatcattagcaaaccaaaggcttttattatgtcctgattaagctcaggtcagccttctaaaagatgtactagtacttaatcaaagagtagtcgtttttttttaaaaaaaacaggacacaatttgtaatatccatgagtaggaaacggtcgtgattcaggcaattaaaaaggactaatgatccattaggtgggatgtgggattgaacatagataaactagttggcagcccgcgtatttgccgcgggttttatagttttatcgtcaaacaaaatcataaaaatggttaggtgtaactctatgtatatacaaaatatatgataatatggatttatatatgtcttatgttattacaatacaatttagctttattttttcaaacatcattgtgtattgttataatatatgaatattattttcatatgcaatatgggtttcgttatagttagacaatttacatttctctacttcactcaagttttttctgaaaatagattcaggtaacgatacctaataattatatgctattttgtcatgcgtaataaaaaaaacatacatattaaacaataatcacataataaacaataatttgagtagtatttggaaaacatggtgttatgcacaaaatatataacagtgctatgtgtgacagtgaggtagagcaaagggaggtgaatggataactaataaatgattgaattggatgaataagtggcttcttgatccaatggttattatctttatactaatattttatactaatatgatcaaatggcttaaaatttttgatgacgtagcttcttacatgtcttactttataggaataaatgcccctagtgtgtaccaactatatagaaagataggattagatttcctttccatgctcttgtaatattctactagtagtaagaaaagagacgaaatagcgttatgtcgtggttcccccattccattggatggtgtattatcaaatttctcggtccaaagaacaagaccaaattgttaatttggtcaagtccaatccctcgtcacgctaagctcttgcaaccaaacaggaatgtacaagtcgaaatacctctaaaactggtgtaggattaaaggaatgatgaaaaaccgtagtcatatgctagccaaatggaggagcaaacgcggtgcattagggagctagagggaaggaaaagggaaaaacatgggaacagaaaggaagatctggccttgtggacgccagcagcaactatacaacactttgatagttcatacacagtgaactgaactgaaggtgcagatggaagcagaggaataagcacacagacctgagcagcagggaagcgcgcgggagaggatgcaggagcaggagaggaggaggaggaagaggaagaggaagaggaagaagaagatatcctatctcctggccatagttgtgctgtgttgctgggaagctcaagaaatgcgatttgggagtggagaaagggacataggggagtggggaactggcgatatgactagagagataatgcgtgcttgctaccgttgcttgcccttttggctagggaaagtgcaaatggttggtctgaatttaactatttaccacttttagattggacaattattcaaatatccattttaggtttgcacatattctttttgctctcttaagagatgtcttcttaacaatttgccacttttacccacatggcatgccaacatggcaagggagggtagaaactggtgtgggacctactagttagcctctcctctctccttcttctctccctccggcccgatgtggcgctgccatgatggtgtagcggcgacatatgaggaggagcagcggcggacagagctccttgcggtggtggaggacgcagagcggcggtgccggcagagaggaggcgtagcggcggcggacaggcttcttgcggaggcggtgaggcggagcggcggctatcggcggaggaggaggtgtagcaacggcactggcggaggaggcatagcagcggcggcactggtggaggaggcatagcggtggcggacgaacgccagtgaaggaggcgtagtggcggcgaacagcctcctcacggcggcagcgccggcgaaggaggcgtagcggcggtggtgggcgtggtggggctaacggagactgaggtggcgacgccacgccggagtccggaccggagggagagaaggagagaggagaggctgactagtgggccccacatcgggttttactctccgttgccatgttggcatgtgttgatgcaaaaaatacacactggcctgagagatctgcttagctctagtgcaggtccaaagaaattgctttcgggttctgagcgtgccaattggtttgatcctgcaactaacaagaaacaaagaaaagcaaagttaaatctatcaacgatagctgatcggctggattgccgatgacgtatcgttcagtattaagccgatataacatgtatcagatcagcaataaggaatataacaaagaaagagttagatctacttgatcggctgtagatatctatcacgaccggaaataacccaacgggcgttccttacgtgcgtgtattattccttgtcccaggaggcaaggtacaccgaaagttgatacatttcagagtttatcaagcggaagcataaatagttactttattacatgggcggcgaaggcccagcacacaagaagacaaacgggaaacagcagaagactagggcgacgaccacaggcgcttgacggcaggcacgagctaaacaccaaagacttcatcatccaggggctcctcttctgggtttgggaaaaattgagcaagactgagtacaaccaccgtactcaacaagacacacccataagtgcagaataaatgcaagggagtacaagggggttataatataaagggttagggtttgcaataaacagcattaaaagacacttagttgctcaaagctattttgtaaatacgatcctagagttatacaagattattaatcaaggccgtgaacccacacgaacctgccttaacccaaggcctacgatgattcagaccgaactggcaacctgaccctgggtcccagctcgtcccaagccaacccaggccaaccattccacattttagtggttaagcaggttttaagaattaaaacactaacttgggtacattgctcggcttgcccataactgagggcgcggctattcgaataggttatactctgatcagaggtgtacatctttacccacaagacacatcttcgtcacgtgtaaccacgtgccacataccaccaccgtatacggacggaagacgtgacatagtttccaacccattctagccatagacaagagtaccgacccaaccccacctacggccggaacctccgggacaggtaggcaggactgagcccctagcagcaggacaccggccctgtgccatgacatctcgactactgggccgtagctcgtgtagccttcatttgccctagagatgtccatcgacccccgacttcgtccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcctagcctaaaaccattttgaggattttgaatagagggggaggtgtgaatccaattccacaataatccaaccattccatagtgttcaggtgatatgaatattcccaaagtctagagttgtaaaaccacctaatgttacctaattaagcagcgaagcatctacctaaattcatactagtggtaccatgagtagagtgtccactagttggggttttgtttattctagggtgaacaaggtaataataataataacaataataataaggtcataacaaaggtaaataggcatggctaaataaaacagtgataacgcgggaatttaaataaagcgataatgtaataatttaaatcaaaataattttataaactgggattcaatatgttcaaggatgatgtgacttgccttgctcactttcccaaacgtcggcttcaacctccacgaagagcggatcttccgaagctgcacgaccaacggaaaagaaaagggcttttactctaataaactccacataaccagcaagaacaaagcacaaaaatgggttcttgacttcttaaggaaaaattagagacttgaacggtccaattccgagttcaaatggccaagttatggccatttgaagtttatattctctttaaatgaatatttgcgaatttattcatttaaattttaatttaaaaaggggtttattgcgtcagccgaggggaaggggcgcgcggaccgggtccacgggagtggggcccacgcggcagcctcacggtccacggtggaccgggtgcacccgggctcacaccggccggcgccgtgggttccacgcgtcagccgcacccgagggcgcgggcggctgacgaccgggccccacgcggcagccactcggcgcgcccgaaggcggccactcggtgcggctggcaggaggcggcgcccgcgcccctatggtcgccggtggcggccataggcacggcggagcggcggccgagagaggggaagggaagggggaaaagaggcggcagtccacggctcaccctaggtcaacggcgacgatgaaaaaggcggccggagcggaggaaggtggcggcgcggctcgggtcgacggggtcgacggcgttccggcggtcggcgaactcggcgagggggtggacggggtcgacggtggtgcggcgaagccggggcgggagacggtcccggcgagcggagaaggccggccggaggtcgtcggcgacggaggagagagagagagagcgacgacgcgagctcgattccggcaaggaggaagggcggcgagaggcggaaacggacggaggaggtgcggggagggtttaaatagggttggaagggggagagggcggccggaggggaaggaaaccagcgcggcgttctcgggctccatcaatggcgccggcgggattaagggagggtttccaaacgaatccaagggagagagggaaggaaaattggggggaaagggagagggaatcacggggaataattcccccctattgattgcacgcggggacgacgggatgcgacggattcggcgacggcggcggcgcttggcgcgggtggagcggcgggaggtcagggatgacgggtgggccccacccgttagtgagggtggcgggcgggcccgcccgtcagcggcgcgcgcgcggggaggggccgagtgggccgcggggagaggagagagagggggagggagaagggccgagccggcccaagagggggaggggggaattttaaggtttttctttttataaaatcattttaactttgtttatttcttcttaattattatttgtgctctgaaaattccactaaaatttatttacacattttaggcttttaggaaatatacaaaaatcctccaagccttatttgacttttaactttgcacattttaatttttggaggctttcacacggattttaattattctaggcataatttagaggatgtattttagagttgttttgggacgtgacaatatcaatgatatacgatctatgtttcgaaataagtttaaactaagtgattgggatagatcgaacgggatgctgagacagtataaatcacttatgtctaaaagtacttcaaaataaagattgtatatactcatagcatagccgataaagcaaacctatcatgtatcggctagtactccgataccactttatactaaaatatcaatatagacgtaatataccaaacataaatcaatctaacatcaggaaaaacctaatggatcaatagcaagcttgatatattctatctaagtgagatctcaatataaagggcagatttagcatatcaaataaacatataagaatcaagataactaaatcagataagatcggctgaaactccgatgctatctctattagcaatcatcaaacaggctagattttatagttctaaatattactcaacagatcaaacttaactgatgcagcaataagcataagaagaaacataaaatctaaacgagtctatgaaagctttttcaagatggtggatatactatataatttaattcaatatcagtatccaatcctatcggttgttttcgttgatagaagccggccgatgtggttagatagcaagatcgatctagattatatagcatatatgataactcgacgatttacataaacaagattagagtgtcatgaagatgtaatcactagtcccgagaacgcaagccaccataacaagttttaccttttcgtcggagatcgaacccgatgcagcccaactcgaaagcaagaactcgtgaaaacaatgaaagtagaaaaaggtggcgatgcaccgaaagtattattgaactatcgtcctttgtttacatggtctcgggtcatatttatacccaaaatacatgatatgtccttgccggacatgactctatctttattacaactcaaaatacgaataagtcccttaggcggactcttaccaaaaatatctctaagaaaactaccagaatatcttacaactcaaaatacgaataattcccttaggcggactcttaccgaaaatatctctaagaaaactatcagaatatcctaattaataaatagaattgccttcttaggactcaatccatgtgtggcaacacttgtgcagcacctcaatcgaccctaacaatgattctagaatcaccttgccgaaatcggctatatcgacttctcccaaacagcagccgatgcaaacagcagcagatgcaactcgtagccgatgcaaactctgtttcctagactaccaatttcctctaaatccgcttcagatttatccccaaatccaatctgtgatttaccaaatttggtcgttaaaagcatgccacgtgggcaaaagtggcaaatagttaagaagacatctcttcagattggaaaaaaaatatgtgcaaagctaaaaggggcatttggataattgtccaatctaaaagtggcaaatagtaaatttcccctgctctgcagtctccactctggactggagttgcagccttgcatgccttcaaggcaggattgtttttaaaaaatatgttattatttcaccggttttgtatgaatacacatgattgaaaagaattaggaaaggcagagcgcaccatcgctccacggggacgcgaactcgctggcctcagatttttcttttatattttagatcatttaaacaaataattttaataatagactttacaggaaattattttcaaaaatgaacattttcgccacgctagccgcgatggcgtgaccaaactgagctgccgtgccagtcgttgccgttgacaaggttaatcggggccgacgtggcagggggcggctgggcttgctatgccaagctcggtggcgaacaccgccacgccatctcgcctggcgtggtggggggggaaatataccccagtcactgccgccgcccctttcttcctccttcctcgcttcttctcctccccgttgttctctctcctagcgatgaagaaaccggcgccccctccccaaatccatccaaatccactcaaaatcctgtgtttttgctccgatttgaagctcttttgagtgggaacccatcccgtaaggtattcgttttctctcgtttttgcatctattgtaatgtttagggttgaatgtaatgtgactgaaatatgtaataatgaggttcacggggatggatcgaagtagattgaggtgtattatggagtagtactcgattctgttagggttatttacgtggaaaatatggtttttttatgatatggttaaaagtggggttagacatgggatagcacgaacatgatatttttaagtatttgtgattatgtagcatgttgtgcttatgttggtctagaaatagttgtattccgccattgtattgttccctaactagtgctaattgtgaatatttaatattcgccgtcgttaattcatcgccacagacaaacccgttgttggtatttcttacgatcacagatagaatccgcaagtgcacagatataccgatgtagcacttcccctacggagtattccaagggtatcgaatccaaggaaacgtgtgtgattatctctttctctagttcatccaaggacacaagataaatataggtaaagggaaaagaggattttctagtgagaaacaatgtctaaggaaagcttaagtttaatcctaacgcgatacttcaggcattggcaacccgctcttcccagatgtcgctctactacgtacccggacagggaggacttaagtactcttgagggctgtcaccacctctacacctacctctaacatactgtgggatacgcagcaaccactgaaaattaagtacccagacaccgcgtctacgcaattaataactactctagtgctagctaaacactaaagcaatcactatataatttatggactatagtaaacaatgatcccgtatgctaattaggaactaaccaagaataattctcacgaagcaaatcttaattactcagaatgatatttttattgaaccagagtaaataacaaagtacaagaataaggagaggattaccgacaactccgggattcctccaacttcttctactttactctctctctctctattctaagtatactatagaacatataaagaagctaaagtatacttagagcctcttataattcagctctacatcttggtgtgtattgtgaatgagggagagaggagtatttataggtggagagatgccttgggaatgtggagatgctaagcatctaaatggcatcttcactctcctcttgccatgtgtctagctgatgacggttattcaggtaaagtcggtagaaaccgtcataacaagtcggcaactgacggcatgtgaagtttagggccgaatggcgcagctacgggttcggccaaacccttgctggcccgttttgctccgaattttctcgtgggctttggtggagaacccctcagcccaaatgtagttgcatttggcccatttgaatgagtttcattcggtttgtgggtccaaaactccataagcttgaatatggaagtttaattcacctcctcctctatgtatcttttgtctcaactttggtggttcgtcacctgcatctaaatatacaccaacactcatggaaatggttagaaataagccttatcactatgttggatgttttatatttagggtcttatgctggtattgacggcgttaatttggtacttaacaaccgtcaacacctgtatcattcctcaatgtgacgatttagctttattttcgtatgctcctaatggtttctgctattgtatggttcacgaatcgaacattaatggatctattttatttttattaataaagttgcatccacgtcctactgcattttcttccttctacttgcgttcttattcctccatcctatcacgatattgctccaactagcattcaggtgattgctttttgtggtgccggatttagtcatttccatctttccaaattgaagcgaaaacaaggaataaggaattgacaatgcttgaaccattcatatcttcaacagataaatcaagtccatcaaaaccgcacgaagttttctaggaatacctcacaaatactacagatactttatccgatctttagtaccaattttctaaatacaaacttggcatgttcaccataaacaagcaattgtcatgatattaataaaaatattcctaacacatgaaattttcttatcataatttttttcttcagaaacataaaatagctgggctttttgcactgccacaccaacaagccgggcatggaagtagccacgtcagcgcccgattgaccttttcaacggcaacgactaccatgaggcaatttttgccacgccataaccaatggcatggctgttggtatttcttacgacattactagaaacataatttccagcaattgtgcagaaatactcttggtatattatggttacaaagttcatccacaagcgcacggatataccattgtagcatttcacccgaaagtattccaagggtatcgtatttgtttaatcctgtaggaagattatagtagagagaatctgactaataatttatatgttacttgtaataatcatagtctaagcaagggttaagataatccaagggtagagtgacacacaagcaggaagctactcattctcatactaaaatatctatgctaagtggaaagaaaagagaaagagaatctattcctataattctagtatacatagtatacatgcatcatagttatctgacatactagctaataccctctatctgatgccctcctggtacttcgagaagccacccctgactaccgagttccttacgacaacccgttatgaccatacaaccggggctaaatacggaggagtaccctccccaggaaattaacttaggactatatacacgcgcggaggaatacccgtactgagctgtcaccatcagaggcccacctctcattcgtagcacataaccccaaataatgatatctcgtaatctagacaccacacctaaactaccagatactactctaatatcatcgtcatgacatagagtaattgcataagcaaacactatacccgtaccgatgcatctcccagataagctagcagtataatcagtataacatgaacataatgtaaagttgacattcatatactcagaaagtattccaataccataaatgtatatagaagagtattctaaataaagtacagagcttacaaaagagaagagaagagctactagaggcatacccgaactcttccgaattcttccacactccgatttctactctatttctactccactagcttgagaacactaaactaaacttgagagaatatgagagagctttgcttgaggggtgtgtgtgaagtgaggatgagagcaccttttatagcttgagaatgac

SEQ ID NO: 13946 - DNA, 19069 bp, Oryza sativa
gtatatagaagagtattctaaataaagtacagagcttacaaaagagaagagaagagctactagaggcatacccgaactcttccgaattcttccacactccgatttctactctatttctactccactagcttgagaacactaaactaaacttgagagaatatgagagagctttgcttgaggggtgtgtgtgaagtgaggatgagagcaccttttatagcttgagaatgacggttgtgacggttggaaaggtcggtaatactcaccaatcgtcattggggagtcatctcagccgtccaggagaaccctggattaagtggcgctgcgagggggggagggggttcggccgaaccaagggctgggccgacctggcccaaaatcggcaggtggcctcctcctttgctctcatatgtagacttgtgaattttggcccagttcatcgtgtcaattctgagttattggcccattcatacataagtttgattctcgacatcatccgattgatttattatctggtttgatgtcgattttcatccactttatagttattctctgcaaaaggttagtaaccaaatgctagtggaatattatgattctaacatgaatatgcattgcaagcataactagttctcctctattttggtaatattgacggtcaaaactaatcgctaacgacttgtcacaagtggcgaaaaggttcatttttaaaaataagttcctaggaggtctattattaaatttatttattttaaaggtctaaaacataaaaaaaaatctggccccgcgtgagtttgcttggctgaacagcgaaatgcctactaaattgttgacgatgaattagcggttaattaaatgctaataacaatagaaataaccaccaattaattaatttctagtgatgctaattaattatttaatcatgcgatctgcagtgccgtgagttcgcatccacccatttttctccatgcgaagtcgcgccctagtcgcacgaactcgtgatgatatcatgaacacattatgagttcacgcactcaccgtacaaactcgctgcgtgtaacatcctggcctaattaggatttggcatgtgtggcgcatgagagttgggtgctcatgtttagtaccaccttgtttagcaatgttggaaccaatttataaggtcttttctctccaactatattactctcaggttaactattttacatgaagcgaggatgaaagtgtatataagtgggtggtatatgtaagtgggtccacctgtcggatgggctagctacgtggttatagagggaggggctgagattcacacccctctgcgacaatggtatacacttttttaactttgttcttcaaggcagcaggtgtctgcctaaaagcatagagtagagcagtagtttttaataatcacttcagcggacggccactcatttatcatatatcaactaataatgtagggtttagggtttataaaaaaatcaaaaaaatgatacggtagactaatatgtaatatattgctcaacaaacaagtacaaattgtaataaaaataataattttgactgcgaatatgcatataccaattaaagtttattttgttatttttgttgtaacatgtagaaatcgaatttgactttaaatgtttatggactgatataaaaaaattttcataactatttagttgacatgcgataaaagagtggacgtccacccaaatgattagaatccctctccgctctcagggtccatgtttcgaaggggaaaagtaaaaaccggtaaaattttgagatttcaagacgggacataatcatgtttcgaagcaaattttaaatatattttgagaaattaaaatttaaaatagtaaattttaacaaaattccattggaatttgttaaaaattgatggaaattgatgtaccaccagggtcagtatccggccatccatgggaaaggtaaactctcatactgctagagaatgctaggggtagagatacgatgctgcggttttggtcatttttgtttattcacttttactatgctaatattatatggacttagaaattttatgggtgtgttttgaaacattagaaaatttatggacttttatagcaattggtttaatttttatagaattagaagaattcccatgatccaatgagcccttaatactttacgattttcatgacaccccacttgtccacaatattttgcctttgctttactagtatgagatattacggcatatcaatcctacttttaatcgtacacacttcttaatacgagtacactagtccaaaagttcaagtaaatacacatggaaaaagatacttcctccgtttcacaatgtaagtcaattctagcacttcccacattcatattgatactaatgaatatagatagatatatatgtctgtctagattcattagcatcaatataaatttgggaaatgctagaatgacttacattgtgaaacagagggagtatgtatctattacatgtcgtccatgcaaatgtgtgatagttaaaaaagaaaaaaaaataagggaaagctctatatctatctcttaattagagtaaaaaaaatatctttacaacatgaaaaatgggtgttttgtaaaattttaggaatttaacatgtttgagtatagaattatgattatcccttggatttcttggtacacctttttctcaacccttcctaactttctaaactagtaaattttagaaaaccctatattttattgtcagtgttgtagaaaaccactggtatggtcacttgtcgcatataaccacaggttttatggtctaaattttgtaaaaccccatctttatttaaatcttgattaatttaaccatatctgaaacgatatctttcaaagtagcaaacagttaaactatcaaccttagtcaagaactcaataattaaaaacaattcaaatacactatgttttaaagtgcatagagtaaggtttgtgaaactttacaaccataatacctagggttatgtgccactggtcataatatctagggttttatgcaactttgaaataaaacatggggtttgctaagttttactccttttaaatttatctgtttctttttctcatcaaatgattggaccaaaggttcatgaacaactttctaaatactagctaatgcccgtgctttgctacggataaaatgaaaaatatcacaatattttctaaaataaataaatcatatttttcatgaaatgtgttacccacatttttcctataggaaatagggctatccatttagatttagttgttatgtaatattaagaactaggagaggtggtaggttcaatgccacaccattggagtgagtatagaatcttggtgtgcccaattgtatatttatgtatatgtgccaaaggaatgaagcatgtcatatgccacttgtatgctatttatcgcctttggaagttgagcttggagatgctgagaccaaaaaggatggcaaacaggatgggaaacatggccaaaattatggctgctagtggcagtaggtcatggcggaaaccgaagtaatccttaatgaaggcggccacagatttagtctctccaaatacagaaatctccttctgatgctcatccccaaattgtgtggtaaagaaaacgttgagtgtccacgacaatggggaagtgtagtacaaccatatccaccatcttggaatttgctgccatatcagtaaaccatatatttatgcattttgtaatgctatgtatacatacttacattattaagcaataattattcaggtgagatgatggttttgcttactggtgcaggcacgatgaagccagacatgaggttctgcagggtgtagaacatggatgccaatatagatgccacttggatatttggggtgagtgacactatcatcattccaaagtagaggaagtacagcagcgtgcacgctatggtgtacatgaaccaaaagaacttagctgcagtccatgcataccctatcatgggataagctatgaacatgatcaacaatatttgcaccaacacataagggatctccattgcaacctactccagccagccccaagatgcaaaatgaataacaaatagaaagtcatattaagcccaagcataatacaactaagtcttttacatataaggttaaggtcttgaggacataagatacctgtgccaaggagtaggcccaaggagagtacattcctgcaaacctctccctataaacgacagagcgctcaatggatatgaacggtatcaccgattggcagttattgatgccagtaaaaagagtggtgccgtacatgcaccctagtatggtgaataggccttgttggtcatttctacccaccaaggaaacaaaaaaagaaatgaaaaaaggatcaatgcaaatcatatcaatcatatgcatatgaacatgcttcctctatatctatttacaaggatggacatagtgatggttcacaatacatacatgtggttgatgtcaccttgctgccagaacaatacaccgaagacaatgcaggagattgttatgaataaaattcgcactaggttgtaggaaggacttctccaatatgacaaacactgcttccagatgcaagcctttagttgctccctaaacttctgtggaaaccgtgttgggaaatggagatcactcgtgcctagagctggtttgctcaaactcttcactagagcatccttgtcccttcaataaccaattacttaccatcataccaagtttgtttttcccacaggtaagagtattgttaattacaagtggcgtgatgacacacgtaagtatcatttggtcaattattttatcaagaccactcttggcacccaagccccattgcattttatgtgtaacttgttttggatatataaatggcactagatccaaatgtgatgggtttttaaaaacttacttgcacatggttgattccctgtaaatttgggcaaaatctacccccaattgagcttccatagatgcacaagtaacttcgagcatccatgttgatgggttgtaattatccttgatcttgggtaccccgggaattgtctgaaaaatcaaagagaaaaggttaggtactcctcccttttcaaaagggtggctctttgctttcatatcttatcttttggcaatgtactggggtttatcccctaaactctgttcttgcttaataatatgtttgtgtgttaaaaaaaagatatattcttattctacggttcaaaagaagtgtgtttatgattatattgcacgtcccatcatctactacagacattagaaatcatgacatccagagaataaatttttaatgacacgtaatatatatgtaatgtacaatgtacattggaaatagtgatgcttggagaagggaattgtaagaataatgtgacataaataaattaattattgaaaatacaaaaaaacatatatttatcaaggaaatcaaaatatccacattgcttgcttcatcatatgcaatgtacattggaaatgcaacatctggagaatggatttatacgaataacgcgctctacatatacaatacccaattatatatatacgtagagagagttgagggtgatgatatgttcttcacccacgcccatttaaaaacctttatggctgtaaatatgtaggaatatgtgtattgttgtaaaacttttgtaggaaagtattgcatctttgcatatgtacatacatttctggtcaacttgcctcataattatgcacacatgttaaggatttaatggaatataattttgtagtttagacttaatatatattagtttggatccgttaattatagcacatgcacatgatgctagatagaaaataatggactggaaatgcagacaaaaatcataactagtgattagtttgtaacttcttaaaaacatataggtcatgaaaataatgaaatcagatgtagctagctaggtcaactttaattggttttcatcacataatatgaatggtgatacgaaacaaattttatttatagctagatacttttgtacaagcaatatacaatgaacaagttcaagttattaattgatacctcgaaatagtggatgacgttacatgaatggagtccaagaggcccagcatatatcaactctccaccccttttcattagcataagctaaatacatatttaagataattagttataaggtacttcacttttattttactcatgcaaactaaagaattttaatatcactaatgcacattaaatatacacaaaatatctcccgttattattgaaaaaaatatggaaatttcatgcttaacttctccaacaccatgaatgcttaaaaaggttacagttgtatgctcttagcccagtaaattaagccgtaaagatctatgtactatagcaaattaagaaacttttggtaatgaagacatgtagagttatcaacatgatgtttttgtctagaaaagtaaatgaatactccatagaagttgtaacttgaaatacccctatattgtaatcatgttacatgtattgttgacgtagtaagtttacgtacaaatatgtatcattatttttttcttcatatctaatatagtaatagagggtgtgtgtagttgaacaagtctgctaaaattcctatgaataattaatgtaatgtatgaccactttaaagcgtattttttattccatgagagctatcctttacacttcatagttagtcctagataagactattgagctatatatgtaacacaataacttgaaagtacctcatcaaaggcctcaaatatttcaatacttggttggtgaatggtgcacacaactgttcgacctgtgtctgcgacattcttcaccgcacgcatgacaatagcagctgctcgtgcatccaagcctgatgttggctcatccatgaatatgactgaaggattggacacaagctccactgcaatagtgagacgtttcctttgctctgtagatagcccacttacccctggtagtcctactaaagcatctctaatatcatccaactcaattgtttgaataacttcatcaacaaattcctatgatggcaaaaaaatatgtatgtgttaggtcatagttccatctcaattatgcaatttacactgtaataatatttttgtattgatttacacatgtatatttcatttttttataatttgtttcaacaatgaaataactcactcttcttgtttttgaatcgacttctgttggtagccgcaaccaagctgaatatgcaacagactcctccactgtgatttgtggggaatggacatcggtttgttcacagtagcctgatatccttgcaaaagtttgttgaattttaggataacctcctactcgtatatctccttcaataacaccaccagttttccttccagcaagaacatcaagtagagttgtttttcctgctccagtaactcccatgagtgctgagagaacccctggttggaaagctcctgtgatgttgtgcaatagttgtagctttcgctccttgtaaccttgctccctcatttcctaaaaattgagaatacactcaacattgatttcagcctattatacttctaaatatatgggaataaccatgaagcacatgctaatagaacaagtgaatatattgctctctttgactactgaaattcataacagtcaacaactaagcatgattttcttccactagtaattgtcttgactattaggagtttagaattaccacgggggtgtctacatagtagttcacatcttgaaatgatattgtaagtggtgagaaaggtaacaccatcgtccctgcacaagatcacattattgatgtatttaatatgagatgcatttagtcatagaatgtatatattgaactaaccagtcttgttaggtgccaaagcatttcctacttgtaacttaggcatcctattgtccatgtccttggacatgtctttgcctcttctatcaaatgtggaaaacttatcacgagatataattgctcgggaagttcctgtagctgaggtccatatggtatcagaataacgcttgagagaatggaactatttaaaaacatcaacatgaacatatgctttgataaatatggatagtgaagtgctcgggatgtattatttaatggtatttcacatatcatacttacgtttcttaatggtcaagccaatggcataacctacattaagcaacaaaataaacccaatcaatgcactggcggaaatccaataaaagtagctagagaagtctagtcctcgatccattagtaccctccttccaagtgttacaccagacgttgtggtctaataacatagaaaaaatagtcttttaatgttggaatctaagtagaaggtactcaccttatctaaaagataggctaaggatgcaacaacacgtacctttagccatcgtggtgccaaaaactcatttccagtcaaccctatctcagcatatgacaatggagagatccaaaatccccattttagccaattaggcatagatactgtaaaatatgacacacatggttttaattagcaatgattgtttaatacataaccatgtacacaagaattagtagaaattctgaacgatgtcttgttagcatagtagggcttatggaaaagagacagcggcttacgccgaggaatgataaagcccccaaatagaaggatgactagaaatgacatggtaccaccaactgaactagccaccattgtttgacagtatgaggcgacacatcgaaacaacgataatgctccagtgtggacgaggaatagaatgaggagctggcaaaaaaacctaacacagaaattgagtatgttaacacacaacatagtcattgcatcttaaagatgaggtaatacgaataaacactaaaatagagtctagatagttttatataaagaaatcctgtagtcttattttggtagccaacatcattgaaacccaaatagtaaaaataaatacacctatgcatatcttgaatagactggaaaaatgtttgccctatatatggtggccctcgtaggtatgaaaggttcacacataagaacaaccggaaagagttgataatatatacagtcaaatgcgtacttcatgtgtacaatacttttacaatagagtgtaatttaacctggatgcttctggagtatagccaatgaggtagtaagatattgatgtccaagttattgactcaactaaagaaagtggaatctttagtataaaagaaggtattgcataagcccacgccggatagaaatagtagtctctttgtttgtaaaagacgggaagtctgctaactgcaatagccaactcagggaaaccattaactaaaagaagaatgagcgcatagaagagggaacccatataatagtcagcatgggccctatcgacccccatatgtgtccgtagaaacactgtcccagtaataacagcaagtaatccaagctgaaaaaaatgtaatatgttaatttgttgagaaaatgcaaaaactaaagttttggctcatccgaattctaaacaactatattatatactactatgtcccataaaaggaccaatcctagctacgaacctagacacaaggttcatagctaggatttgatttttttatggaacggaggagggtattatgcaagatacactcttctaacaaaaacctcaattccttgaaaaaaataataatgccaaagttaatataattcatgtgtcaattgaaatataggaagcattttaaagatatcaaatttcaactggaaaccttgatatattacaacctccattgtttttggtgttgatatagtactatatgtagcctaaattgtacatagtaaacatgagaaaacttagctacgtgacaatgagtgtaacatcataaatcaggtgtcaaaaaccggatgttttgtatcatagaatgcattcatctattctcaaaactatgaacatttgaactgaaattttctccaaaagagatatttctacttccttacctgaacaacttttgttatgtagatgaaggcatttcttctcatgagaagaatttcccttgcaaaacatgccttgaggagatcccacttggttagagagtagatatttaaggacaaagcattattgtatacttctgatttatcaaagggattcgcaagctcttcaacaagattttgaccaacttgagatgctttaaatttctcacagaagtgatcaatagtaacaaagttgtatgtttcctcagtacgactccagtattgttgttggtctttcttagataaaacctatacgcaagtttagaagagaaataataataagaaagtcaaagacacatcatactaaccaatacttaactgcttaatattaaaaagttgtatcttgaacttgtaccaacattgtaagtacattatacaaaatgcagagactaagtaaaagagcatgtctctataaaacaatggctatttggaatactatagaacctaaaatgtccaatttagtttatccatattgcatcgaacgaaatccctaagtaggacaattgacatggtagattctattagaattatgaaagctcaaatatgcacttcttatcatgcctgactaatttagataaaatgcatggctcaagtgtcttgtatttctccttttctttctccaatatcttatcaaataaaccattaactcatgttgtttcaagttgggagctatacacaccaactcaaatacacacacttaaacttcaagtcattaatttccaacaagtacttgatgctgatagtgttcattttaaacaatctcacttcgctgtttagtcaagactttttgaactaataatacttttctcatgtacctcctgtagaaaatcagctgctccttttctttccgggcacttgaacccgcatgattcaaaaaaattcataatgcaactcttagacccatggtatacaatttttccttcagccatcaagataatatcatcaaaaagatcataagtctctggtgctggttgaaggagagagaccagtatggtagactctgagatatgagccacttgttggaggcaagaaacaatttggaaggtggtagagctgtccaacccagttgatatttcatccatgaatagtgctcttgaaggtccaactatcatctcccctggttccaagatgatgtttcgatataaataaaaggaaaaccaagcatcttgcattgaattaacaacttgacttgtcccaaaaaaattgagtttgtatggcataaatgaagataaccctattccttttgttttttgtttggaaaaaacttgctagcctgatacctttagttaggtggctagcatacatgtttttgtgaatagaaagtatacattacctatatttgtttttttattggaacactacctgtatttgttggttagctagagtgtagttctatagtattatgtttagcattggaatttacaagggtgtagatcctcccatacataattgcggaattttagttgttgaattgagtgttttaatttaattacaactatatttcaattgagatgatacaaacgccatcctggtattggtatatatacacggttaaatcacctgtggttagtctcttcttttcaccacctgaaatacctcttctcattatatctccgactattatgtcagcgcaaatgtcaagtcccataatctattaagcaagagatagattatacataaggttaaaaagttatgtactaagatccctgagcattgatcattggactgagcattcttcattggaccagttaccttcataatgtaatctgtctgcatgctcctttctaagccttccacagatattgcctacaaaaatacaaaaatacctaattgaattgtaatggtagagcttatgccatttagattacaaatggctaaacaccaaactattttttccaacaccaaactgaatgaggaaaatgagacaagttttcactgttgtttagatacactatccaaataccaatgtgttgcaatgaaatttaaaaagtatgttataagttttaaatttgaaatgtcttatataattcctaatcaaatatcagttcataacatattaagctacacacacaaatatgtatttgtcctcaaaaggtcccttcaactcgagaggtggtgggagtggcagagtcaccaccatcactattggcttcttttacacaactagctaggtggcccgcgcaattgcgcggctagcacccaaacaaaatcatatctttaacggtcatagtgctttcaggcgatatagcaaaacagccataaagactgttcattgtcattttatgaatgaattctaaggcttttatgtttcagttcgccaggttgtctcttgcctgctcatggattcagcaggcagttcaaaaggttgacctatttgggaatctccggatctatgcttattttcaactccccgaagcatttcgtcgcttgctacgcccttcctcgtaacccttttgcttttccagcaatatgtacatatctaagtaattgtcgttctgtcataccatcatgaaaacgaaatttccgtttttcttctagacgactgtatcagcacctagttcattactcttgatggagggggaggatctaccttcttagatttctttttctatttatttttccatctaggattagaaccgtatacttggtagattatttttccatctaggattagaaccgtatacttggtagatagtaggaacggcacattatggcaaaaaaaaaagtttgattcagagagagaggaagcggcagaaattagaacagaaatatcatttgattcgtcgatcttcaaaaaaaaagataagaagcaaagtttaccctttgagtttgagtgaaaaaacgaaaatgcggcctgactattctagaggattgtgcgatattattgcggaatactgagcagaggctggaacaacccatagaagtgtaggggctgcttttacttccgcacttagctactctaggttggggagtagggcccgggggagaagttctagatacttttccatactttgtatctggagtacttcatctaatttcctccgcagtcactaatctaaagaaaaacaaaaaaagaattccattgaattgtatttttattgatcaattagaactgccttctagaacgtataattgtctcaaaagggaaatgggaaaggaattattcctttagaaccatggaactcccgagcggttgtggttgtacctgtacttgcagaaatccgtgtcccgcccagcaagaaaacggctgcgcattattttactaacgcgcgacggagcaagaaaacgtatgcgcgtgtacggaagcgcaacggctttcgcgctcatcccttgcttcaaaactacaggttttagcccagagtttgctggtcgccaaagacgagagcttcgcctttggaagcgccagtagcgtgcttgataaaaaggatctagtgtctatgccaggttggtaaaccatatagatctttcccaaacaaggagtaggggctagcttgtaagccacgacttagtactacaaggattcgggcgttggagggaccgttttgtcttttgtgccgaagctatttataaatcacaggccgaaaccggtgaactttgactcgtcattcaacactgcatgtagactgaattcttcaccatatacaaatggagaagagacaatagggttacttatctcttatttatgtagatttacaccacattccgtgtagatttacctttggtatctatgtgcgtagcggcacaaaatcgacgaagattaccatattgatattcgggcgcatgataaacatcggtactccagtgcatttccccatctgattcggaataaatatgtttttgtaccttttctttaaaatgcaaagtgggcgttccagcacgaatctccgagttctctctcctccgactttcctagagcctccggtagcacagccgagacagcgacgggttctccacccatacggggatggagcgacagaagcatgcttcgtttgctttttcctctccatggactaagataagactagttgttggtcgtaaatctgggaatagtccagactgagaatatgcatcatctcgttagagaaggaaactcactctagtaagatcaggcaaggcagcatatgatccaaacattcactcgctctaagcacgggaatagaataaaggtatgggtcccccaccttaccatccgttctgtcagaccaattgctaaagagttttattcgatttgagagtttttactactcaaagaacttccctatgcaatggtgctttctagttcttatctgcacctacatttaggattaaccctattcttgataatgggaatcatgaacatttcagtatgattttacttaagatttattaaatagctatccccgtatttctaattatatagtttttaaaagtcacaccagctgctaccccttacttctgtcatatccttctttattttcttgctcggtctaccactatttctattcattctccttgaaacctttaaaatttggatcttatatagttttttgagtttattatctcgttgggtttcgtttttataatttctagaagtcccgtcaaacgaattatactcctctacggcccgtccgctgtcttttctctttattatcattgggattttataaatcgaacataattatcattccggttcattttttactttctataagtctcgccaaaccttcagcaattttgccattgtactcctttatggctcgtccgctgcctcccttctttattgtcattgagattttaaaatcgaacatgattagcattgttttttttactttttagtagttccgaatatttaaaaattggaccttgtagtttttattgggtttcattttttataatttttagaagccccgtcaaacgatgccactatacttctctacggcccatccgccgcctattatttattgtcattgggattctaaaaatcgaacataactatcattagaattcattttttattttctagaagtcccaccaaccatcggcggctctgcaactgtactcctatacacgctgcacgctacttctcctttttgctgtcattaagattttaaaaatcgaatatgattatcaatgggttttttttactttctacaagtcccggcaactgccttacccgtttgcttcacggcctgcctgtcgtcccttcttttaatcatcattaggattcaatttggtgctttactaacagtttttatatgtcgtatcaaccgccaccactctattcttttataggcctgttacttaatttatctcgtcatgtgttttagatggtcatttttttttcaatagtctttattttttatcatcaatttttgttatttataaattgtattcctaattgaaatcttttttattttttaatttcagaatttatttttttcaaattttaattaataccgtatagtgttctttttaatatttttattttttgaagtccagttgtttcaaaattgtattcctacttgaaacctcttttcatttttctaattttggatattattttattatgaattttaattaatgtcgtattggcttcttatatggactttcaatattgcttatttttaattatgaatttcagttgattttaaattgtattcctacttgaactcttcttttctttttgctaatttcagattttatttttatttttattccgaatattaactaatctcgtattggattcttatatggatacttcttttaatattgcttatttttaattccgaatttcagctatttttgaattgtatttctacttggactctccttttctttttctccgattaatgtgagaatttctagcccccacagcgaacgtggtgcctcttttcaaagctgtcttaataatataattagcatggtggcccgcgaagattacgcggctagcatcgttatattttctcttatataatagcatatatgttttatcattttattattcaaatatattaaaatgacaacataattttaaattttgcaataactttacaaaactactaatgtgtaatatttatattttattttatatacgtgttagttattaattatttttaatatcaaattttagttatttgtaaattatatatattcctgtatggactctagactcgtcttttaatatttcttttctttaattccgaattttctgtaaattttatttctatatagactctatgctcttctttcaatattatttattattatttctaaattttcattatttctaattgtatttctatatggactctaaactcatatttcaatattctttaatttttaatttcgaatttcagttacttctaaattgtatttctatattgactttaaactcttcttcccatgtttttcttaatttcgaattttagttatttgtaaattatttttttatacggactctaaactctacttttaattttattatgtttattccaaattttagttagttttaaattcctatatggactctatactctacttctaatattccttatttttaattccgaatttcaattatttcctaattttatttctatatggactctatactccacttctaatatttcttattttttaattctgaattttagttatttcctaattgtatttctatatggactctagtctcctcttctaatattccttattttttaattccgaatttgaactatttctaaattgtatttctatatggactctagtctcctcttctaatattccttattttttaattccgaaattcagctatttctaaattgtatttctatatggactctgctttttctttttctccgattaatgtgagaatttctaggccatgagagcgaacgtggaggtttctttttctattcctttaataatataatagatagatagagatgacaaaagaaagcattcctataacagagacaaggggaaagaaaaaaaaaagaatacataaatgggtggttaatgtttaccttcatatatgtatctatgtcagggtcaggggtaatcccggcctccttctccctcctaatgacttccttcatgatctctagtttgcacaagaaaaataacgacacttggttaagttgagtaagtaaacaaaaatgagacagataattaaatgtgctatatatacctgctctagtgccaacgccctgaaaccttgcagagaagtcaagtgtctctctgacagtcatctcagggacatgaagatcatactgagaaatataagctgatgtcttctctggaacaaaggtattcagattggcaccattatactcaacttcaccggtcaccctgcatgcaaaatgcattatgcaatgcgatgatatgataatacagcgagtagccgattattgatgatcaaaatatgtcgctgcagctagtaggctggttacttgtgattagatacttaattggtggaaggatcacatgcaattggctgggaatgaagaagtaaataaccttgagatttttgtcgagctttcctgcaagggcgagcaagagggtggttttgccgcagccgggaggtccaaggaggagggtcagcctgcacacaacacatacatctcgatggatgatcgatcacctcgcgatgaccatgcatgagaggctaatatcaatagtacctggaaggcttgaggattccggtgacgtcgttgagaatggggatcctcgcgtgcggccggcggctcaacccccgcgcggtggcgagcacggtgttaaggagcgtgggcagcggcttgccggaaaccacctggcagtccgccttcacgcgcacgttgagccaccgcacctccaccgtcggctgccggacgcccaccctctccatcctccgccgctgcttgcggagcagcctcaggttgtcgcgctggatgtcggccaccagcctctccaccagcacccgccgttgcgccgcccccagccgccgcacgtccaccgcctccgacgacagcaccgacgtgcgcatcctgtccaaggtgggcagcctctcgatggccgcccatctcagctcagcttcctcttcgtcgtcgtccccacgatgatcccaccgcaacgacgacgacaaggacgacaggctcctgcaggttgccgcagctcgcaacgatgaaggcactactggtgcttcttcttctgcttctgcttcttctcgttgctgctgctgctgctgcttcttgtcctccatctcaaccacctctaattggctcatcttaatttctggatgctgctgccgctaaacgttgaggagaaatttcagttgtactgaattatttatactgatgattgttgttgacagccagcatcgatcgacgtcatccaaccatacataaaaaaacgagcaattctactatgtttgaggatgtaccatgagataccaaaaatttagtgtaaaaatttagtgtaaaaatttggtaccttatgataactcatactctctctgtttcaaaatgtttgacactgttgacttcttagtacgtgtttgaccattcgtcttattcaaaaaatttaagtaattatttattcttttcatatcatttgattcattgttaaatatactttcacgtacacatataattttacatatttcataattttttttaataagacgaacggtcaaacatgtgttaaaaagtcaacggtgtcaaacattttgaaacggagggagtagtacctagataccaagagataccaaattaatttacaatagaaaaagtgctatctcatgataccgcctcgaggaccgtaaaaaagctctaaaaaaaacatgtgttgcttgctccagagcaacttccattttttttccttctttgttgacaaaacgacaattaattgataacatatactatatatcattattatgggcatatacatattgcgtggacaaaatacaaacaactcgatcgatcgatttgtacatgatggggctacaggtcaaattaacaagttgtgtcgtcgtcatgacacttgcatcgatcttcatctggatgtgttgttcctggatttttctaatcgatgctattgctaag

SEQ ID NO: 13947 - DNA, 529 bp, Oryza sativa
cacaccaccacgcctggctaatttttgttgtatttttttagtagagacagggtttcaccatgctagccaggatggtcttaatctcctgacctcgtgatctgcccacctctgcatcccaaagtgctgggattacaggtgtgagccaccgcgccttgcctcctgcattccttttttaacttgttggtgttctacatttgattgcatttaaggaagggtttctgctgctcaaacattttgacagctggtggcctagatagtctctcctgctcagtgagtctgaaagctgaccacccgcagcctgcttcgccagctgagaattgggcccaagcacagccaactttgatgagtggagatagatcactcagactatgtgatcaaatcaaaaaaagaatttcgggcttaacaaaatttattgcaatttgtagaattgaaggcagcacatgaatggctaaagaaaaatggtctattccaaatccatattaactactgtgctaccaggtccatgaccggcacgggctgagggaggggg

SEQ ID NO: 13948 - DNA, 308 bp, Oryza sativa
tgggtgcttggcgttggcggcggcggcgcggagggaggcgcggcagacggggcaggtggagtgctgcctgagccaggcgtcgatgcaggcgacgtggaaggcgtggccgcaggaggggagcacgcgcaccacgtccttcgcctcgtactcctccaggcacaccgggcacctgcgcgcgcgcgccaagattacgtcagttttacccccccccccccccccccaacagcaaattaagccgacatcagaaaccgtattgtcttgctttttctataaaaaaaaggatataaattgttttagaacaatttaga

SEQ ID NO: 13949 - DNA, 12012 bp, Oryza sativa
  unsure (1)..(12012): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnacccagcttgccacctgcgagaaccatagtccatagatgcccgcctacgcccatcaccgtcgttggtttgcttggccgctggtcgcccggcacaacgacgtggggagaccggaggctggaccatgggagcggccatgtggtggtcggtgcccatggatgcgtagagtcgtggagaggagaggagaggagagcacatatgatggcggtggctgtgaggagaagtgcatggagggttggaggctatgatgatagggttgttaagatgctgagttaggttttagcttttatatcccactattactccatgttgggcttcttgggcttgcaatgagctgtattttgaggggtatataccttcttcggggcacacaggtggattttgctagacacttgagacgtgtgtggtggaaagaactagaagaacgtgcacgctcttgctgcctcgccttgcctggtcaggcagcacgcgtacgcgacacgctcatggatggtttcgccaaaatgaggagagggagctttcttttgcagatgttggttgctacgaaattcggtgtttgtttttttggaaatatagtttttcacacatattgaatattctgatgcgtggagcggcgtaaagtccgaataggttacacgcgacttatctgattcggttacgcattatggagatcatgcaggcgccctgatcactcttcttgttatctctatataaaccgagtcgtcgtctcctcacaacacacgtgaaaaactgtctagggtttgcctcctcctttgtactgtgtcgtcgctcgtagtctactctgtctcgctcaccagcgtgcactggcgatcgagagagtgggtttccgaaaccttcacctttgacgctctgcatcgggataaggtgctaataaggtttttaggaagcacttcgcgcgactgcttgctagtcttccacgatggctcgtcttcatctacacggatgttgcgtgtcgtcatcaacatcctataccacgccgttgttcatgtggtgtgtgttactccccacccttggcaaaccgatcctcttctgcagcagaactagaattgttggtatgtttcgaccatgttctatatattcgatctattcgtgtgtagatgtctcgtatacatgtctagatcacgtgattcggttatgctagtttacttgtttaatgtcatgatctatttacgaaataaattaaatatacatgtgtttatatttccaacagttccaactatgaggatgatgttgtggacggtttggaacttaaagtgacatgctagccatggtaactagggaagcacggaccaacccgcgaacccgcttgtagataaaattagtgggtaaccctactaatttgacatataaatgggtttatgggtcgactcacttgtatctctagatgcggcaagctggtccacgacgtggaacccactggttaccacttattttacatactaggtgaaaccctgcgttgctacgagagtttactatgataaaaataatgtgtaatatagcttaaacaacataagttgatgtgatttaaatttaagttgtatatagaatgatgattcaaatataaaaataaagatgatgtggctttatgagagaataaaagaaggaagataatttagaccatatatctaagggcttaaaaaattgagatgatatggcttaatgagataagaaaatgatagataatttgaaccatagattaatcatctaaagactaaaaacaattaatgcgatatgacttaatgagaaataacattaattaagtgaggatgaactatataggtatataagatattataaaaaaatgatagagagatatattgaaatattatatgaattgtgtgggatgattttacatgcttacattttaaatctctaaaatttaataaattatacaattatagataatatagcattcttgcatattgcttaactgtaatactactaattattagtggatgattatgtaacatatttgaattttaagttttaagaatcataattttaagttttaagaattacagggttataaattgggaaaaatacgaattaccccctgaactatcgcggtcgaccaaattaccccctaaatcacaaaaccggacattttacacccttaactagttttaccggacaaataaccccctaatcaatccggagtggttttacgcctacgtggcagtctaatcagcaatactttttattaaaaaaaagtcagtggggcccacctgccagattctatctcctctctatctctttcctctcccacctctctctatctctctcacgccgaaggccgacgaggaatccacgcgccgacggaggccgagaacgagcggcgcgccggcggctgcgagcctcctcgcggcagaggccgagtatgaggcgcgcgccggtggacgccggccagtcaagctcacgagctgggcctcagcgccggacttgtgcaagaagatggcgatggtcgatgagcggcagccagcgccggacttgcgcgagaaaatggcgagcgcggcggccggactcatcgtcttggaacgacacccacaagaagatggcgagtctgcatgtagttttcctatttatgttgataacaaaccagaaaagtagcagcagcagtacgcggcaccaaaatctcgtcttcctccgtgtactgatttgatccaatcttctgagtgtttgttggcagctagaagtaggttgttaggattttccgggcgtggctgacaaagtgtgagaaagcacgacagcggcagcgggctcgtcactgcctgcgcgcgagctccggctccgccgccgttgcatccgctttcgcccgagttccaccgttggccgccaggcgagcgcatgcaggagtgcttcggccgacaacgtgctgctgtgccgacaaggaggaggacgcccggccggcgagcttgacgggcttgccgccgccgcccgagctccgccgtgcgggagtacttccgctaccgcgtagcgacttgctgcgatgttatgccgacaaggaggtggaggcccggctggcgagctcgacgggctggccgccgccgcgtgcttcagcagcatcccctgagctccaccgatggccgacgggcgagcgcatgcaggagttcttcggcacagcgcggcgagatagagagaggggaaagagatagagaggagagagaatctgtcaggtgggcccccaccgacttttttaataaataattgctgtctagactgtcacgtaggcgtaaaaccactccagattgattagaggggttatttgcccggtaaaaatagttgatggtgtaaaatgtccggttttgtggttcagggggtaattcggtcgaccgcaatagttaggggataattcgtactttttccttataaatttatagtaagagataataagtaggttcgtgggtaagcccgtttgcatctctacgtgtaaccaccaataataggtatacctattgttgatggttttaactatgagctataccagaagcgtatggtatatttgaatctgtagaccttttaggtgacgtgcatatataagagaaataaattaaaataatgttgtacttctaatacgcttaaagcattatatacgggcataattaacatgcgccgattttctagtttattatgtgggccagtttcgtacttcctggttaagtaaactagccgcaatgtcgactttccaatcctcatccgttcaaattgaggtgcaccgtaatgtctactgcgcaacccgctcgatcagtaacgaactgatgagctgagcttggaaaaggaaaaaggccgaaaggagatactccgcagtactccctccgttttaacaccattgactttttaagtacatatttaaccgttcgtcttattaaaaaaatttgtgaaatatgtaaaactatatgtgtacatgaaattatatttaacaataaatcaaataatatgaaaagaataaataattacttaaaatttttgaataagacgaatgatcaaacacgtactaaaaagccaacggtgccaaacattttaaaacggagcgagtataaagcaagtcaaagcatccgccgacatgtgattaaacacttacaacgattatttgacattgagcagaggtcgcttttacatactccgcacaaagtcaaaccacatccataacaccataaccaacacgccgcttcagtttagctttatcgacgtattcttcttcttcaaacgcatccagatgacttgcgcattgtttgacaagtgttccacagcaagaaagacagagattcagcaatgcagattgcaagtggcttttcagtagtcaccatgttcataaataaatttcagaatatcgcagcagcctttgaactggtgatcggcaaaccagttgggcacttgagcgtgtctgcaaaccgaccaagcattggtcaactgaagttgaatcggcgagcgtgcagttggtagctcgcccactggggcagctacagctgctgcaaactgcatctgcaaaatactcctagaacaggtaagctgcacacaggtgagcattgcaggggggagcaggctagtctggataatgcaaatgtcaacggagactggtatgaaacaattgaattaacacaactgcatctataaaatgagatctatcttggacctaacaacagcaagatcggcagaagatctccaagctactagtagcatggactctttgcgtgtgttgataactgataaagtgtagagttccagaagttgactaacttcaaacaaatttctttcaataacatgacaaatattacttggtccatggactcgtggagagccggtgcgtggtaagcggcaatgccaacgtccaacggttgggttcttcagattagtcagacaaagtcgaggataaagtgcatgattgaagaaaaatatgaggatcagtgtgtttccttcaactgtgaactaaaatatgagctatgcagatagaacaaactgaaccgagaagattgttccaaaacagcaatgcatttatacacaaaaaataatagggctcccaaaataatattgtagtttcagtgtcactaccctaagatgataagattctacttactaccaggcaagctttctttgacttgctgaatcagcaccatggcaggcgttgaaccactttgacaaaagaggggaaaaaagcccgtgactttgcatcaattcagtgccacatgcaaaattgtaacagctcatatgcagcctgaatcgcaaacgccaaagaagaaacaataaccttgtttgttcgatctccccatcagaaggattttgttttgtattttgacatgtggaaattcgagacgatagtgcaattccgaaagaaaaaggacaacctatcaaactcaacgggccgtttccaaatttgctagtgaatgcaatatgtcgggaaacaagtcaacccaaatattgtattctgtatgtatggttggtatcaaactaaccagtatcgcatttgtctgtttgggccaacatgattacaatagcacactgctacactgaagaaatggtagattagtaggtaagacaagtacaaattgtttgttggaatatccagatgtgtgcttggaccaaaccaaaattacattttgccctacataatcaaatactaccagtgaatgcaatttcagaatgaaatttcatcccccgccagcaagcacatatttcgcccgaaattttcgggttttttttccattttttttgaaactggtcaaaaaaaaattcaaattcattcgaaattcgtcaaattttcaaaaaaaaagggggccaaaaaagtaccgaaatttcagagattttggttcttttggccacccccggcaaaaatcacaatgttgagattgctaaccctgactactacagcacccagcttgatgcatggctgaaaagccactttatcttgttattatgcaaactatgtggtttagactgtagagattgccaaaattaacaagtgaccaacaccatatcctttaacctttatcgatttgtgcagaaagagaactataattaatagtaacaaagagggaggggagggttcgcgaaccagtagaaaacggctctctttgccctgagcacgttgctcccgttcttcataaggattgggttgctctgcccggtgagtgcgcgcccctcgtgcgtgtgtagcctatctcctttcttctagtcggcgtgcacgcgatcacgccgcacttttccaactgcaactagtatagcaaatgcagtgagaattataaataaaatcgcatgcttttccaagtgcaagtaggcaaatgcagcgaggattataaaattgcatggaatggaaggtgagcgaaaggaatactgaatacataaacaagcaaaaacacgatccatcagagcgtccggcctgtgtgctcgcttctcgaccagtgctgattgaccaaccaaaacctccgatcaccttgtcccgtactgaaaatgctccgtttttgacttgtgcagagttcactatcgttgccacgaccatggtgacgatggcatcacactccgccattgcaatggacagataaatattcccccctcaagctctttgtcttctcctgctcctcccgatcccaatccgccattggtgggcgccaagctcagctcgttgctcttcttcttcttcttcttcttcttcttcttcctcactcgctgcccactcattgggaaaaatccgagctcggattgaggtttgttggtaagacggacagccatggaagcggtgaggtgttttgtggtgttgtgcgtggctgtggcggcggcgctggcttctttgggtggcggtgcggttgatgcggcggcggcggcggcggcggcgcaagagatgcggcgaggcttctcggcggcgcacgaccggtcctactcgcagttcgagcaggtgctgtccgaccccaccggcgtcttcgccctcggcttcctccgcgtcaactccaccatgctcgacctcgccgtggtccacctcccgtcctcgttcccgctctggagctccatccccgaccgccccgcgcagtggtccgcgcccgcttcgctctccttcgacggcgacctcgtactcaccgaccccgccgacaacaaggtcctctggtccgccggggccgccgccggagccggcggcgaccgcgtggtgctcctcaacaccttcaacctccaaatccagagcggcggcggcggcggcgacggcggctcgtcgcccggtatcgtgtggcagagcttcgatgccccatcggagaccatcgtgcaaggccagaacctcaccttcgcggcggcgctctacacctccgaccgccgtttctccatgcggatggggaccagctacttcgggctctacatcgagccgcccgcgtcgtcgtccggcggcggcggcgtcgcggcagcgatgtactggaagcacacggcgctgcaggccaaggccgcgatcgtggacggcggcggtccgacgtacgcgcgcgtggagcccgacggctacctcgccatgtaccagaaggaagggccacccgccgaagtcctctccttcgacaccttcaaccatggcgtgcgggcgctccgccgcatgacgctcgaggccgacggcaacctccgcgcctactactgggacagcaccggctcccggtgggtgctcgactacaccgccatcaccgatccgtgcggcctgccaagcacctgcggcgcctacgccgtctgcgtgccgcccagcggccggtgcgcgtgcctggccaacgcgacggacggctcgggatgcgccgccgcaaacgtcggcggcggcggcggcctctgcggccgcacgggcggcgaggtgggcgggctgtactgggaggtgcggaggcagcgcgtggagccggcgaacaaggaattcctgccgttcgagcactcgccgtcggcggcggactgcgaggtgcggtgcgcgcgcaactgcagctgctggggcgccgtctacagcaacggcacggggtactgctacctcatggactacccggcgcagatgatggtggccgccgacgagaggaaggtggggtacttcaaggtgaggagcctggaggaggcggcggcggcgagcgggggcgggagggcggccggtgtcaaggcggcgctgcttgccgtcggcgtgacggtgctggtcgccgcggccgcgttcggggcgtacagggtgtggaagcggaggtgccggacggccgtggacgccaggcggcaggtcgtcgccgacgacgaggggctctcgccgggcccgtacaagaacctcggatccttcagctccgtcgagctctccagctccttccggaggtagccagccagccacctgagatgtggtgtgattgattagatcgatgagatcgctgggaaacagacgccgtggacggagaaggcaaggcaaagggcggcggcggcggccgctgatcggaagaggcaggcccaaattacggtggcgatgacttgggctagtgggctacttctgtttttggagggaatgagggatgtctcttgtatgatttcggccagttttgatcttttcgttaggcccatcatattatcctcgggccattttctttcctgtacaaatttgcccctccatctaaaaaaaggaaatttcttccatgctatggtgatttgtgaacacattggtccccatcgtttggcttatttctaataagccaaaacgacttattaaaaaataaaaataaatttatagatgaaacttttataaatgtgttgtttgtgacttaaaagccaatgttataaaagaaactacgttgaaaatatcttaaaatcaatctcaaaattaagtttgaaaattcaaaatttggctttttttaggtgattaggccatccgatgggagccattataccatctcatcaagtcattattatgcaaaatttaccgtcagattatacatcatgcaaaattgtaatgtcagaatttacacggatactccctccatttcaaaatataagacacaaccacccttgacccaaagactaaaaaacaattattatcgcctctttgtttgaatcaatccaactaatacaatacatgaacccaatagaattaaacatattgtgagtgtacatttaaaaaacaataatttaggagaggagagatgctaattaattactatgcatacatgcatgcattatattataaaacacctttaaaaagtagttgtgccctatattttggaacggaaggagtaactgttaatcttgtcttaccaacgttaaaacacagggagcttaactgattagtcttgagcaattttgaacttaaaacacagggggcttgactgattaaattcggcaaattttgaactcaaggggcttaactgattaaactaacacaggggacttgactgattaattaaacttgggcaaattttgaactcaagaattggcagtgcttgctgcaaagtgcggaagggcctaactgctaaaataagggtaacttataagaaataaagtggtcttttatgcaaaagccgaggagctgaactgcaaaatccaaggagcaaaatttaaatttgaagaattggcaggggccgcgcgaacgcgtaccccctctaccacaaattatgacgtccactctcccacttggggagatggtaagccagcgcacccaccaagtgcaatgtgggccactagcctaggccatgacccttcatgatcggccatagaccccgtccaggtaagtatggagcaacggtgcacctggccttggttttatagcgtgctctcccgccccagcctcctcgaacaagcgatgtggtactaaaaaaacgctcctgcgtgctgcggtttggaagccggggaattcgagtccggacacagcatatgggccgtattgtgtgcaggccttctcgtttgggccagatttatacatacaccccgaagagcagcagaagagagtaaaaaggaataagttcacttcatgaccctcaaatgtgatcgaaatctaatccatgaccctaaactacaaaaccggatatctcgacccccaatctcctaaaaacggtgcaatttgactccctgggcagttttgggaggcagttttgctgacgtggcgcctacgtggcaatattgaccgagtctttattacaagtggcgttgacgtggcacctacgtggcggtagaaataaaaaatatgcgtgggacccgtttgtcattttcacacataaaaaatatgggggccactgacatatgggccccacatgtcatcctccttccttcttcctccctctctccttctctctctttcctccccttcttcggtgtggggagcggcggtgatggtcgatggcggtggggacgaggtggtggggagcggcagctgtggcggtggggatgaggcggaagggagtggcggctgtttcggtggggacgaagcagtggggggcggcggcagtcggtggccatggggacgaggcggtggggagtgacatctgtggtggtggggacgaggcggaggggagtgacggcagggagcggcggtcaggaggagtggcgatggtggtggggacgaggcggaggggagcggcgacggctgtggcggtggggagcggcggctgtggccgtggggacgagacggagaggagcggtggtagctgtgggtgtggggagcggttctccggcgagtgtcacgctcatggcgctgatcgacgagatggggtcggcgtcatggaggaagtcgaccggcgggggttgcccttggcgtcgtcaatggctgaagatggaggcggaggttgaaggcggcggtccacgcgctcgaagccagcggcgcagccgtgctggcgtggaagagggaggcggccacttggggccgctgcgagacgagcaggacggcgacggcggcgggccacaagttcaggccttcgagcgcccgccaccgtcgccgctccggccttccaccgctcgccgccgccgctcgagcccactgccgccgccgctcccgctgccgccacatgtgagaaagagagagaagggagtgagggaggaggaaggaggactgacatgtgggccccacatgtcagtgagcccacatttctttttgtgtgaatgactaatgggtcccacgtatattttttatttctaccgccacgtatgtgccacgtcaacgccacgtgtaacaaagacccagtcaatattgccacgtaggcaccacgtggcgccacgtcagcaaaaccgcctcccaaaaccgcccagagagtcaaattgcactggttttagaagtttgagggtcgagatatcaggttctatagtttagggtcatggattagatttcgatcacatttgtagggtcgtgaagtgaacttattccgagtaaaaataccaacttttccaatcttataaggacaacatgtgaaatgatcaaatcaagtccattggattcaagaatgtacatgcaagtatactacgaagcgggaaaaaaaaactaccatggctcgaactagaactgaaatcagaagcctgtaaaaacaatgttaataacaattaaacaagactggcccctacgtgatcctaaacacatcataatcccttctcgaccaaccatccatctggcgtataacagctggtacacgtgtcagactacagcactgcttcgctgcctctctatgcaacagtagtcatcgatggcccgcggcagcggcaggaggaggaggatgaggatgttcttctgcctgtccgccggcggcggcggacggcgcgggctgctcatcggagacgacgatctccagccggtcgtctgcggctgccgccggttggagcgcgtcggcgtccgacgacgaggacgcggtggcggagagctgctgctgctgctgccggaaggttgcacgcgcgggggccggggtggagggcctggcggcggcgggggggcagtagaggggcggcggcagcatggcggcgggggaggggg

SEQ ID NO: 13950 - DNA, 21414 bp, Oryza sativa
cccccaacagcaaattaagccgacatcagaaaccgtattgtcttgctttttctataaaaaaaaggatataaattgttttagaacaatttagagttttgttatttgctcacggcattcttaattcaattcggcactttgtgcgacaaggaacatatacccacccataaaaaatatttaatatatattgaagtgaaaaatatgtgcaatgagtagtacttaaaaaataatcatatttatcgagagaaagaggagttaagataaacggaaccaagcgtgggaagctaattaattcattgtattgatttctcattggcaatcaatataaattcaccagtatatacaaatattcatttaattaagatataagtaacaatacgacactataaaatgcttctctagagcaccacataattaatgaactattatgacgatatatcaggttccttttaaggccctttttctgctgaatggaatataaacgatatatgcaaaaaaaaattgaatggttgaataattggtgatacttatttaagagtatacacgaatttattaactattataaaatttaaaatggatttaaaacaatattttaagaatttcatatgtagctcgagaagcatgacactaaatagaatgcgacgtccatggctccaccattagataatgaatgtagtgaagttggtatgaaactcaagtgtgaacgtaactatgccgttgattttttttactcgcccgcccaacatgcggtgcttgcagcttcgcgaggcttctactggaagctgctagcgtcttttgagtactgaagtacgaatcgaacggttcatacagtttgctgcctgcatctaacggtggacaatttgcagcttacgtcgctaaattaggattcaagaaagatcaattctttcactactttagatttgccaagagacaacttcaaccattattttaacaacttcaaccattattttaagaactacattatgaaaaagtagtgtgcactatctactggtataaaacaatctgaatcattgatctcgtttgattagagggtttcagatatattactaccacctcaataaacaacaatagtagaaacatggagggtattattataaaaagaaagatgcaaaggggtataattgtcatttagccgtgattaaacttttttttctccctttttagcttttccgatagaatatgagcaaagccatcgcaatgaatgattatagaacgatttagccaagaaaaaataatacataaatactccctccgtttcacaatgtaagtcattctatcatttcccacattcatattgatgttaatgaatctagacatatatatctatctagattcattaacatcaatatgaatgtagaaaatggtggaataacttaaattatgaaacggaggaagtaatagttactcttaatcatggtattagtaaattattaatttatctataataatactggtagtataatactacagtattttaatatatcctctaagagagtgaaaactttacggaatacaattttacaggttgtgtcatattgcaacaaaggtaacgtaagttcaaagtaaaatatgtctattgcaactaaggtaacatacgctcaaagtaagacaacaaaagtaaattatccagtttaaaatagaaacattaattaaaatatggttcaaaatatcgatataaaagatggcccaaaatttacttttatagagaagtgatatgttcctaactttgaaagtcaaaacaacttttggtaggagtacaataaagggcaacatagtacactaaacaaccccctccctattaatataagccataattatagtattagtgaccactttcgatctgactttgtctctctggtacgtcaagcacaaatgcacaattgactatttctgaaattgataggccatcatggcctttattggtaagataagggcagttcgaacccagagaaccactaaactatcttgcttctgttaactaatatccataacccatcatatagtttccagtttcgaggtgatcttccccattttgcacttctacttcagtctaatggcaaaaaaacaggtttctgtgacttcgatcttacagaacattatattttttttcaagtaaagccaagtccagatcatcttgattcttaagtaaagctagctaaatccgcaaaattcttataaataaaaagcaaatccgcgcaacaagaccgttgcactctaaactatatttaaattaagagaacatgtgatttataccagggcgaaagctatcagccaatgtacctattatctctttatcaatctattttactctctccgttcttaaataatatttaccattttagtctaaagatttatctcataaaactttcttttaagtggacccattagacatttttaatacaacttcaatattcttcttcttgtttagccattgaaccagcaatgctccctcctcgtcgtcctcattttctcttcgcattaatgaataacaaagtaacattttaatctcttacttaatctacctttgactcgctagaacaatcgtcccttaggatggagggagtatattgctaagaaaagatagtgaaccatcacatttgtttcgagatcttagaaattactaaattaatatatgaggaaaacataaatatttgtaaaattttatcgcattgaatctagattataacctgaaaaatcgatcaatctatataggttatatacatgtatttttattcattatctaaaaatagttatatacaatataattatattaattatatttatagaactacaaataagacccccacataaatacaatttttttaaggaattaataaaattatttttctaaacaatttttaatctagctttctgtaattgtcaacgaaattcagcaagttgtgatcgatcgtaaagaaaaagaaatgattcagaaaaaagaagagctctctactgctaaaaaataaaaagaaagcggccagctgccgtaaaaggaaaagggccacacgaattttgtttcgccacgccatcgctagatacgctcgcgcacaaagcgaattcgtctcgcctgacgtgatgcatttctagctagctactgtactagctagttgttgttggtattatccgcgacgagaaattaaatttggtcgaataatcgtggcatgagcgcgtgagattaaagccaatttaaaacccaacaaaaagagggaaggattaattggtggtgccttaactgcgattcctccagcgccgccgccgcgcgaggccgcgagccgccgtcgccgaacttggccgttgggaagctcgtcaccaccgccggctccagcccgcggatcccgcgctccacctgcgcgcgcgcgcgccatgcgaaccgatcacaaacacgctcgtacgtacgtagcacgaacgatcaacgagaggatggggttgctgcgtacgtacgctgaaggccgggaaggcgtcgccgtgcgccgccgcggctgcggcggcggattggcccgccctgaggtggatgcgggcgcagagcagcctgacgaagatgaagagcacgaagaaggcgctgacggagaaggccatcaccgtcgtcaccgtgttcatgctcatgccgccgccgccgctcgtcgacttctccgccggcgaggacattcgccctccagcatctcactccgggctccaccaccaccaccacccaatccgcgagctcagctagctctggattggatggtatcctcctcctcctcctcctctcctcgccgtcggagaatcaaccaattaaccaatcaagcaatcaatcaaatcaatcgaccaatccacagctccccgccgtaataaagtggaagaggatgagaagggcggagcgcatagcgcatagcggcaacagcgagtgtgtactcgcctcgcctgcacccgcctcggcctagggaaattgttttgtttccgctactggtaataatctatggtcgtctgccgattagttgcacgctaatctatcatcgttgagacttgagaggctaataatcctcaattgttaagggggggggggtttagactgatgattacgcccactgataatcaatcaatggatgggttagtttaattaatgaacttagcagctgctgctgctgctaggtgggacctcgctttcagacgtcccccgcggccgcggcccgccccgctcgcggggtcgtggtgcccatgcacgcgcccgtccacgttgcgtgtgtgattgatgcgtttagcccagcgactagctgcttcgccgtgccgtgtccacgcgctcccctccatcgccgtcgcctcctcctctcctcgttttttatctagataattacatatttcctccgttttattatataagttattttaacatttcctatatttatattgatgttaatgatatatatgtctagatttattaacatcaatataaatatgaaaaaataatagaataaattatattatgaaacggagggagtagaagatacacacgcgtgaacacatgtacacattgattcaaagatacaccactacacatacccaggtagaaatgtaagtggcccacgaacccacttatatatcctacacacggccggtgacacgggtggcccttgctgacgtgggctatccgtgtgcggagtgcggacgtggcaagtacaaccggatcgagcggatggcacggcacggcggatcgcgggtgaaaaacggtgtccttttttttttaactgtggtttcattaatcgaagcgccaaagttcttttgagtaccaggtacgtgttcaagaataacatgatggttacaacacgtagtatgacaaactgccccgggacttgtcgatcgatgaggcgaggttggaaaacttataaaaactgatcggtcaggaatacgtcaacgtatttgatactgtttcctctgaagaatccagttcaggaataaagccccgaggaaaaaaaaagagcttgatgacacgatctgtcaattagtacgcatttgctgccaaattaatcctgtttcgagccctctaattgggaaaaaaaaggatttctcttgacaatgacgttgcaattaaactgaaccatacagaatagataaactcgtgatcccatcagctatatcaaacgcgacgacacatgtgaggtcacacaaatttggctcatcctcgtgtcataaaaaaaaagaagaaattgcacactgcaaacaagctctttgtggtggcagccatgggcccccaaaagcccaagtctagtagagggactctaccgttttgttcagctcttcgagcttcttcatccgcagctgctcgctctcgcccacaagctgctcaagatcatatggaaatacttaatgagagtataacataataaattcagaagaataaatatataatgtaccaaaaaacattactataagaactgcagcgtgtagtaatgatcttctgaatatattatgaaatgggtattataatacccacttcacaatattattcgtctagtttaaactttacaagttgttccgtgtttatccatcgagtaaattaagatatacaattgtgtatttccactgtctatctttgctataaatggtgaaaaaaaaaacttaattaattaacatatatcatctgctagtgggaatcttgctccattaacggtggttaggcatttagaggaagttttggacaaatatacattaggcccaaccttgttgatgaagatttgagacaaaggctggatgttgtcttgttgcttgggaattttgggctaggcccgaaaattataactggaccttgaaatggaagtaggcatcaactttaaacaattttggcgcaaaaaaaaaaacagaaacctccatttggtactccatgggtaggtgaaaatgattggaggattcttgtgattggttgagaaaagaaagtaggtaaaaaaattaaatagagaatagttataattgattaagagaagttggtaggtgtaaaaatatagcttccctaaaaaaaaggtgtagaaatagattcattttgagacaagtactagaaataactatattttagtacgaatgtagtatcaagctagctgttctttgttctcacccttaccttggactattctcatataactacttcggttttttaaatatgttttatcaataaaggtattttaatcatgtcttatctttttacatatttatactatttttttaataaaatatattatcaaacctcatgtcgaaaaatcaaagtcatatatttaaaaacggatggagtaaatggtactacggttgttagtttcctacatattttttatgcaaacatttccattttatatttagataattggaatcacaatttttttttgctccaaatagttcaaagaattttgaacttttcaatgaaatttgatcaaaattcaagtcagtcctacaactattttgactgaatatatatgctatctttcctgggtagctaaaaaccactgaaaaccgctcttctgtcactcacctccatcaacctgttcacaagcgttgctttctcgttgctcttctcgttgtaagcctctaggcacgccttgtattccttctcctgtttgtttttagaggggaaaaaagggttaacgcccggcgcatgcggttgaattcgtcgtaacaaacatgtatgtacagctatattgctgaagaagaagaagaagcagcaaaaaagaaaaaaaaacacaatggcatcctcaccttcttgaggcagttcttgccgagcggcttgagctggcggttcaccttgtcgatgcgcttccgtatcgtctccacctcccgccgcgtcggatccgacatcacctccagctcctgcaaatcaaccaacagtttagcttgcgatcagagatgatcgatcgccatggcggacacaggcatgcacggacgaacagtcgaacactgacctggcggatgaaggcgaggcgcttggtctcctcctcgacccggccgagcatggagaacaccttctcccgcacctccagcttcttccgctcgatctcctcctccttctccttgaacagcgacagcgccgaccgcgacgacgactggtcccactccgacgacccatcctcctcgccgccgccgccgccgccgccgccgccgccgccccgcacgcacacgatctgcatctgctgctccctgccgccgccgccgcactccatgcctctcgcctctgcaggtgcttctctgctgctagctgcaacctctctctctctctctctctctcaccaaccaatgctaaccttaccgcagcgagcaatgtgtaggaactagcagtagctaccctaagctaacaactcctctaccttccaagcctatttatctcttctcaatcttccttcctgctgccgcttggccatgttgatatgcaccttttttttttcttttgctgcagaggattaatggttgagtacaagtgtcctacctgcagtctcaaccttgaagcaagcagcggcagtgcgtattaacaagtttatcaatggcttaatctgactatatcttcatgcatgtgtcagtcatagcagctcatgtcaatgatatcataagactatctactagggatttgatggaagagaggacagcatgatttcacgtacatgtgatgtgagctggggagcaaactgtgttaggtgaggccactgtgtcaggggtcgagtagaagtaactcctgcgcaagccgcccaagtgtttcattctcatgtgagccaatgcctacatgtgcactgcaggttgcaacctgcctgctgcttccattttcattttgcttgctgcaggtgtatccatctctgacttggccttgcagcatcagagactcgagagttgttttcctcttccattttgatatgtccttgcgttgttattgggttaacatctcggagaggaaagctgagatgtctcttcagccttcagggatgggagtgctggtgctttgtgatgaagcatcccacacatttgtgtagctgtgctagtactcaagatgaagtagcagtcaaggataagcagaacagagtaggaccacacgacctgtttagaagctgacatggccaacaaactttgactactagaaaatctcaccttgaaatcactggaactcaaagcattttgcttaatgatggctaagccccgaacatgattctaacttttctttttgaaaggataaacatgattctaattaactaagcatcaagattcaagcatcacaagatgtacagaagtgcagaactatgtataactggcagttcgaacggtaccaacaaatatacggggttcatggtttcgtcgccgttcgacagccatagataattacaaataaacgtttctttccctcacaaactaaaactacaaattgggagcgcaaagcacaaaagcaagctgtctagtctatccggcattcatcgaagcagaacctaggaaagccgttcacagattgctggcaactagtttttcttgctccttcgcactagcagccgcacacacttgcatgctgcctcttggtgttctcattccgctggagcatagacaacgcaggttctgctaggagaataaactgagaacgagtagggcctgttgtcatgtgaacaatcctgcaaggaatgagcacaacagaggttaataaagagcacacaatatacggtacgcaatttcatctgagcaagacttacggcagtgaagtgctctgcagtgtgatggatcctgccaaatccaccaaagagtccagcatctgagtccaagaccacctgatagaaagcaacataaattattttgcagttcagcaaccaacacatccagttcgtctgtaagaagcatgaacgcgctgcaaaactgactagaggacttttgagtaatttttactggttattttcaaatatatggaaggagtaaactatggcagggtcaacataatgggcacgactagtgtaggtaaatatgaagtgttgatgattaccaagaacttctttgctcgtaattcctgatttaacaccaatcaataaataatggcacttgacatatcccagagacccagggagaaatattagttacagtacaattggagacgtacataacatgaaatttttttagtccacattcaatattttttaatctgaataggaaaaaaaaatgaatggttgcaatttgaggatccagacctaggactatcgctaacaaaggcaactccttgaccaccggggtgcatatgcaagcatagttgtcaatctattttattcttgggcagaaatcatacaaatccgatttttttggcattttgccattttctacttggttaacagtaaggtcggtaaagccttacctagtgaacaaaaactataattgatcacgggcaatgcacaaatagctgcataccttatatttccctggctttaaacaaccaacacggtagtcaaaatagctgttactccaatggaagttgaacacaaataccagatctcccttctcaaatataatcatcttatcctcttcatgctttcgagatatgtactggtggtctgatgtcatgaactgaaataacatagccataagaaaacccccatcagtgtcagagcaatgttaaaacaaaaccatcattttacttgcaaagtttttcctataaatacaaaaaagaaattctatgaagggaaatatatgcattatattattgataatgcatttattcatcaataaaaatataaaattactgtccacatagcccatgcaaacaagacaaaataatttaattggcatcgaacaaagctgtccattatttaacagtattgattactattgcaatgattggaagacatgagaaaacataatgatgcacctagataatgacaatgggagctattcctaagagtattggacataattgcataatgcacaagtgcagctcgtcatttcaccatatatttcaagtggttttggataaatagttgacatagcaagtatcagtaacaggacataagcataatggctcatatttgtgcaacccccagaaaaagataagtgataaatacaacataccccatatttttcctcgagagactgcatcgcgcggtcaaactctagcatgccacgatacctaagatagtccgcatcaccctgacaaagcaatgaaaaaacttactgatccataacaaaatcatggttcaatgttgctggcctcgcacaaatgttaatgtgaataaaaaggaattgatgaattagatgaattgtcataatgggaccttcatgattaaaacactgcagaagggggtaaaaagatatctaaattgaatccagggaatgcagaacttattttcatcaataatcaggtgacagagcaaagaaagttaccaggtcaaatcttcgacggcatttatcataactgttgttattccctgggatgaatttaccatttggaagtacttgtggagctcttggaaaatcaatccattctgcaaaataaaaggtagatcaatggcctttaagccaattgtttcccagaaaatactaggtgacaagaaccattgtcatcaaatgagaagttgatataaaataagaaacaaacatggtgtgtgattgttattaaatctcaccaggatgtccgaactcatttcccataaagttaagatagccttctcctcctaaccccattgtgataagtctaatcattttatgcaatgctattccacgatcaatgctaggtgttgccggtctgtccagagccataaaatcatacatatcctgcataagtacagtatgtgaggttctcatgccagtattcattaaaattcatacatatcctgcatgtatatgcattttctcaacaattaaaactcaaagaacaactctattatctcaagaatagtacggtgatacactgatacacaaatatgttttaagtattaaaacaaggaaataacattttccaaagaactagtaaagaatagaaaattcataaatacatgttgcaactaatacaagaaaaactgggtgtagactgcagaaagcctaaagctatccaacttaaaacactgatctagctgtggttttcataccgttcttactatccacaatgaatgcattgagtatatttgagtaaaatcagtacaaataattatcaaggatatattaaagagccattagttacagtcctaatcagtaaaacactaaaacctagagattgatgtgtggtaaccttgtccatcaaccagaatgcaatagttttgtcaccaactagtgcttgatcatgactttcagcataagtaacacacttctctgaccaccttctgttagtcagtgtgtgcacaatatcacccatcttccaagattcatcactttgcctgtgtaaaataaaaattgaaactctggcaccacatctttcaattaaaggatacaaaataacaatctttcccagtttctaaataaaagctaaacagctgacaaaaaagtgagatacgatgagcatgggcatttttataccacataataaaggagcattaaaaatgtaacgttgccaagtcaaactctataagttggtagttgcatcttattttatactaataatggaactcacacgaccactgttcatatgaccaaatccagcacatcacattggtaaatgcctataaccctatatatgagtgatcttttttttttttaaaaaaaaatcaagggcaggagttatgccaattaacttcagaagagaaatagagatatcatggtcaaggaaaccaatgtatacaaaaaagaatttaacacaagaaaacagtttatgttcattagatatgtaattagtatttctattaaccaaaatttgaaacacttacttgaggagttcaatccatttgtcaggaacagccatatgaaggcgataatcaaaaccaaccccaccatcttgaacaggaagggcaaatgtaggcattccactgacctgaagtagttatatgccatttaaccacagaacagttgaaattaagttatcttttgcaatagagttaggtttacgtatgggatttagagtattgttactactattgcaactctagaccatacaggcgacaggctgagcaagtggtctgcagaagtgtgtcttctgtgatcaaagtgtggagtcaattgaccaccttctaatccaatgtccagaaacactacagctatggtggacagttctatgcggcattggccaatcccattgcttcccatcaaatgagcagcccttcctcgtatggtggtgcgacagccgagacaaaatcatagcggcccaaagatgagggtttgacaccatcatcatatcctggtggcctggacgatacaaaaggagtggaaaaaccgggttttcaatggtcaatgcaagaccatgcaggagatagcggagctagtggcatcggaggccgcgccctggagggaggcaggagcgcgcatctaggtggagcatttggtcatcaaattgttccgcgagatattactatatgtttcccacacccatttttcttcctttctccctgtacatagttgctgtgcctgttctaacaacttttcccgatcttaatacaaaagatacgcattttgcgtattcccaaaaaaaaatgtagaccatacagagctactgtataacttgctttttgtacttcacaaacttccagggaggctggatttcccaagagaagaaaaggttatgacagtatggcaccatggaacatgcacagctgtttttgaggacacaattatactctctttttttacagaaaaaatgtactctttttgttcagaaatatgtaaatttttagaatgcacgcgttcatatttcaaacttctctaactcagaataatatataaaaacaatcaggttattcacatgcaaatggtgccattatattcgtcacgaatttttttcataacaatacatttgtataattctttactaacatactcgtataacattgatggtcaacttctgtactagagaccaggtggtcactaatctttggtaactatcattactccttgctgttttctaagcccaaggaaaacaatttcttgaaccagcgacataatttgatcaactatcaagatggggttaatagtaaatatgtaacactaagattggaaagctaagctttgggtatacaacattatgaactagagaaggcaaaactgacattagcgtaatatgcagtgcaagctttcaacttcttacttaagcatgtctagatgccaaaatattgctataaatgcatgctaaagaaatgagtacataaagacaaatatagtcagcacttacatcttcaccgatggttatggcctcaggataaagtccatgaattaaatcatttaccagcatcaagtaaactactgcatcagcatcagtggcaaatccaaagtattcactgtagttccccgtaaatgctacctaaaatagagggtggaatcataagataaaggttatgacgcaaataaatatgaaattgtaacagatagcaactgctaggtttgaccccatcataattaagaaggtagtgaagataaagtaatgaaaacgaagcaatatacttgtaatccatgatgagtgtacatcattgaggttacaccgtcaaatctgaaaccatcaaacttatactcctcgagccaccatcttgcattggatagtagaaatcttagaacctgtataaggataaaaatgttggcaaacacaatagagattaatgcatatgaataatgatactttgtaaagggaagtagcgattaacgtgttccttacttcccaattcccatagttgaaaaggcgagaatcccacatccaatgatggccgcgtgaaccactatgaaagtaatgcgtatctgtaccatcaaaaccgttcaacccatctagggtattatttgacgcatggctgcaaaaggaaaaaaaaggggcaaaggtaaagctattaggtatgcagctaaaaggggacttagtaaatcaacacaaaggttaatatttgaaaccaaaagggcttagaacccagaggccaatgagctaaactttgggccatggtgattgacaaattttggcatgtaaattagttctagttgttgtccaccagaaagccaacaaaagatgtcacgaataaaatattaatttgaattctcaaattcaataattgaatagaaaatatgaatgaaactgtttaattcattttcttcccatcctaagataaactcgaatgctagccaatttaaattgtgaaaactcttatactgcaataattcaagttaaacatgttgcataaaagagagaagatctacggttgtagattagtcataattagggttcaccaacatgagggctagatgtactttttttttatagaacagagaatcataccgttagctaaatacccatgagtagaagtggattttttttaaaaaatatcataaaaatgaaatgaactatgcatgaacttctcaggaaaaaaattgtaatttgtaagcaatttggaaccaaacattaatccacaaacagcctagccacatgcataaatgatctatttatccacagaagatcccacaaactcaagaggtggtggtataatggcagacttaccaccacagccttcttctatattataaggactttcttttatctctgtggccacgccttactaacttagatatgaaagaccagttaacaaatactcattctgttcacttttataacgcatattttgatttcagaaagtcaaactcgaaagattttgaccaataattagttgatatacaagtatatttagagtataaaacatataccactagattcatacctcaaagtattttcacattatattggttttatagctatgataaatatattttatgagaaattaattgtcaaatttcagtcataaatactttctaaaattaaaatatgccttataaaaatgagcagagggagtaattaattacctgtgaacaacatccatgagcacaactaaaccaagctcatgagctttatcaatcaatgactttaaatcttctggggtcccgaaacgactacttggtgcaaagaaattggtgacatggtacctgaaacaaaagtaaaaaatctgcattgctcacccataataaaagtcttaattgacaattgaaaattatctcaatagccattcattcaaaaggtggcgaatgtcatttgttacagttcaattgtaccaaaacaaaaggggaaacaaaaggggtcagtaacagcattgtttcatgagtataaaaggaagataaagatgataagaaagatgaagcagtttatcacattatacaaagggaacaaggaagatgaaagataaagtctaaaagcatatatatgtaaactgcaaagacaagaaataaatccagcaatatgtaatttgatcacccaaagcttccataatatgcatgctcttgaattgccattatttgcactgcattgtatccaagctttttgattcttggaagcacctcatccctaaagtttgcatacgtgttgatctttggctcctgattgcaatattaaaattaataccagccagcatagtacaggaaaatcataaattaccaacagacgcccaaaaaaaaatgtatacaaatggtaggcatggtgttattcgctattttttattatgtaataataaccgtacccgtttgtaagaaatacaaacatagattaattaaatataccctatgttagcagaaaacataaatcaaaaattatatcagtgtaaatatcagtaatttgtttcaaaacatcatatttgaatcaaccatccagcaaaggttatataaacggctaattgttgacgaatgtgcaaaaaatgtgctgattgtattaatatattattacagaggaaacttgtaacaacttatcactgcttagaagtagacagttataaaaattaaggctaacagcactttaatataattctagaatgtaagttaacttgaactgtatatggctagtaattaaaagaaaagatgcattaccgtgctactcattccaacatgagtttcgtatatccgcaatgactttggtcttttaggttgaggatgcttgaatatgtacttctcctgcatagtcatataaaacattttaataactagataaaaagaacaatctaaagatgccaacaaaaagagaaatttccaagagtccaaggacattacagaagtattcacaagtacaaatgaagcacttttttcaaggaacaagaacatattcaaatggcgtgtgcacgtgttgggggggggggggggaggtacctcttcaggaggatcataatatattccattgtatgggatttctcctgcggcctgcacagagtacttgatccaggcaggaatagaatcctttataccagatggagtttccattcgcacctagatgacaaaaggcatgcttgatacagggagatgctcacaggcccagagctaaaacactggccaagcaggataaggaattacctttacacgtgagccatgtggaataggagatgagccatcagcattgttaggcagaaaaatctcccaaacaccaaactcattctggaaacagttgcattagatatgagcatcggtaactaccaacttaccaatcatatggaattacaacactaggtccatgcattattagttacaacctcaagctactcatcttctcctatcaagtccacaaaaactgcaaaatacatctaggtactaaagaatgtacatgtaacatacacaacattaatgtactaccactacagtagcatcaaaaccgataactaacagttaactcatggcaacagtcaataacatataagagtgtgcatgatatatatatataaaaactcaatcggcgggttaagatggcccgcagcatgaagctaagttgagaaccccacccctgaacgcatcgcacaaccgggattgctcaacctcacatggggagcacgcttctgccagcatttgcaaggagggatttaattttttttgtgcgaaaatccaggttcgagtcaggtttaccactgcgctatacatgcgttcgcatgatatatcactagctcaactctagagtatagatgaaaccaatgctataaccaaataaattagttaaagaaatgtaaacaaaatatttttgaagaaaggaagggcatatttgtgagcctgtgggcttactttgctcatgcggtctgcatttggattccaattgttgaagtcacctactaatgctgcagactgcaattggaagcaaaaattagttcttaacaacgtctagtcaagtacattgacaagttgttcatctgagaattataaattccatacaatctggaatatctcagaatatatggcatggtaattatatctacatgtactagaaatatggaactaataatgtagcattttaggtaaatggtgagactatcaaaagaacatacatgtgccccgggagcccattctcgataagtgacaccttcagcactacatgggaagaaggatgaatatcactgagttattttgttacacccagagaagtgatgtgcggttacaatgtaaaagaaactatacctgtgattaaatccaaacttctcataaccgcgagaaaatgtttccagtcctccttcatactgatcaatgtctgaacgcagtctcctatataggctatatctgtattcaatcaattaaagcataatcaggtttctagtagagttagcatgggcatattgacttcatctatgctccctccatcataaaataaatcaactttccaagttcacgtacgaaagttgttttttctaggacagagggagtataacaatgatataaaagaaaggaaataaagttgttgtccagttgacagacgtcagcaaggtctaaaacccattatgtattttacatcatagataactttcagattaaatatttgcaaaattaatattgcatttcttagttctgacgccatcctatcactcttttgtttggtttgcagtaccgccccaacccagaaccactgtgaagagtactatctatgtattattagtactatttactatgtatgtccaatatactcatttgaccattaactttttttttctaactatatgttgacttaaaaattcttataatggtaaatctatttttttttcgcacattagtagtttaggactcttgttaaattttaaagcatgactgaatgatttctaaaacaacttccatttgagaacagatcagagtatatatgcaggactaaagataaaacttcaagagtctcatcagctgtgacacgtaagtagttatttgcatacatcttgtgaaagactgaacagatggagaataataaaaacataacctaatgaaactatgtgatctataaagaagggcggaaagccataccgatattcaagatggtacttatagccattaagcatagagtccatctggaatattttttgcccatctcctgttggtgggacaactcgtggtttctgctcagcagctaattcttcaaccactctcttcacgccttcaacgtcacttgctccagatgactcaatctcaacttcagctccaacctccgtgcttaattcatcatctaaggctggcaactacaacaatgtacaagagataaaatgttcagaagtaaaacataatgacaactgaacggaatgagcgacaacaagcaagactctagatcaatcctacgcatatggtgtgccctttgaggcctcatatagggtgctctagacctagatcatattatcattatgcacgcagacaactagtatggactaagtacataaaaaaggactgaatcactgaatatatcataatcccgtcacaaacagaaatcaacacgtctcaagacgtggactgcgtgaaatgtatatgatctcgtaaggtagcactgcacaagaacatgtctccattttcaaacatgacatgcaaaatgctgttagatatgtagcaatagtattgtcaaggcaggatgaatcatgatcacgcacctgcagatcgtctgaacctgctgaaaccggcatcccgtcgctctcgccctcggggatcatcacctcccctgacgcgcccgccgcgcgcacggccacgcgccccccggaaccccccacgcgaacggcacctggacacgagacgcaggcaaaaccaaaatgaagatcacgacgatttaccgcacccgcggcgcgacgcgacacggcacgccacctggtcgagccgaggcgcacgcgtggcgcgtcgcggcggacgagaacaacaaggtggcgcgggatcattaccggggaatctccggccggagagcagcgaccgcgacgtcgggagctccgccgccgcacgccagctccgggccccggctggcacggggaaccgcacggcccccgcccgtagccccgccgcgctcccgggaaccgcagacgccggcgccgccatctcgcccgcaccgcagccggatcggatcccccggcaacccccgcgctctgcttccacctaaaccctcctcacgcgagagccaaagcgaggaggcgctgcctggtggtcggtgtgtgggtgtgcgcgcgtgcgggtgcactggtgctgaagctaggaggagcggagggcgccgcgctatatagaggacgaggaggaggagctctggtcctgatggagcgaacccctcacgcgagagtggcagcgaggccgcccgagggtgggtgtgcgatgcgtgcactggggggacgggggcggaagaggcggttgcgcgtcggtccaacccgcggcgcacgcgagtcaggcggcgagggcggagggcgaggcttttcccctcccccctcgcggtgaaagcgtcggtttcccgtgcgcgcccgggcgtcgcgttgcgttgcgggggaagggagaggagaggagcgcgtccatgccatgccagccgctgctgccaggtggaaggtggagggcagcggcgcgcgcgcgcgcggggaggcaggcggagtcaccaccgatcgagttggcgtggcgcgggccgtgcggcacggcgcgggttggggaggaagaggagaggaaaaggaaaccaacggcggggaggctttccctctcgacccgtaacgccgcttgcgtcgcgtctccctccctgctacttgctactcctgtgcttctttttgtttttccttgtcctctttggtcgcgctttttgttacccagggaaaacaacaaaagggaagatgggagttgggctggacccaggaggcttacacgaaacaaattctcagtgaatggaagaacgcaacaccggtgctctgttgtttcatttttctgttctgctctgtcacctctgtgtaaacgttgaggagcacgtgagggagaagcactcgtgcgaagcgtgacctgactagcctagtagcctgtggtccatcatcctttctcgcggtgaacaatgggctgccaaaatggagcacatcctctagcagactggcgactccgcgtgcgtccagcggattgggcagagcgatttttctgttgggccagcccatgaaaccaagcacaccaaacgtgtgagttgagtacttaagaattcaaaaaagattaagttcattggaggtcccttaacttgacaccgaatccgtttatcctccctgaaccacaatataagatataggggtgggcattcggtctaaccgaaaatttcggtttcggtctttgaaaagtgaagaccgaatttcagcgcaaaatattaggaccgataaattcggtcttggtctcggtctcggtcttgactgaaattcaacaacattttcatatatgcaaagaaataatggaaattttcaacacaaaaatcacaaaaaaaatttcgtaagcacttatgagtaaagactcttattaggttgcatacctagaagaagtagggatgtgaaaattagagtttaatcctattaaacatagtgggttgtaggttgcatttagacgtttttttgataattcggttttttcggtctattcggttaaccgaggagactaaccgaattgaccgaacaaaattcggtctttcactacctagggccgaatttctcggtcttggtcttttcggtttggtcttttctgcccacccctaaccagatacaacgggtctctcaactgacaaaaccggtgcaagtaaggtcctaagacggtttggatggtgatttcggcttatgtggcatctacgtggtaagtttgacttggtcctcatcctacgtagcggtgacgtggcactggaagcaaaatttgaaaattaaaaattaaaacaaaaaaatgttggaccctcatgccatcgagcgtttggttaaaaactaaaagaatgatattggaacccacggccaaccctttcttttccctcttctctcccctatttctctatcccctttcctcatcatcgtggagctggtgacatgtgagggccgcgat

SEQ ID NO: 13951 - DNA, 9927 bp, Oryza sativa
cctccctttccgctcgctcggaccagccgctccacccccgaacaccgtcacttgctgctcctctcctgccagccaccgtgctgaccaacgacgacaacttcaccgcactcgtcgacctgaccccgacagctgaaaacctcgacaccaccagctccttcaccagcccgaccactcccgtaacgctgccttcctctactgctttcgccgcttccacggcctgcacctccttagcttcctcatccaccacccccgccacgtcgactagccagcctcggttggtccctgctgacgaaaaaaccgcgctcggccgatggtgccgagtctgtgttggcgcgaactaagtcaacgaacacaacggccagggagatctaattagctccagtgcaggtccaaaagttgatgagatgcaggtgtgcctatcagtttgttcctgcaactgacaagatatacaaatagcagatcaatgagccaatcggctgacaagccgatggaataattccagccgatgccgatactagcctatagcgataaggttttgagctatcagctatatgtttgatgtagaatctgacacttgatgtaaataaagacaatcagctgatgaaaacaacaatttaatccaatagaaactaatcggctaataatgatatgatataataagcactgatccaaaggttaaagcatacatcggcttagaagtccgatgtcataaaatccacaagattagataaacagtgaaacgtctgttgccgtccgctaaatccaacttatgtgcaatccttgtaagccaatgcaacgtccagataactcatcggctgaaaccctgatgaaacccttattggcaatcaaaaagcaagctagggattatggtttgaagcacgacttagtagatcgaacttaactgatgcagcactaagtatgaaaagaaacataatatctagacaatcaagcccttgattgattttcagggtggtagataccttagctaatctaatctggtaaagcgatttagccgatatcggcataaactctaaaatgaatctcaaccgataaaagtaaatcgaactatcaaactagattaactaagatatatgatagataggtgcttacatggacaagatcagagtgttgaagccctagccccgccgatgcaagcaaccatgacaagtataaactcatcgaaaaagtagaaaagtaaaagagtggcgatgcgccgaaattgtattgattgtgaagatagtttacaatgaccccgggtgtacatatttatacccatgggtagatactagtccttgttggataagaaataaactttcctaaagataaaaggaaaacataaactccttataggacactaaacacactttcctaaagataaaggaaactacaaatgctttctaattaatagataaattatcatgccacatcctccttgaactcgatattttatatataaacttcgtttaattgattaatttccttaaccgaatatagtgacgacttgataattcccatcggccgattccagaactctgaagctgatattgactttatgccaatgatgacttcagggcttaccaaatttcactatttacagtcccttccttccccgccgccatcgctgctgctagagatggtaatgggttgacgagctgacatggatgcgggtggagctcgtcatctccttcctcatggcgtcgcagcgtagacagcaaatgacgacgagctactccacgacaactctcctcacgccgcctatgtcgcggccactgcccttgccaactccggcggcttgtaggatcgagatgtcgactagatggggagggggtgaataggcgatttaaaaactaaatgacacctaatcaaaactaacataagttgctaggctcagtgagggacaagtctaactaagcaactatgttatgttttgcaatcctggggtgatagtggctcaagtatatctctaggaaagtaaatcacacacctaagttaagtttttgcaatcctagggtgatatggactcaaatatgtctctatgaatgtaaattgcacaaatgtaaatgcaacaaataaatgagacaagagacaaggagtttttcaccgaggttcggaaactcgccggtttcctaatccctgttgaggcgagcccaactccacctctcaaccacgaagccaccgcacacccccttcgtcaaggggtgggcaaggtgggagccgatccacggagaggactacccaaacctcaatcactaggggtagttcttccttcacttcgaaggtggtgaactccaaaccactcacaaccggcgccgggcctcctgcacaatctcctcggagaggtcaccgggcaacacctccacaagccgtctaggagacggcaacctccaatagtaataagagatgacccggctcggagatgatcaagtgccacactagctctacaatgaagcaaatgcactcgactcttggctaattaaccctcaatcacacctaatggatgaacacaagaactagagagtgtgagagagtgtgcaaggggtgtatgtaagtgaagcaagtaccaagagagttcccttgctgctggtgggggagtatttacactcccaccaactaaaactagtcgttgggggcgaaatcccctaactcagtgtactgccggtcagactgccattgtgtggccagtcagaccggactactatgtaacggctagttttttagccattacagggcaatcaatgagcaattctgaataggccggtcagaccgcagtactgcggccggtcagatcggccacgcctcggtcagaccgacatcggctcggtctgaccagttgcggctctggattggctaccctagagcatagctgccagcctccagggggccggtattggtatttcttaatgacattactaaaagtataattcccagcaatggcgcagaaatactcctagtatattatggttacagaatttatccgcaagcgcacggatataccattgtagcatttcacccgagagtattccaagggtatcgtatttatttaatcccgtgggaagattatagtagagagaaccatactaataacttatatattacttgtaataatcatagtctaagcaggggttaatataatccataaggtagaatgacacacaagcatagaactacttattctcatactaaattgtctaagctaagtggaaagaaagtagaaaagaatctattcctatacttctaatatacatagtatacacacattctagttatatgattaactagctaataccctttttccgatgccctcctagtacttcgagaagccatcccttactgtcgagttcctcacgacagcccgtcatgaccatacaaacagggctaaatacggaggagtaccctctccaggaaagtaacttaggagtatatacacgcgtagaggaataccgtgttgagctgtcaccaacagcggcctacctctcatccgcaacatataaccccaaataatgatatctaataatctagacaccacgcctaaactaccagatactactctaaatcgtcatgacatagaataattgcataagcaaacattatacccgtacctatgcatctcccagataagctagcaatataatcagtataacatgaacataaagtaaaattggcatttatatactcggaaagtatttcaatacaaaaaatgtataaagaagaatattgtaaataaagtacaaagcttacaaaataggaaaggagagatactagatccatacccgaactcttccaaagacttctggactccgatttctattctattcctactccactagcttgcgaatactaaactaaacttgagagaatatgagaaagcttttgcttgaagtgtgtgtagaaatggagagagtgggctccttaaacaggcaggtaatgatggttatggcggttgctaaggtcggtaataccgtccaaccgccataggaaggcaatccacaccgtccagaagaagtcctgcatccaacggcgctgaggggggttcggccgaaccatgggctggcccaatctatcccattttcggctggcggcctcctcctccgttgctcacttcagacttgtgaattttgtcccaattcgtcgtttcaattctgagttcttggcccattcatacataagtctgattctcgacatcgtccgattgatcgatcgtctaatttgatgtcgattcccctccactttatggttattctctgcaaaaggttagtaaatctaatactagtggaatattattattctaactcaaatatgcattgcaaacataactagttctcctctattttgataatattgatggccgaaactgatcgctaacgaccgtcaacagccggtcagaccggggctcacccgacggtcagaccggccactacccgtcagtcagaccggcatttgtgcctcggtcagaccggccctggtcagaaagtctcaaatgaatataaatttagcaagtctaaatgcaaatgacctaatgtggcattttgatcatctctttgtctaggtcattacccctcttaatagtacggcaaagctataaataaactagcacaattttgatcgcccaacttctcgatcaatttaaaatttaaaacactagtttaccgtcttctttcctttgctttgcaccatcaaattttaatcctttggtaatcatccatgcacacatatcacgtggtcctaactcaaaatatataactcaatagaacggttagtccacaattagcgcttgttattaattaccaaaattaaccacgggggcctagattcttcatgactaggggccctcctccggcctctgctctagaccgccgccgtcctcctcaccaccttacgccggctgccgtcctcctcatcagccgccactgagatgggaacagaggcaaagcaggaagaaagagagaggggtgaagagatagagctgaagaggtctaacatgtgggcccacattgaatcattgcttttgacttgggtcaaattgccacatgggacaaaaccaccccactatgttgccatgggacctatattacaccggttttgacgcttgaaggactcgttgtatctggtatttcggttgaaggatgaaaattgaactcgctttcaagttaagggacctaaaatacacttattccattcaaaaatagtattgtactccctccgtctcaaaatacaagggatcctagtccatattcatagtattagtatgtgtcacatccaactcaaatctcttatattttgagatgaagaaagtaataggttactgctccattcgtctacaattaactatttgtgttctaaaataaagctcatgtcccttatctcgatcaatcacaatcattcttcttttaattttttatctactttctattatcaactaatcactactttctaattttcacatatttttttaatgtttgtgcctaacttaaaaaatactaacattttgtgacgggagatatgcgtatgtactattgttgttaatttttaacaaattttcaaaactatttagatagcatgtgagtaaataaatggacattccttgagagattaaaataggttctcaaacaacgattttaccctgtacatcaaaaaatatctcgattagtcgcaagaaagccactgaaatgcatcgatagaagttttgaattgctcaatgttggatccaaatgagtccaagttatttactttcttctctgttaacctgtatcgttacgtttgattggtgtaaatgtttggcgtgtcacatcgggtattatatagggtgttgcatggggtgtttgggcattaataaaaaaaagagtaaattacaccttagaccactttttcttgccattgttgcaatttggaccggggaaaaacaaacattttcactttaaaccacacatctttaccagttgattcagtttaggctagttattgttaccttgtacctcatgctgaccagctccctcttctcgaatgttctctccctccaaggccctctctttgtatctcttctcgtatcaccgaatcaagcgagcggtgagtcggtgaccccatcatgaattgtggcgctgtgaccaactcctattcgaggggttgatgccgtcggggtgaacaaagtactgtatcgcccccaatttgtccatggtttgaccctcatatatagggggatgatgcaggataagcctagccatggtgagagccatctcgtggctgttgcacaaatcggacgctatcgcgcatcacaatgatggtttccttgtagaggacatgctccaacaatatcacatcggctagattaaaacctccctggagttgccgcgctgagagcgttttgaggctgcgtgttcgattccgctgctatccacgtcgctacgcgccaccagccagacggcctgcccaagctccaatttcacgctgctctcggccgtcggatcgcgcgcgaaacgctgtgatgtgctggtatgttatgttaggcattaggcagtgtcccaacgattggtcgacacgtgagcctaggcccctacaactgctggttggttgctgcaccctgtgtggtttgcattagtccatgccatgtgggccctgtgtgtttgggtgctgtgcaacgagtgtatgcagggctgtggagtagggtagtggcctaaaatttcagcgtgttgcgtgacggtctagaagagtgtgcgtgcgtgggcacggtgcatgcgctgccgtagggtgcacggcgtatgacgagtgggtccacgcatcatctatcttcgtgagccaggtgtgcaattactcgacgcctagaaatccacgggtgtatcaaaagcagtgaacgggggtgtacgccactgcctcgttacgtgcggagcatccatggaccagtccgtggttctctgccgctgacatgtgggtccagttatggctctatgggctgcgctagatgcaccgtgaccatgcatccggttcttgcattgagacgtgggttctggaccgggtgaagagggagatcgtgcacacagccaaccatgagacaacacattggtacccatggctgtttgtactgtggaaggcttgtggtgcgctcggcgttgtgagctcggttcacagcattggtttccatgacaggtgggccatgtgcatgtgtcttgaggcggctatgctgtagacaaggtttatacagctaaaagtgatggatttgttgctttcgtgtgcttttagcagccgtggtgtgggtgagaagggagccagagctcttcttaatttgccagctgcttgtgtgttctccttgccgatcccttgcgctagccatcttccgcgaaaaatggccatcgtttggtgtgtgctgacgccttttgctaaatgtttcttgctacgatgtgttctttggaatgtgctcatctctgtcttctctactctgtaggggttttcggttttgttgtgttggtgtggttcttgctgcttgatttgtccgcctgagttagctgacaggatcttgcatgctctagaccaggtatgtcgctggatgtgattcttttagttcacttcggttgttgttacgattcttgatcttattcggtttttggttgtattggatagattttctctattggttccacatcccgcaacctcttctttgctccttgctgtgctgcttctgtctttgaaggtgaggtttgttgcttctgaggttctacattcgtagcctgcttatagcttcttggtttatttctttggtttgttttgcagctcacatttcttcgaagggatttcacgctgtcggctaggctgcgctacaaggtaaagacattgtttctttctgtgccttaccagtgcattgcttccttgcatttgtgtttgtctccgatggtttcttgtgtgcatgtctcctgatgtggtgctgctctatggacccagtttgtttctttgtccttgtgcatatttgttggttgtgctactatagtattatatatatatatatatatatatatatatatatatattaaatgcacagtatatgctccttgctgtgttggtgcgtgtgtgccggtagagcgagaagagtgttggctacaatcttccttctggtcttggcctaccactttctctcttcttaaagccttctagccgttgtgcctgcctcatccttttgtgtcgctctcctctctttgtgctcctcttctctttctctgaaactttcccctgcttactttccttcttttcccgttggtagtattgtaggcaacatgttcgctatcggagtgtcacacgtatctctgctaaatgccgctgctcagcactgcatgctacctagtcttgcctacttgtgggagttcagctttgatggtacgttgttggctggagttgaggtcagcgttccatcagtgtgccactccgatggtttggaaactatgtttttctgggacatggcctcagctccgcttgggactgcacatgaactggtcgctgagcgagcattgaggtacctccagcatcgatatggctttttagtgcacgattacaatttaaactcaatgttggcttacagaagaattgcacagaccgctatacaggttgctttgtcagcctcaggttgtattgcgcattttaggtcctcttatggcccactggcgccgtgttgtgaggatgttcttagaacatgtagctcattgtattttagtttccatgtagaagacatggagcaaatgggttcttttccaatgtaggggaacatgggtttctggggttctgtgtggtttcttgccccattgtaatcctatttgttgtttcttattgttgctttctgttgtgctcatcctacttggtaataatggaatgttcttttttgtacaaatttttggtggttgtataggcattttgtgtgcatgtccaaaagatctgctgatagagtgtccagggtccgtgcaagtcgtgaaaggcgcaatgcacgtaccttggccccccccccccccccaacttgcttgcaaaatgaacttcccctaccaggtgggacaaagagaacacgttcccttatggattttaagcccgctttggcagctttcaataggcaatgacggcgtttgcttttaggaaggagttcttccttagtttcagatgaggacagtgcacatggtatattagctttctcatgggtttatataattatgtgtaatgttgattgtttttctgatagtttagatttggtgcagctagcagtgggtttcatagaggtagttcttcgcggtcacacaaggatcatgctgaggctttaaagggtttgtacatgttcagtccatatatagttggcagttttttaagataagcttatggtagaaatatttggttttctttgtagcatcataccctaggaggtcttattatggtgcaccaacatacgagtgcccatactgtggtgccgtgttttggtaccaggagagagttaagggcgcttctgctatttcaaaacgaaagatagtttacaataagtgttgcaaaagtggtaaaatacagttgcccaaactatgtaaaccccctgagcctcttgctacactgctaaaatttaatggcgatgcacgctcaaaaagattccttaggcagatacggtccgacaactctatgtttgcttttacttcaatgggtgcagctgttgataaatcaattaacactggaaattcaccttatgtcttcaaaattaacggtgttgttcatcacagaattggtacacttttaccgtcacatggaaagcaacctaaattcgcacaactctatatcttgacccagaaaatgagacacaaaatcgaatgaacatatatgaaaatgatggtagtaacgctgatcaagctgagcctgttgtagttgatgctctctgcactatgctagattgtcataatacacttgtgcaaaaatttcgctacgcta

SEQ ID NO: 13952 - DNA, 803 bp, Oryza sativa
gaactatcaagatgcaatggcgttatgtcgtgtttatgggtctcctgatttatttgtcacattcacgtgcaactcaaagtggcaagaaatagttgaatcaatacgatttgaagatggccagctgccatctgatagagctgacatgattgttagggtattcaatatgaaagttcatgattttattactgacatcagggagggtaagacatttgggcctgtgcttgcaggtaatgatgcctattgcaatgtttctacagttagttgtgtagtatagtgtgattacaccctcctaattaaacttggtatttttttttgtcttagttctctacactgttgagttccagaaatgtggtttgccgcacatacactgcttagtatggcttgctgctagcagtgctcaagtatcagtagctgttatagatggatttatcttagctgagataccagactttgaaaccgatgaattaggttatgagtcggtaagcgagttcatgatgcatggtccctgcggtgagcataacaaacaatgtccttgcatgaaaaatggcaaatgttcaaagcactttcctaaagattttcatgatgaaacatttgttgatgaatatggttttacaatctataggcgcagaaatgatgggcgatatatcacaaaaaatggtgtgcgtctagataacagatcagttgtcccatataacattggtttgcttaaaacataccaggcacatataaatgttgagtggtgtaataaatccaacatgattaaatatcgttttaagtatgtgatgaaagtccatgatcgatca

SEQ ID NO: 13953 - DNA, 8952 bp, Oryza sativa
tacaatcatgattatttcttcttttctgatgttaacagttggagctgaagttgaccatggcaagatggagttactcttgtctcaactggctggtaaggatatcactgagattattgcttccggtcgggagaagtttgcttctgttccatgtggcggaggtggcgtatctgttgcagcagctgctccggctgctggtggtggagctgctcctcaatctgaggctaagaaagaagagaaggtggaggagaaagaagaatctgatgatgtaagatacattgctctatgcttgagttcatggtatcctgttgatcagcatgagtttcttcgaattgcttgttcatctattttatttgcactatacactgcagtagtattccttttgggttttctatatacgcgatcaaatcatgtcatgaaattggaatggtacatacttgtatcagttttcatctatagataattttactcccatcaatgtctaggctgcatcgtgccattccattatgatggtagtacttgtttccatatagtatactttccagcatacgtatcatattgtttttggcatggtactagcatctgacggattgatgactgattatttctttttaatcttgtgtgtgcaggacatgggcttcagtttgtttgactaggaccattccttggattatacccatttttggttaacttgggaaacggcaacctaaacacgctttttgaattactccattttgttctataacaattcagatgcaggatattgcactgatgactatctgtcgaaccatagatttgttagaaggtttcattaccaatgatttgtttcagcaaaatcagcaccgaccatgatatgttgagtttatatgcttccctcgctgctctttactactgaagaattcacgtttttagttgccatgtttagcaaatgcttatatgatatctggagtagtttccgtttgtgcacaaatgacgggtgaatttagcaaattattccgttctatgcctagatacatgcggagcctgcgtgtgctgctttcgtcaaattggactgtggtcagccaacgttgtctgacctgaagcagatgcaatgggattggaatttctgccgtaaacagctgcgcctacggcgatggaattcccaccgtagttgatcatccaacggaaagaggaacaagttgctgttgctagttgaaacttgaaagattgtaagaaagctccaagaccgcaaggagaggtgtactgtcgtttactcgtggttgaacgtctgcagtagatgcaaacgatgatacgagtttggatttcagacattgcgagtttggtttaggaatatatggcatgagaggtagaatattttcccgaattaaaaaggtcccctccaaatgggttattccctccaacacaaaatatatatatagcaacatcttaccatttctttttaagaaacactctataaaggtaggcttccacaatgcgcatacactcgtctctataaatacgcacacgcataccatcacctccggtacccctatgatcacctccgaaaaactgggcatcttatatatttttaccaatctattggtaatgctaaatttggaggcgctatatatttttttggtagagtagaatagtatcaattgtattgatatcgcaaaaattggaagtgatccaaacatatgaaatacggtattcgaaaattaccaaatatttggtagagtaagttttgacgtcagaccaaagcagtttctaatacttcccctgtcctaaaatataactatctttaagcggatgcgacacatcgtagtactatgaatctagacatgcatttgtctatattcgtaatactaggatgtatcccatctatttaaagctggttatattttgggacatgtgtagtattagataagatataacctggtatgttcagaatcatagtactgtggttttattcagatccatagtattaggttgtgtctaatctctgtccagattcataacatatttgtctatattcatgctattagattatgtccaatatggatatttactgggttgtgtctcatttttactaattttttttagtacagagggattagtattatttccatttgttaccttagcgaacggcacccctgtaaacgctcgatttttaggcaccgacgagcgctcgccactcgcgggagggcaaaccgcacgttccgcaattaattccgttccgaatcccgagccctctcactaaacacacctaaaacaccaactccgttctcggcaattcagcatcagtcaagtccaaaaacagacgacacccacacacacccggagagcgagcgagcgcgtgcgcaccgcacggcccaggaaacaggaaacgcggcctggctggctgcgacaccgcgccggccgaaccgccgaagccgaagccacccagggagggattcagccgcgcgagtcaacggccgacagccctctgccccagaagccaacaataacgggagaaaagaaaaaaaattgagccgcggaaggccggaaggggactccccgtcgcctcctctcctccaaatcccaacccacctcaccgatcccatctcaattctcaccgcctcaccgcgcccgcgccagcgcctcgcccatgtgatgtgagtgagccactcacactccccctctctatcgccgcgcccccgattcgcgagccgccccgatccctcccgcgcggctgataaatccgaggcggctagggttgggggtggaatggggcaggaagggatggggtacaacaacggcaaggggggaggaggcggtggcggcggtctaccgatgacggcgccgcggccgcgtggggcgtcgccgttgagcagccacggccaccaccaccgctcgcgcaagatccaccgcaccttcaacaacgtcaagatcaccgtgctctgcggcctcgtcaccatcctcgtcctccgcggcaccatcggcctcaacctctccctccccaaccagcccaccgacgccgacgcgctcgccggcgccaaggccgtcgaggacatcgaccgcatcctccgcgagatccgctccgacggcggcgccgacgacgacgccgccgccgccggggacctcgccggctccttcaacgccaccgcgctcaacgccacggaggcggcggcggcctacgcctccgctgtcgaacgctacgcgctcggccccaagatctccgactgggacggtcagcgccgccgctggctcaggcagaaccctgggttcccgtccaccgtcgccggcggcaagcccaggatcctgctcgtcacgggctcgcagccggggccctgcgacaacccgctcggcgaccactacctgctcaagaccaccaagaacaagatcgactactgccgcctccacggcatcgagatcgtccacaacctcgcccacctcgacaccgagctcgccgggtactgggccaagctgcctctgctccgccgcctcatgctctcccacccggaggtcgagtggatctggtggatggacagcgacgcgctcttcaccgacatggctttcgagctgcccctctcgcgctaccaagaccgcaacctcatcatccatggataccaggatctcctctttgagaagcactcatggatcgcgctcaacaccggcagcttcctcttccggaattgccagtggtcgcttgatcttcttgatgcgtgggcgcctatgggtcccaagggattcatccgagatgaagccgggaagatacttactgccaacctcaagggacgcccggcatttgaggctgatgatcagtctgctttgatttacctcttgctctcgcaaaaggagaagtggatgaacaaggtgttcatagagaattcgtactacttacatggcttctgggctggtctagtagataagtacgaggagatgatggagaaccaccatccggggctcggggatgagcggtggccattcgtgactcattttgtcgggtgcaagccatgtggaagctatggggattatcctgtggagcggtgtctcaggagtatggagcgagcatttaattttgccgataaccaggtgctgcggctctatgggtttgctcacaaggggctcgaaagccccaagatcaagagggtcaggaatcagaccacaaagcctattgatgacaaggagaatcttgatgtgaaggccaagatatcgaccacttcttgaaaagtcctgatgagagttggtatggcaatagcatacttgctttggctctcttcaaggtcagagcattttgtgacttggggatggtgttgttttattttccactctttttttctattctttttgttcatggaattgttattgttatgtaacagttagaggttgcaatctaatgtttatcatggagttaaatgtgataggggctcaaatcagcagaaatagacttgccttttatactgcgttacatctcaatgctactatgctagcttctagtgcaacaagcatatactgatttcgtacgtggtggtggcttgagtttatctatctcatcttcaatgctatatttaagtgaagatatgaagtaaaattttagtatggctaactgaagaaaaatatgattctaaaacttgacaggaggctaggaactcaggtcagaaggaagtagcctcaccttgtgtattgcattgcacttcaatgctagctttctagttcaaccagcatcaccaatatactgattttgtactggtttttgcttgagttcatcacttcatctatctttaaaccatagtgcatttaagtgaggatatgaagcaaaacatattgcatggctaatttgaaatgtataacattcaaataagttatacgcagaactttatatctcacatttgcaatttagttggtttagtgaggaaaaaaaagaagacatattccattgttatggaacttgcattaccaaagagtaactaccaatggaaatataatattttataattcgtacttgttttttaatagatatacaagaaaatatagcatggtgttgttgtttttttttttttactgattttgctcaagtgccacgttttttttctgcctgacgcatcattcccataagtcctaaaaccatggttttgacttttaagcaggaaagtgtggcatcttagttttatttatggatctgatgtctctggtgtattattattgtacaaaattacttaacagtgatggttcattcatacctggttagtgaattatcaagcttttgggtttcccccaaactttcagaggtatgctaccggtttggtttcctctcgatttgccaattcattgtgttgcgtacatctatgtccaatctatgatcctggagtttacttttttttaggcatctggatattttatctcccttaaattgttcaaaactggctagctgttaggaaattacttgttctgactgctaaaaatcaggcttcactctttttgtcattttgttttaaattatgatgcagatggaattaatccgagttgatgaaatgcgtcccaacatttcttaatgtaaaacttaaggctgggaattccaatagttgccattattttccggagctcttgagaaaaacaatcaagaatctagagttgataccctttgaattgcataatgtccattttctgtctggaccatataagtgcaagttgttatgtaacaggcatactgcttactctgagttgcttatattcttcatgtactctctgtatcagttgctgctgttctagtgctttagctcttgctaatgctgggaacaacaaattgcttgccttggagttgggtcatctcagtaatgcccctgttttaaaaatctcagtccatttttgttcttgtaacttttggtgaaagcctcattactgctgctgtggtatgttactcagttcatgcatctagttaatcttgcgactagacagtgctctgtgcagaaaaacaatttaagatgctttcagcattattctggcctcctatgaattttatcaaactcttctggagttctacttgttttggcccctggaatagtggaattgctggctccctcaggcctgagcggtgcctgctatgtacctgtttttttttttagatgggttaataatttaatcaacccaagatgctgatttgatcatggacagcaagcaagtcaacggtccaactaaaccactgatcaatatttactaattcgctaattatgctagctcaggatctgatcatgcaaagcagctatttctagctggagacttcagctgtgatttgttcgatttgggttaggctgtgtttagttcagcgcaaagtttggattttggttgaaattagagatgatgtgactgaaaagttgtgtgtgtatgacaggttgatgtgatggaaaatgactgaagtttagatccaaattttgatctaaacacagccttaattcgactgctgctagatactcgatgtcatggagatttgggacatggatctcaagaaactgccagcaacgatctgagaagaagacccgagcatgtgcatcatctgtcctatgaaagccaaaacgcccccatacaaaagggttttgaatctccaatcaaaattcagaatccgagaggtcaacatccggtcaaacttttcaaacattaactgtattttaaaatgcttagtttgaaaacataaaaatgatgtaaatatatttgtcttgaaaaaggcttccataatctataaacttgttaggttttatgaacttaatctaacagaaaaaatatggtcaaaatcgcatctcaaaaaccataaagaaaaggtaaatctcatatttttagcagagacaatactttgggttcttttttcctgaagatgaagattaagttttttactcaaaacgaggtggcattaatatacgattgattgagttttaattattacaaacttgaaaaataggttaatatgatattttagagcaactttcatataaatatttttcgcacgaaacacaccgttttgcagtttgaaaagcgtgctacgaaaatcttaatcttcatccaactcttatttgacgcacatgcctagattcattaacatctatatgaatatgggcaatgctagaaagtcttataatctgaaatggaggtagtagtatcttattaatagtaggtaggagtaggagcttcaggatattgatggataacattcagttgaattaaactgtttatttatacaccattggttagccggtaagcagtgatagacgtctgtttacaagtaatcatctgatataatcccttcgtttctaaatatttgacgccgttgactttttaaaatttgtttgaccgtttgtcttattaaaaaaatttaagtaattattaattattttcctatcatttaatttattgttaaatatatttatatgtatacatatagttttacatatttcacaaaagtttttgaataagacgaacggtcaaacacgtgctaaaaagtaaacaatattaaatatttaaaaacggatggagtataatatggcctacaccaacataaactaactgtttgcacaaaatatttgaatgagatgaatggttaaacggatatgaaaaagtcaagacgtcgtctatctattatattattaaaacagctttgaaagaagacaccacgttcgctgtgggggctagaaattcccacattaatcggagaaaaagaaaagaagagtccaagtagaaatacaatttaaaaattgcttgaaattcgaaattaaaaataagcaatattgaaagaagagtccatataagaacccaatacgagattaatcaaattcagaataaaaataaaataaaatctaaaattagaaaagaaaaggagagtctaagtagcaatataatttaaaataactgaaattcgaaattaaaaataagaaatattgagagaacagtccatatagtaacccaatacgagattaattaatattcggaataaatataaaaataaatctgaaattagtaaaaaggaaagaagagttcaagtaagaatacaattttaaattaactgaaattcggaattaaaaataagcaatattgaaagaagaatcgatgtaagaaacccaatacgagattaattaaaatttaaaataaaaaataaaataatatccaaaattagaaaaattaaaagagagttcaagtaggatacaattttgaaataactgaaattcaaaaataaaaaataaaaatattaaaagaacactatacggtattaattaaaatttgaaaaaaaaattctaaaattagaaaaagaaaaaagtatttccgttaggaatataatttataaataactaaaaatggtgataaaaaataaagactattggaaaaaaagaccatctaaaacacatgacgagataaattaagtaattataaaggagtagagtagtggcagttgatacgacatataaaaactgttaataaaacaccaattagaatcctaataacgattaaaaggtggggcgacaggcaggccgtgaaagcaaacggacaatgcggttgccgggacctagaaagtaaagaaaatagacctcattgataatcatatccgacttttaaaatctcaatgacaataaaaaggagaagcagcgggcggggtgtatagtagtatagttgcagagccgccgacggttggcgggacttctaaaaaataaaaaatgaattcgaacgatagttgtgttcgattttggaatcccaatgataataaagagtaggcggtggatgggccgtagaggagtatagcagcatcgtttgacgggacttctaaaaattataaaaaataaaacctaacaagacaataaactctaaaaactacaaggcccaatttttaaaggttccgaacttctaaaatcatgtttgattttaaaatgtcaattacaataaaaaagggaggcagcatgcgagccatgaaggagtacaattgtaaagccgctgacggtttggtgggacttctagaat

SEQ ID NO: 13954 - DNA, 9129 bp, Oryza sativa
aaataaaaaggatatgacggaagtaaggggtagcagctgatatgacttttgaaaactatataattagaaatacggggatgataaggtttggtctttcaaagttttaagacaacgagatagctatttaataaattttaagtaaaatcatactgaaaaatatatgatttagtttgggggctagccacgcaattgcgcgggccacccagctagttattataaaaccgaaaaagcggtgagagtattcgtattagttcaagtaacactcttttctttttttttacataagttcaagtaacactcttgaggatattacttgtctattaaaatcttatgcaagattgcagtattctctaatttcttccaaaggtaattccgttgaggatatagaaatgccttttattgtcctggaggctggagaacatacactgaagaacttcagtaagacagcatcttttgatgtcaacaatatgtaatttctctttctcatatatgtacatacagtatacaactttgatcgtcaagaaaacagccatcgtgaaaattaagaaacagaaaaaatatatatgcccccggtaatacaaaacaaaacccagttaattgataagcagaagctgtgccagcgaggacgactcttttaacattttccccaatgcactgcagatcaaggcaattaggcaaagctgatcgtcccatgtttccagcctacttctcgattagcttgcgtgcacgttggtttgctcctttcaccctcgagttgagttcatccacatcgccttgcagatcatccagcgctttgttttgcctgaaatgtatgttggttaacatagtgaaactccatttgaaaccactagcagaacaggagtattatcctatcttgaactattaggtgttgggtgttacaggtgttttggttgctttgttattatcaggggtttagtgtagctttggggaatgatctttatgcttataggatagtgtttttagtgtgaatcttttcttaagtctatgtgtatcttttctttatcaataaaatgaggcagagcttctgcctttgtgttcttgaaaaaaatatatatttcaccggtaaaaaaaaaatctgtctttttctgaataaattaaggagttaactcacctatcaagctctgaacccatgtcacaagccatgcccttgagctgcccaagcacaccactgagatcatctagggcatcatcctgcttttgtttctccacctgcaaaaccaaaaagaattgaagataatggatgctagctatgctagacaaatctctgattttttttattttttttgcgatggcggcagagagatcgagattaaacctgaactttctccatggcggtggtaggctcggcgtagctgcgattagccgacttcccactagggctcagccctagcttctccctctgctcgatgtggctcgccttctttttgaaggaatcatctgaaacatatcatatcgccatttatatgccaaagaacagtgagagcacatgatcgaactgggaattgaatttttcgatgcagatatatgtttgagttcgtacccgagacatgggctggacccttgatctgccttgttttcttgggcttccatggcttggagaagaaccctccaaggctccccagaagcgactcgccctatacacaagagcaaagccatcatcaaaaccatcatacattctcacatgaaatcctcaactttggcacgacattggcaatgctaactgaattttgtcaggaatcaagacggcaatgcattatacttctcactccgtttcatattataatcgtttgactttggtttcaaatttttttaagtttgactaaacttatagaaaaatatagtagcatatctaaaatatcaaattagtttcattaaatctaacattgaatatattttcataatatgtttgttttgcgttaaaaatactactatatttttcaacaaacttgatcaaactttaaaaattaagtttgattaagaaaaaaatcaaacgacttataatatgaaacggatgaagtacatagcatgatcattttttcagaagggaaaaaaagattcaaaatcaagctattgaccttggagaggtcctggtcgatttcgacggccttctcgtgggtgcggctgatctgctggccctgcttgttgagggtgacgagcgtgttggcggcgtcctccctgatgttctcggcgatgcggaggcagccgcccagcgcgtcggtcgtctcctcggccttgtacgccgcgtagttctccagctcctgcaccgactgctgctccagcccgcccgagtcgcggaagtcgtccttgtaccgcgccttcgccgcgccgctgggcgccgtgtacgcccccggcttcttcttcgggaccaggtccgagtccgagtccgagtcgaaggggtcggccttcgacgaagcggccttgccgccacgtgacaccggcatcttaatttgccgttaactcgctaattataatccctagggttcctgcaaaaccaaacagcccatgcatgtcacactgcaaatttgcaaaaaaaaaaaaaagactccaaagatgaagaaattttcccatacaaaaaaaatggataaaattaaagaggaaggaaccatcacagcacgaacgattaaacaaagcaaatacatgaactgctggagatattaattacaagacgagaaattggcatgagagatcggccaaattaaacctgcagtaattctttttgtattgtttggccctccctttctccctgatcctcctccccctggagggcaaaagagaggcaatagatctccctttattagaaactgaacttctttttagcaatgcaaatccttctctcttatatagtggcctcgtttaccaaacgaggtgttatttttgggaaactctcatggtccatcggtgctggagacacgactatattcgggggttttagaaagaacgtgcttctttaatttatcacatgctaattaattagtccaattaatgacgtgcaagaatgtaggcgacaataagattgtgagcatgcattttcaagatatagcggagcaaaagattgcattcttaagagtataagttgatgccgattttatgcagagaaggtactactgtccatgattatgtttactcgtggtatccttaacttgagcttagcaaatattcaggggtagatatagctgatttagaacattctattaactcatggttgcatgcatgggtggtgctggaccagactacctgagcatgagaagtgtgctggtgtcaactggttacgtttcttatggtaaaaacatcttcttctaagttcaagttttagatttcacgagcgctcacattaatttaagatactaggtgaaaccccgcgcattgctgtgagaatttagtatgataataataaaaaaaataatgtgtaagatagctagataatatcatattaagtagattaatgtggttcatgataatttaaatctaaatagtgtgtagaatggtgattcaaacgtaaaaaagtaaggtggtatgactttatggaagaagaaaagtagggagatagtttggaccgtagattaatcatctaaagactaaaaacaattgatgtgatatgatttaattagaggaaaaaaggagaaagataatttgtaccatagattaatcatttaagcactaactaagtgaggatgaactatatgagtatataggatatcataaaacataataaagatatacattgaaacattatgtgaattatgttgggtgataatttaacatgtttgtatttgaaaagctcttaaattataaaaactataaagatatagcatgtttgcatgatgtttaaatgtgatgattgttagtggatgatgatgtggcatcttgttaattagtggagatgatgtggtatcttattagtggatgatgatgtgtcatctttgcatgttaagcctaaggagttagtggaggataactttatactaggatagaatacccatcgatattgaggcatctgtggtgacttcgctaatctcaagatatatcggctcactctttcggatgcatgtgctcattgagataggttgtttgtatgtatgttcgtagagatgagtgtgtgtgttgtaagtatatgtgtttatagtgcgtttatataaaaggaattgtgttattgtgtttcatctatgatgagaaacggaatttctggaaaattctctggttatttgatcatatattaccatgtataactaatgtcttgtgtattgtttttcttgccaaaatgtgaaagaaaaaggtttccaaagcttgaactgttaacgagacaagtattacgatttcattctgttgtccaaaaataggtactcctttgaatgatagaatttattcccgcctttgctttatccagaaaatacgtataaatagaagtggtgagaatactaactaggttaaggttcaaatgtggggcatcggagtctcggagatcttctcttgtatagtctctcattttcaccagcgccggatccttggcaatatactctcactttaacagtaagttgttttttttaaaacattttggaacctcaaccctattgcaatattaggtactgcaaagatactcccataggctttggaatcagtgtgtagaaattcataacatcagtatccattcagctacccagatcgaacttgggcggaatctcagtcccaactatagtgattccgacaatttaaaacactatccatcaccgtcagcaaaacaagcatataactgtaagtcaatagtatgggatcatactgcttggcacagaatttgtcatgtcaaatggagtatatggtaaactacaagaggcaagtctagtgtacaaaaattgatgaaagggatacaattgagaaatgcccaggcaagtgctttcttgcaaaagccagatgcatctacaataacagcatccaacagcaggcatctctccgtccaaacatatcctttcgtgtatatatacaggaagatatttcctataacttaaatgctaacttaaagaaccaagtgatggatcttttgcttcaagaactcatacaatgaatgtcttctttaacactttcttgcctcttttcctgtttgtgctcaaagcattaagaatttctgaatcctcgtcgttcgaaagaattctagcagcatcaggtttgtccagcagttgcttggccacaaggtacccagcaatagaccaggtttggtaaagacgagactgtttcccaatgaagcgtgctcgtttggtgtcatagtattcaggccatttgtcgatagcaattcgcctctcagctacctctacagcttttgcagcaatctctggtctgttcatcttgatagatgctactgtgagctgcacgcaaagaaagtaatttctcagcaactatatgttgagcaaacaaatcatagtgaattgtcaattgttactacaaactgtctgcatcaggtaaaaacaaagtcagcaatttcaaccacaaaaaaaaaaaactttgttacagaataacgaacctgccataacaatgttggccaggatcctccattatgatatgaccaaggcctgaatcaatagatattactaagaagatgctcattggaacttgaacatgtacatagatgcaaagataattattccgaaaactcacgtattctttgggtcacttccagtaatgatcttccattcctggttctctagagcaggatagcatatcttcaatggcatctctgccactaaatcagaccatttggattcaatcagatccaaaatggcatgggattgatgagttgttgccaagctgcttactatggaccataaattccccagagaaaagaaccggaagtccatgtgagctggctgcaggttcccaatgaagtaacctcctttaggaggtatccactcaacaagccacggagaaacctgatcaggatatatgttgaacttgttcacagcatcataggaatattcttctgttttatatcgataaatctcattcagcttctgcatgtcaacccaatagtactctctaatatgaaaggacagtgcgataagcctattgtttagagcacgtattaaatcagctgatccatcttctggggttaacatttcacgcgcgcacaggagagctgaatagaacagtgcctacataaaacaatatttacgtgagtttgctttatcacaaaagagaagctgtaatgaaaaatacaggaatactcaatgtcagcccctttttttgaaaaatattattatagcccttaccttgtaaagttacgtctgaatataaaatgtaagtgaggccttggattaaggtgatgaatgtattcagttcacttaaactaggataaggcagaggaaagttattaggagcatcagcaggagaagcaggccatcctcttcatcattgatgctgattattcaatgtgcacacctatgaactaacattgttgaggacgacatcacagttattcctatcatcttgttgcattcaaactttttcaagattgactttggtccttatatcttattacgaaacttaaatagaaaatatactctattgcaacagaaatttactatggctaattgcaattgtttttaattttgatcgtgagaaacttgtaggaagtgtccaatttcaaaagtttatatttgttaatcatccaaataactaccttagctgaaatttctgatatgccaacagtaacccagattaattagtactcatacctcactgccatgtgggtgacacatgatacagcaggaactgaacaagaaaattacatgtttccatatagtttttgcaaatcattgaaatggaaatactggaattggaaaattaaatgaaaaaaaaactatataaatcttctgtgtgttaaaagttagatattatgatgttacaagatttttctaattgatgaatcttgcttcagttttaaaattaagttccttgctctacatgctcctgactttaaacttctatcatttccatgcccattttgtgagttgactgttaagtggctatgaaaatgaccattttgtgcgttttgagtcaagtcagctttcagttatcttagcgagccactttcatatggagatcgctgaaaaaactcaggggattggaaaagataggtttaacttttgagggtacacatgcttttgattgaatgggataaaatccattcacaaaagacacagaattgacaggagtatcgtaaaaaacctgaatttcaagtggatgcccatgaattcccattcgacgatcaatcatgcatgatccatcagttaccagtaatgtagggaacatgtcaaacccatcagctaaacaaagctttaatatcattttaattccagtctgaacatcaattctctcctgaactgtcagatctcctgaacactttccatacgccctaagtaatatgatccaccatagacctgaaaccatcaatcacatatccagttaagagttagtagaagcagagtagcaaaaaagaggatgtgctagctatctccattagtagctctacctgaatcaacaggtgccacacggcctattgctgcctccccaaaatcaggatccaagacctcctcagttgcatcttcatctccatcgagtggaattgttcgcaccttgaagctagcaggcattaagccctgtcctggactatggcagtccattgtcttctcccagctctacataacaaaatgacagcagaacttgttacaccttggatagggcatacaaattcattttgttgctacggtaactagaagagatatttgccaagaactttaaggatggcaatctcagtaagccaacacatttaagatgtgtaattgtatcattgtgcatcgacttttacatgagaaagcaagcacacagccaactttctgtcaacaattttatgtggaccaaagcagctcataagaaacaggccttaccatcgtgcgcacttcctcaagagatcaagctattatatgtctaaagaaaaaaacctagagcaacatattcagatggtcacaacatgaattgaaattatcaaagctggctcatgtgaaataattttattaccggaatgttcatttacactgtcacgatcaatacaaggcctggatctaaaacacgatgcaacaatgaggaagcaacgaagcaagtacctgaagctgaagggtgtgcaaaatgaaattgcgcacaatttcgtactctcccttcaatagaaacgcgatgccagatggtatgaaatcccgaataaacacctgatcataattcatcggattggcatcattcgggtcgttggcagcaatcgtcccgaccggactaccacaatagtaaaccacggactcccgcaagagctcccaagcttcatcctccacagaagacgccttccgccgctggggcggaggcttggcggcgctcccgtttacgctcccattgccacctacagcctgaccaggcaccctcacatcaccgagagcatggcttgccttgtccaccgcatccttaacccacgccccgttcccttccgtgaccctcgcaaggtcatcgatgcgctggcactggcactccacggcggcccgcagccccggaaacctgaccggaccttggagcgccctggagctgtgcaacgaattggcgctcctcctcctcctgcccctcgcggcgtcggccgcgaggggcaaattggatgccggggagtgggcggcgaatgcccccggcatactgtggagggccacctccgcaatccccattgccaccgtgctcccaactcaaatgggtgactgcaagaagcaccgcgcacggccatgtgttagataaaagctaacaaccaccagaaacgaagatcccaaaccgaaacgaattccgcgataatcgaaagaaaaaaaaaccaaacccaaattccatgttcgctacgctcagcatggcaagaacagccgcgcgcgagggatcacatgaacaagtggcgcaaatgattaacgcgaggaggagaggaggcggggggggggggagcaactcaccggccggaccgccacggtacgttgggaagcgcgagtggccaccggttcgacggagaaggcggacgctaagggccggggggagggggactgggtggagtggcct

SEQ ID NO: 13955 - DNA, 13020 bp, Oryza sativa
  unsure (1)..(13020): unsure at all n locations
gggaagaggagagaaaggaaaggagaggaaaggaaaagaatagggaggagaggaagacgaaggaaggggataaaacgaagaccggagacgaaacgggggaggcctggccgcccggggcctcaacgccaaccatcccatctctcgcaagtctcgccacgcatcctattttccgtttttcacatctcctttcttcttttctttcctttttttttttacacatgcgtagtaggaatcttttcgagttcaacgcgaacacgcaccggcaacaacaaatatcccaaggtccgaaatcgcatcgtttgaattttgtgacgtataggcaggtttcttttttctttgagtttttcatccactttgatgattattctcaaatgtcattctctcaagtgacttctgatcatttgtcatccgaatccaccgagtcgtttctattctattgtttttggctaacatctaataataagagtgatgaataatctctccacccctaaactctcctcaccccttctctcctgtctttatcttcatctcatcgctcggacttaagaatagcagccgaagagggtggcgttgagctcgaagaagcaatcgttggaggagaatcagggttcgtatcgctactaggagtgcagcgtcgagcaagtccagcgtgtcgagtagcaacatgaggaggtgtgagtaggacgcgatgtttgggaggaagttgtgcttgtggaggagaccgaggagctatagagtgacgggtgggacgcaacacggcaacggacacggcaaagggagttgagtagtggcggtgacggcaggttgcagagcaatggtgggaaggacagcagtagcgagtgtaggagcaagcgtctggggacgaagaacgagtgacaaccaaaggttgagctggaagtacaggcggtggtagtggaggaaaggaagcaatgcgaaagagagcggcattaacgtgttgctggcacgtaagctcgtcggagttagtcggctggatcctggaggatagtagaaagggggaaggaggaaggggaagaaaagggtaatttgatcctaataaattagaaaatgttgtgaagggtatgcagtggtatatatgtaataattgtaaaatcgtaatggcatggttgtaaataggtcaatagtgatggtatatttctaaaccacgaaatttattatggcacgaatccaattaatcctattattgtcgacgtttgatgtcgcaattctggtatttgcatagtatggggatcgtcggtgctaggatatacgcgagaatgaggtaaaagagacggagacagggatttttatacaggttcgggctctcgaattgtcaggtaataaccctacatcctattggccgaagccggtattgctcttattcatgataatcacaccagtacaatatttggggtagcctatctaactgttgtcgacatagcagtctgacgatctgactcgtagtcgacaacaaggtaaccttccacctcgaatccgtgcccgacgagatcagagatagcgctttcgtctctcctgacagtatccggagacaccgtagggtactagccgtgcttatccctgaagtcgatatccggcggcgtgtcttggcatatgtaggcttctatgttgtggcttctatgtcgattgtgttgggtgttgatcctccccctctcctcctaggggagcttgtatttatacccataggtgtccccttgtccaggtagaactagggaaaccaatatggatacaatccgagtagtccttgtcgtttccacgtagaactctggttgtctttccttatccggaactcctcctatatccgcaggttatttccgtataggacatggtatgtggtgggtcatgccgagatttagtcaactactattaggtatgtggtatccataaccctgacaattatatatgcccttttatggaatcaaattatcaaaaagaaccataatttcagcaggactccatgttgcttggtcccttacatcgctcctaagtggctaaatgggtggcaacctagggcaccacgccacctcccccacagtcctccctttcctcctcaccgtcgtcggagttggacactgaaaattgagcaacggcaagaatggcggtagtagggcttcctcccttccccggtgccctaggactagcatggtgaggatagggagtggatctagcgtgcgtgagaaggtcaaccgcctaggtacatggcggtggcgtaggctagaggtggtggcaacgactaaggtgtgtgcatccagaggcgaggggatagttggatctagttttcctaggccaaatatggtcaaggaaaccagatctggcaatgttgaccatctctatgcgtcaggtgtggcagcgatgggggcgaaagtggcacaagtatggctatgtaggcgtggtaaggtggcggtgcaggtggcgtcgacacaaggtggctgcggaggagtggaactggagtagggtggagtcggcatggacacatggttggcaggtggggcacggtcatagacatagctggcagagagctggagaggcaacatgaagaggttgcatggagagataagaggggcgcttggagaagacaccgtagaagggtgactcggatgcgcacgattgctggtgcttcttgttgggcgaaaggccaagtagtggctcaagcaatgaggacacggtaagcaatggcatggacaacggcttggatgatggctagcaagtttcttttgatagattggaccacttttaccctccttggagctcctcctctctaatggtcggtctacttccggactctggtcacggggagctccatggtgatgtttggtctggcttgaggtattatgcttggtggaggatgagtagatgttagcatcgacaatgctttgaaaggtcttgtggtagcgagctaacccatttggtggagatgcggtgcacgaggcttccatggctcaaccatgcattggtgtgttagagtagagtcagttatttagctgagtgtggcaagctcgacaatgataaccctcaattattctagttttggggacgctaagaagttgcggtgcaagtggtttcttcggtggctgtgcactgacttgttatggtggagtcggagctacttaccggggatggcaatgacaagtaacaataaccttcaactacttttatcttggcaatggttgtcaagatctgtagtaggcatgtagtaggagttttggccaaaaaccttgcttagtctaggactggtgtcgacgatgtcaacgtctatgggcatcgtttcccttctcaaagtcgttatttttttgcttttcacttttctttaggtgaaaatttagttccggtgttcagacgggctttgtaagtatcttagaagatactttcctcctcggagtgttcgcccaaaaagccctgcctcgtgtgttcgggtttttaagactgttgttcgttatgaaaagttggagctacttgtttagctaggcaatgatgacttgttctctgcatgggtttttgtcggtttttctcgattaaccgtgtgggtataagatttttgagcctagtgctcctcataaactgagcaagtctctttttcttaatgaacacatgaacttcctaacctcttttgaggttttccttaaaaaaatatatagtcaaattattgattattagctgttaatcattgaacatataagccactatacgatttgtttatatgtataaataacgtgaaaagaacatacagatcagtcatctaaatttctgtttaagcgcttagatagtacaaaaatgacaggaaaaacaaaagaatgaccccaggcactactagaaaaagcattttcgctgatgttgggtatttattttcgcaggtggacatgaccctgggagccaaatagctacctacaaaaatgtaaactagggtgatgctcgctgtccgcctacgaaaatctatccacctgcaaaaataccgcaaaaatacccttcatttttgcacgcggaccaattatgtggtctgcctacgaaaatagatttggaatataaatagagccaacccaggggcgacttttttctaagtcctcctccctcactcctcagtcctctcccgcgcgcatccctcccttccccctcacctctcccctcccctcacctctcctcctctccccggtcaccagccggaggcggtggcggctcccagcggcgggcggcggcaactcccggcccctcccccctccctcccagatctggtcggaggagggcagggccggcgacgctcccctccatcgcgacatggcggcggcgctcccatccctcgcgacatggcaggcggacggcggcggggcgcagcgggccggggcggacggcggcggctgccctccttccctcccagatctggcggtgacggcgagaatggtggaggcggtggcgtctgtcctccctccttctagatttgtgacgatgaatgttaatttgtgatgtgcttgttttgattgtaaacaatttgtgatgctttgtgaatttgatttggattgatggggaatggaaactagattagatgggggaatggatgccaatttttttaatgctaggagctcttttcgcaggcagactagttatacgcatattttcacaggcgttcatttacatgcggacaactagtctaccagcgaaaacaggtttagcacgcctgtgaaaacctctttgatagtagtgaggtcccagccaatagtgctcgagtttttatccaaaaaaaaacatagggaccagcgatactgaggccacgaaccttaacatcacgtcttccagattccgactatctccttcccctttatccatccgcagcgtcactgtcatcacgcgattgatagctaatcctatcgatcaatcgatcgatcgatcgatctcctccttatcacggactgccgcggcaagtgattggcacgggtgcacgtagccgcgtacgtagcctgaactcctctttcggtctctgttcttgtgatgctaaaataattaaactgatttgtttaaaaagatcgcagctccctttcttttctttactccaccatcagcgtcgtcgtcgatccgctcaaccatttggagttaaattacgaatcaggctgtcagctagcagcatcttggcaataatgcagtgccaattaggagtaagctcgtagatcgtaggcgtagagtcgttcaaaagctcctaaagttcagttaaaaatacagtgaactggaatcagcagaaagcatttcgaggccaaaaggccaccactcggtgtgcttttccacgcgggacgaaagcagtttcctaataccatttcgaacgatttccgagtattcaagtttgaaacagtaaactttacaaaaatttgtattgaaattttatcaaaaaaccatcgttcagttaaggttcgaggggcatgtttgtaaccaaaataaatcttaccaaattttggcaatatttcttacgtactactttgtccctaaacctttttagtccctgtcacatcggatgtttaacactaattagaagtattaaacgtagactaatgacaaaatttattccataaccctgaactaattcgcgagacgaatctattgagcctaattaatctatgattagcctatgtaatactacagtaaacattatctaattatagattaattaggcttaaaaattgtctcgcgaatttgctctcatttgtgtaattagttttgtaaatagtctatgtttaatactccaaattagtgtataaacttccgatgtgatatggactaaaaagttccagtcccatcaaaacacccctttaatgtgttgtataacaaatattcttttcttctaatatattgacgtgcaatccttttgtacgttcgagaaaaaaaaagcatacttgcatgtgcaaggatgttcaacaatgtcgttaatagaagtatagatatattagttagagaaaatagtcaaatacaatgtaaagataagatatattctagagataaaatagagtcctagagatagaatcctagagataaatctactattacttgtattatagtctaagtctttatcttctatatactcctgtatatacctcttaaaagggttgatataatatataaaaaaacataaaaaatacaacaaattaaatttttctacagtcgtgctcacgctgcataccggtaactagtcaagaaaactatttgataatgctgcttacgaagcaccgtatattcacattctgtttttccgattacaacgatgtacacccacttattagtattcattcaaaatgatagaagcgaacggtaaaatttagccccactaaaatcctactgaaaacacacgtgtaagtttaggacgtgactagatgcccggtgtctaatctagtgcaaaaaaattggatgtttaaaatattgcggctgaccattagtggaacatcaagttatacattgttaaaataaaatagtcatataaatatttgaaaaatatgtgaaacacagtaacatatatgttgaatattttttctatcaaaataccattatatgatatcttaaatatttaattacaatgtatacaatagtgtaaactaattatgtaccggataaagctgtgtttgcaatcccatgttcccaatccctcttttgtttttcgcgcgcacgctttttaaactactaaaatgtgcgtttcttacaaagagtttctatacgaaagttgcttaaaaaatcatattgatccattttttaaacaaattagcaaatacttaattaatcacgcgctaatggactgctcagttctccgtgcgaggagtttagttcccaacttcccatatccgaacacagccttaagttaacgaagattcatgcatgcaggaggggctggcctggtgagctttgcacaaagagaacaggaggtgcatgcatgtagtgcacatttggtccaaaaaaaaaatgtgcacgcacacgcagcaacaaaccagtagaaacattttccgcgtctttaacatgaacctaatgaataaagtcatatactccattcctaacccaatgactagtatgatatccatagtattaaataagctaccacctaaaataaaaaatgatatggcaattgagtaaatgaggaaagagaaaaaaagcaggtcttgcatgagatatggtttctacgcaacattcaagacattatatgaaataaatacattaaatttaagtatggaaagatggtgttcgcattgaaagagtagtgtctagtattaattttttgataatgtgaagttttatagaaactatgtctagtgtcttgggctctcaccatggtgttcagaactagtgatcaatcgcatttataatcgaatccgagagatacatttaataacagtacatagttggacgaattcttatctttgaactgaagataaatctcttttaaataaacactaccttgacaagcaaacaataaataactactagactctgtctgttgttacaatcagctgttgtcaatatatatgttgaatatttttttaaaattttttataatcatttagttaacatgtaataaacgaatgaacgtctatccgagtgattagaatcatctcacaagtcttacctaaacttttgcatcgtaaattgcataagagtaatctacaatatttccttttcaccgagtaatctatcactatggtcaaatcctatagcgaagagactaaaaccttgtggtcatctcgctcgaggagtgtcagagatattaccagctaccgacgacgcaacagccaacagagcatgagttgcccatctgattttgcatcaaagccagcatgttacagcttagatgagcttgtgatagctctgggagtggcatggcaccgtctagcaactgcacgacttgccgtatgcccggacgagcactgggcagaggatgtaaacaaagcaagcatagtttcagcaccaggcttgcttcttccacggcaaagtcgccttgcagcggtgggtccacagcgtcagtgaccgtcccttgccgccaatgctccagcaccatgtccaccaacaagaggttaccgccgtgttcgtgtcttgtgagacaggcctccgtccgcaagtaacctctagcatgaacacaccgaaggcgaagatgtcggatgcctttgatggcctgccagtgtgccctagctcggaggctaggtaccctattgtgctgaccacgtgtgtgtggtgtgtgggtcggtgccacgatcatataaccttgcaaggccaaaattacctagtcgacagttcatttcggcatccaacaacacgttgcttgtcttgatgtctcgatgtagaacgacttgttcccaatcctcatggagatacaatatatactcgatgcgatgcctttgatgattctaaacctttgagccaaactcatgattttgctgttctcagcatacagatacttatcaagactatcatttggcatataattatagactaacagtagcttacccatccgccagcaatatccaagcaactgcacaaggttccggtgccgaagttgaccaatactccctccgtcccaaaataagtgtagttttgcattattcatctctaatatttgaccgttcgttttatttgaaaaatttttatgattactatttttattactattagatgataaaatatgaatagtactttatgtgtgactaattttttaaaattttttcataaattttacaaataagacggatggtcaaacgttggacacggatttccacggctgcacttattttgggacggagttagtactaaccacctcggcaataaactccttcattccctgcctctatagagatgaagcccaagcccttcaaggagtgcttcatcactgctatcaattttcactgcaaattcctcgtgcttgctgctacccctacatacagaaaaacacacacacacacacacaaacacctgacctgcttattcccttcatccgtgccagccgactgctatggcggcatgttattcttttgttgtatgttttcttcttcacatgcacttctataaacatatcattggagtatgagactcatcattgtgccacaatagcgtatcatataatcatgtgattgttcaagatgttattcaaattcgttcaagcttctcctgagcggcacaagaaactcaggataggagctttacccttaccgtactgatgatgattgctcaaaaaatcagacatacagggtgtgtttagttcgcgtcaaaattgaaaatttgattgaaattggaatgatgtgatggaaaagttgaaagtttgtgtgtgtaggaaagttttgatgtgataaaaaagttgaaagtttgaagaaaaagttaagaactaaaccaggcctgtatatggttctcccttgtgtcagttagtagttcttgccaacacaagtgcacatttgcgtgtggcagtttcatggcagagcgtatatgcgaatgcgatccacggttttgggtaatattatctagcttttaataagaggatggatgtgctgcttcattacatattctatttttattcatctatcaacaaggctgtgatcacacactttctattttgataccattgtacaaaatgaaaaagggtaggtaggtggcttctattatttgcgagttgttgaccttggccattatatttcttagctgttttatgttgcagtgaattaggattcagggtcaaatcgtatatatggaacaccattcttgcggtattcctatatcctatatataaatagtttaagtttcactgccggcctttttttcttttcagcaaagttagcttcagtcaactctgttctgaattggtttgttaagtactagatggaccttatggatcattgaattccacggaaatacactgaaactgatgagacgtgagactaaatcaccgactagtcgactacttttcgttcggccattaattgaaggccatatttattcgggttaattagattcgtaacattaaaaattgtcggtttggaaatatatcattactatttatgtatttgtaccgatgccattgatgctggtttgtaatctcagtgatgccactaagatacgtatttttgcatgtattaaacaaaaataccctcatcttctacctctctctccccttgtcctctcctctttctctgctcatgctcctctgctcctgttgttggcgatgcttctctactgctctctgattgggtcgacccgtctgcatccgccgccggagctcgcggcactggacaacaccgtgcaggtccaccggtgctcttcacgaaggccgtcctcactgcgtcgggctcgggcatcgaggtggccatcggtgacgaggtggatcaagaggcagttgctggaccagagaaggcaatgatggcgcatcgggcagctgcgagcgtggtgagggaggtgcaggagctcgtcagagaggagaagtggccactcttcaccgctctttccttggtcctttgctgcttcggcattgtcgtggccatcgcccagggctccttgctgcgaggagaggcggacggatctaggataccatcatcaccatctccatcaagcatcggcctccatcttccccgtttccaccttgctagccgcagagagggactaggggagggaggagccacattgtcggagtagttggaggaagatgccatcggcgatggggactgagggccccatggcaacgttgtcgtttgtgtggagctctgcgtaggaggacgccagtggcggcacgaggtgcagggagacacggacatcctggcttaaggagcaccggagaggaaggagatggcgggtgcggtggccttgtccatcgttggtcacgcttgccgctgccgttgctaaactatcgcctgtctctcacgccatggaagagaggaggaaggaaaaagggaaagaaggaagaaggggaaaagccacaggttggttcatttttttttaaatgaatccaaggggtaagtagtggctataaggggtaagtagtggcatatctcaaatatgtgtaaaatttcaatggcacggttccaaatactattttgaaaccaacatatttttaatgacattgatccaattaacccatatttagtttgtttatgtgttgcttgaattttatgctaacatgctagtagtatccatgttgtcaggtcattctgttgataaattttcgaggagtaatcttccagaaatggagaagcgcaagtaagtagccagtctcctgttctcagaagctggttgaatttggaagcttgaaaagcagtggtaattgcaggtacctggttccatgtaacatgccagttgggcactttattttcatacttcattccaggctacatttgcctccaggaacagcgttgtttgtgtttgtcaacaacactttgccccagactggtgagttttgcatatgaagtagtgttttttttttgtcccgcttgaacctctgttgaagcttcagacatacaattttgttgtggctgcagctcagctgatgggcagtgtgtatgagtcatacaaagatgagggcgatggcttcctctacttgtgctacagcagcgagaagacattcggttgaccaactcctccgtggagatctgctttgctgtaggtttacctcgggcgtcaataatatatgcatgtatatatattagtatgattagaaattacaatgatgtgttttatatactgtacattgattgatgtgaatgaagtgttacaaggaggaggagaaaaggttcataccgaacttaattatcccacctaaatttgtgaggcaaattaagaagaacataggccgtgtttagttgattaggtgtaaaaattttaaagtatacggatatatatttaaaatattaaacatagactaataacaaaataaattacagattccgcatgtaaactgcgagacgaatctattaagcctaattaatctgttattagcaaatgtttactgtagcaccacattgtcaaatcatggcataattaggctcaaaaaattcgtatcacaatttacatgcaaactgtgcaattggttttttttccgtccatatttaatgctccatgcatgtgtccaaatatttgatgtgatgaaatttttggaagtttgaagggaactaaaaacacaggcatagatcactcattttcaaagcaggatacagagaatttaagagtttaaatttccaaagagctttgtccgagcaggcgagcactctatcataagcttgcttgtacaatacaaggcttgactcaaacttggaaaatggcatccatgtatatatgtgtatgtttnatcggaaaagcgaacgcgcgcgtgcgcgttgncggcgagagtttccgatagtttagcttaattaactaagtgattagtagataatgacggtaattaagatatgattttcttttgtccggaagatttttttactaaccgattgaaaacttttgaagcaaattttaaaaactttcaaaactcaatttgaaaatttttaactcgaaatttaaatgtgtaagataaattttgaaaactttcaacccagatttgaaaactttcatctcaagatttgaaaactttcaagtacagatttgaaaattttttaagttaagatttgaaaaaatatgaaaactttcgactctgattcaaaaactttcgactcagattcgaaaacttttgactcatattcgaaaacttttgactcggattcgacacctctcaactcgaagtcgaaaactttcgactcgagattcaaaaactttcgactcgaattcgaaaacttgtgactcaagattcaaaaactttccacgcagattcgaaaactttcaactcaaaatattttgaaaaaaataagtgtgctaaagattaaaccaagtaataagaaaaaaaatgaaaaatcccgaaaccacgcaaaagaaaaaagaaagagcccatcgcgaaaaaaaagaaaaaatggctgatgggccggaaggcccggtagcagatggcgcgtgcgccaactagcaatccccatgttttatatactagtaataagt

SEQ ID NO: 13956 - DNA, 3267 bp, Oryza sativa
acacgaccagatcttacatggtctttcgtctctgaaggatccgacaaggccttattggctctgggcgtccccagccgaagttccctcaggttcctcggaggccttgtcaagacggcgtaaagggacagtaggataggtttcaacgctaggtgtcttttgtggtaagggatctctgggtaaaacacttggcaatcttgtgcacctgatatcaactttgttgaagcaggggtaatgggagaatcgctacatcgctggtcgaggaccaggcagtagtcgtaactcgaccacttaaagtggaagtagtgggagaaacgccacatcgctggtcgaggaccagacagtagtcgtgactcgaccacttaaagtgaggcgagagagatcactacgttttactggttcgggaaccagaagtaggagtcttttaatcacctataggggcgctaaagttagtttattacatgtgcatatcatgtggccagcatgactcacatacctaacttatagcatatccggatgtccgctcgcaatcatgtcgggtgatcaaaccgacggcgtttacgaggaattatccgttaacaaccttttctcgagtagtccagctatggccggtgctatgagataggtcgtcggtcttcgttggtaagttgggtgcgacgactccgcatttgtcgagaatgttctcgatagtggggtgtactcgaccacaacctactcgagtgctcaaatgtttctgaaaaatattttctagaaggcaagacatatagcagagaatatcgagtatgtactcaaaaactgcatggatcttctagtattattaggatataacgagcagatgtaaatatcaggtattatgtaaaccgtaaacaagcatgacttatacagaagaagacagagcgagcccccagcgttagatcgtagtcgatttaacatcggggacacccgcacaacaggtattattgtataaaaagcatgctctgggtaaacataataaattatggatctgacaatactgtatgatctgaataggtacgataaattgcagataaaatattgcgtacctttatagatacatgccggatgtatctacgaaattagtagatcaatttaaaaaaccaatctaccaattaccttgctgcgtactcgttcgatatcaggcaatctgacatcttttgttacgccgcggagcttgaggcttggatgatctcgatagaccaagttgtcgatgacgatgatggttccgatctagtcggaagatgtacttggacaggttggatctccccacagccgaagtcgtcgagtagcttgttgtcggagagtccatctcttaaacccatctcgtcgaaatcctgaagcaccaaaatccccctacctggcgcgccactgtcgacatttgatgtcgcaattctggtatttgcatagtatggggatcgtcggtgctaggatatacgcgagactgaggtaaaagagacggagacagggatttttatacaggttcaggcccccgaattgtcaagtaataaccctacatcctgttggccgaagccggtattgctcttattcatgataatcacaccagtataatatttggggtagcctatctaactattgtcgacatggcggtctgacgatctgactcgtagtcaacaacagggtagccttccacctcgaatccgtgcccggcgagatcagagatagcgctttcgtctctcctgacagtatccggagacaccgtagggtactagccgtgcttatccctgaagtcgatatccggcggcgtgtcttggcgtatgtaggcttctattgttgtggcttctatgtcgattgtgttgggtgttgatccttccccctctcctcctaggggagcttgtatttatacccataggtgtccccttgtccaagtagaactagggaaaccaatatggatacaatccgagtagtccttgtcatttccacgtagaactctggttgtctttccttatccggaactcctcctatatccgtaggttgtttccatgtaggacatggtatgtggtgggtcctgccgagatttagtcaactactattagatatgtggtatccataaccctgacagtagctcccgacttcaatgcaaatgtacgaattcatattctcaaccgctgaccatggagtgactgttatcgagctcaagtgaccgttcttagtgaattcagagataacattagacttcctttgttagcctcgtgcgggcacctaaagggttttctaagtcaatctccgatgtcaaccaagaaggtacagagcatacgactaagtctcctgtcttgccgtaatcgagaatttggattgaagtcaagaaattttatctcggcgggtacaccatctcttcattccgtattccttgtcgagatctagcaaccgttctcgagcgattgagaaggcgtagagtctacgacggagctttgtcaacatttgtcgtactcgccttagtcgatcttggtgtagaaccatagagacatgaagttttcgacaatgtcgaatagaattttcttgaaatcaatactcagaaaagaatattagatagaaatagccctcgagcgaatgctcaaagggtgacatgttataatatgacagactagtgaattgaatgtacagaccagtgttttgtatatgagcgtcttctctcttaccgactccgatcagtcagtttgtagagttatacactctccctagctcccagccttatcgtcggagaatcgttctcggatgacagggctcttggacctttgacctgccttggttgaacaagcactgatcctagcccccagccgtgaagttagaaaactcaatttccgattacacggcttggttaatacgcacggcgagaactcttacacgaccagatcttacatggtctttcgtctctgaaggatccgacaaggccttattggctctgggcgttcccagccgaagttccctcaggttcctcggaggccttgtcaagacggcgtaaagggacagtaggataggtttcaacgctaggtgtcttttgtggtaagggatctctgggtaaaacacttggcaatcttgtgcacctgatatcaaactttgtgaagcaggggtaatgggagaatcgctacatcgcttgtcgaggaccaggcagtagtcgtaactcgaccacttaaagtggaagtagtgggagaaacgccacatcgctggtcgaggaccagacagtagtcgtgactcgaccacttaaaagtgaggcgagagagatcactacgttttact

SEQ ID NO: 13957 - DNA, 511 bp, Oryza sativa
cgcactcataacctttaccaataaaatatccatgtttacacacgactactttattagactcaaaaaccaacttaaatccgtctctagtcagacgggagccactaacatgattcctgtcgatagaagggacatgctgcacgttcttcagctgcacgatctttcccgaagtaaacttcagatctaccgtgccaacaccatgaacagaagcatgtgacccattccccattaggacagtggaaccccgtgcgacctgataagaagaaaacaatgagatgtcagcacaaacatgtacattggcctcagtatcaacccaccaattagtagactgattaactgaaaaaacagtaggtaaattaccatacccgcttccatctctagtgttgccaatggtcacattagcaaacttagaagtctgccctgcaggtgccttcatccccttgcgctgtggacacttcctagccagatgaccaggttgcccacacacaaagcaagtcctctcatcctggttagg

SEQ ID NO: 13958 - DNA, 614 bp, Oryza sativa
aacgatgtacttcatcttttagcttcggacggtcactacttctatttactggggaaaagcaaacaaagtaaatgacaatagatcatatcgtgaagattatgcaatatgtaatttaaaagtaatcccaatgaaagaatagattttgtacggtcactaggaggtataacaggccatgtggagaatacttacataataattatagattaaaccggcctctacatcaaaaatgaatgtacactacaaaacttacataataaatacatgatgcaaactatatgtattttttccctctttttatttttttttggggggaagggggaaggggggcttatgccctgtgacagtataatgttgttttgaagctggcacatttctctcttcttaatacaatttggttggtcgatttttcagctaaccgaccaaaaaaaatgatgcaaactacagaataaccagcttgcaattttgaaggaaaacttacgtttgtttcggtaaacttgcaccacaacaggattcatcatcgcagcttccttaattcgaagcccaccaatgtcacttgtatgacttttgctgctagaatgagccttccactttcagtcttcgaagatggtatattg

SEQ ID NO: 13959 - DNA, 989 bp, Oryza sativa
  unsure (1)..(989): unsure at all n locations
agctggtgctccttcaacttttcgagtaccagacggagatgttgctcatgttcttctcggattttgagtagataagtatgtcgtcgatgaacaccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccggattctcaactggtggtagcctgatcgcaggtctatcttagaaaacactttagttcctttcagttgatcaaataaatcgtcgattcgcggtaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgctcatcaacttgcttcttgacctctgctaattcgtttgccggcattctgtacggtctcttatagattggagcagttcccggtgccaagtcaatccggaattcaatctctctcttgggtggcatggtagtgaggtctttcgggaacacttcttgatactcgcagactatgggtatatcttccaattttctcaagttcttctctacggtgtccacttgggattncgtctcaatctgattcaacgagacccctttcttttgcgagactagagatttgtacaccacgttttctcccttctcgttgtcaaggtgactgtgcgactcgcacaatcgatgactcccttaaaccttgtcagccaaatccatcccaagaatgacatctaggtctttggattcgagaagaatgaggttggctagaaatggtgacctttgaatttctattgtaatagaagggctgaattgaaccgaagtggagctattccctggggtatgaacccgcatcggtgtgctaagt

SEQ ID NO: 13960 - DNA, 2443 bp, Oryza sativa
tgatccaagatggacggccgagatcgatcgggtccacagcggctcacggcggacgaccccgatgacgtcagcaatgacgtcaccgacagcggcggcggctcgcggagcggacggcgcacgctcgccggcgaacggcggcgcgagaacgcaaacggaaggcaccgggacgaagcgggcggcacggcgaactcaccgacgaccaaaacgacggcggagaagcaacggacggcgccggcgacgaggaggaaacggcggagttcttcggcttgacgacggcgatgatgctccggcggtctccgacgatggcgaagcggcggacgaggacggcgacgacttggcgaccacgatgacgtccttcccgagcgacggcgacggctgaaacgacggcggcacacggctggagcggcggcggcgacggcaaagctagggcacacggcgctagagctcttccggcgacgagaagcgaaggcgagggtggcggcgagaagagaagactccgggggtccttttaaaggggctcggaggcggcggcgaaggcccacggcgacggcaacggcgaaggaaactcgcggcttggagagaggaaagccgatccgattcgaactcgaatcaaactcattccaaaccgattgagccaaagattccaaaggagaaaaggtaaagggagatcccggagattgtttcccctctaacaaatcggccggagaaggaaaggaacggccggattggaaggaaacagcggcggcggctcggcggcgccgcgctagggtttcggcccgaggaagacgacggctccgacaggcgggacccacctaaaagcgacagcgagggcgcgcgcgcgcggctgactgggccggctgggccgagaagagagaagagaggtttgggcccactttcgggccaaaggccaaagaagactttttaaaacctttttcaattaaaattatttcttaaatgcaattccatttattacaaatactttcttagctcaaataaatcccagaaaaatctaggaattatagaattaagcaaagtatttaatgaaattttatctggccccattttatattggaatttattaattaaacttagattttcttttcaagacttttaaattatttctaaaaattccatttaaacaacaatttatatattttgaattttcagggtgtgacaaacctaccccccttaaacagaatctcgtcctcgagattcggaagaactggcgaacaggtgcggatgagctgacttcaattcatcttctcgttcccaagttgattcttcttccgagtgattactccactggactttgcaaaaacggataactcgattcctgtttcttctctcacttgtttccagaatacggattggtttttcaacataggtcagatcctcttggacttctatctggtcaagattagcttcttcggtaggtacccttaaacactttttcaattgcgaaacatggaacacattatggactcctgccaaagattgaggtaactccaactgataagcgacctctcctcttctactgacaatcttataaggtcccacaaaacgcggtgccaattttcccttggtatgaaaacgatgaactcctcgaaaaggcgtgacacgaagatacacataatctccttcttcaaaactcaaatccctacggcgattgtcggcataactcttatgacgagactgagccacacgcaatctttcttgaatgatctttaccttttcttctgcttcccttaggatatccgtcccgaaaacctgacgttctcccgtttgatcccacaaaagtggagtgcgacacttccgaccatacagtgcttcgtaaggagccatctgaagactagcttgataactgtcgttgtatgaaaattctgcataaggtagattcttatccgacttccaccgaaatctagagcacaagctctcaacatgtcttccaaaatctgattcaccctttcggtttgtccgtctgtctgcggatgataagcagtgctaaagttcagcttagaacccatctcttcctgaagtttcttccaaaaatttgaagtaaactgactgcctcgatcagacactattcttcttagggacgccatgcaaacacacaatccttgccatatacaattcccgccaagcgacttccggaataggttgtctttaccggaataaaatgagccactttggtaagtctgtcgactatcacccaaatagaatcatggcctgatgacgttctgggtaaaccagtgataaatccatacctatttcttcccatttccattcaggaatcttcaaaggctgcaacaaaccggcgggtttctgatgttctgccttgactcgctgacaaacatcacatactgctacatattctgcgatttcacgcttcatacttgcccaccaaaatctttccttgagatcctggtacatcttagtactacca

SEQ ID NO: 13961 - DNA, 422 bp, Oryza sativa
gtgaggccgcctgttttctctagtaccactaatcctgttgaagctagtgattggctgcatgccatagagaagaagttggatttgcttcagtgtactgatcaggagaaggtctcatttgcatcacatcagttgcatggccctgcctctgaatgggggatcacttccgcctgaataggattactgctgaacctatcacttggcttgaattcaccgctgctttccggaagacgcatataccatcaggagtagtgtctctcgagaagaaggagttcaggtcgcttactcagggatctcgctcagttacggagtaactgcacgagttcaatcgtctgctcgtatgctccggaagatgtgcgcaatgatgaagagcgccaggagaagttttttgggaggacttaatgatgagctttcttacccactca

SEQ ID NO: 13962 - DNA, 639 bp, Oryza sativa
aggtaatgctttgctcttggccgacctttgcattcaacagaatggttaatgtttaggcagtgaagtcgtttgaaacatcttctcttgtactcagaaaaatattagattttgtttttttctgtaagtatcatgatcgatttgcatttggtgtttacttcttccagggccaactaaatgaaatgcccgaagttgctgtgaaaagagcatcgtatgttaacagaattccatttgaccagctcgaaaatgaggctaaaataatttcaaagcttcagcatacaaatataggtaaacttctaggatattgcagccaagagagagagaagatactggtcttcgagtatatgccaggcagaatcttagattcattcataactggtagggggttcaattcaactagctttatgcctttatctactcagtttcgagaccaaattctattggtcatgttcactcaatgatgcagtacatacatgtttgtcgcatttgattacaggtgagcgagcagaagagttgctttggactggtctaagcgctcccaaataggtaaagggatagctgatggagctgtatatctacacaagcaatgtgagccacgtattattcatggcgatctggaaccaggcaacatacttctggatg

SEQ ID NO: 13963 - DNA, 775 bp, Oryza sativa
gatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacagaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaattgcacactttgccttcttgaccttcaactacaaacccatcaggttgatccatatagatctcctcatccagctctccattaagaaaagctgtcttaacgtccatttgatgaacgagaagaccatgtgaagctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggttcacacccatagggtcgctctgtcacctcccaagtcccgttagcgataatggaatccatttcactacggacagcctccttccagtagtctgcatcaggagatgcatatgcttctgaaattgacttaggagtgtcat

SEQ ID NO: 13964 - DNA, 25462 bp, Oryza sativa
atcgatagctgtttcagccgttgaccaaggctagctctctaagcctgaggaaacctcaaccttccactactttcaccaactcattctcctccatctccctcatcttacccctaaaacttaaattgttcaaccactatcgtagtcattagactggtgttggagctccaccaacactataattggaaaattcgcctccccatcatattctttgagctcttacagtctggtctggaggtccaagagtagaagtcgactctttggccattggattgagacccactggccagggagaaggtgacttaaatttcccataatttatgttacctttaactagcaaataccttttttttaatacaagttagaaccaatgtgccgttaattgattttttaaagggtccattaatttaatttgactcgggcaatctacatgtacatgtccctttcaaatcggtttgtgctgcatcattttgcaaagagatgttagttagagctggtacaatagcaggctataagacacctataatcacgtattaagaagaaaagagaagagagagaagaaagcagatactgatcagctgcaaaacacggattccaagacgttatgtgtgataaatggtgtagtatatttttatatttaactgttgtataaatagactattagattagctataaatgatttggagttggctatacttaaacttgctcttagagtcgatcaggcgaaggcacgtacacggccatgtgcaggtcaggcagacttggtgcaagacagatatatatgtgtcccacgcactcatcacttctccagataggtttgtgctgctgcacgacaatcaagacgcatcatattgtagggctaaaattaagcaattaagctgatctgtcgacaataattagtggagctagtggttgcaaatactcctatatgcatatgggaaatttgagaaaatacatggagttattaggattttacactaaaaacctttggtaactcgagatacctaaatacctggagaatttctcccgatatatatttaaaaaacattaaagttaccctatgcatatatacttccagcttgcttgatttgcttcggataaaaggcatgcacatgttctgtgatcgatcgtgcctttgttaatccgttgctttcgtccttccagtgtcattattctgcctaattaaattaccagattcagagtagagtataatatgttgaatcgacgctatcatcggttgagaagttatcaaccccagatgagacaccatataattataagttattcatcgcgagagagaagctctttccgttctcgaacccactattgactacggcagtattactttgaccaatttttttacataatttcgttacgatgaataaaagttgcatagttatatttataagggtatatatttcaataatatatagcatatttcaagtatatataaatttttttttgctgaaaagacaagtattcaaaggttaaattcgaatagcagcggctcggttactcgataacagagggattgagtacatactatactatacatgtccatagggttgtgaatgagttgagctcgagctagctaggctacgtagctcgtcacacgaatgtatactaatttatacctaatatactagctagctcataaataaaagataaaaactacacatatgactaggcttgtgataaagctcgagctcggcacattaaaagtttgagacaagctcgaatcaaatctgagccgagctgaagctagctggagacgctcacaagcctcgagtttttttagcctcacatgtgcaggcgcgtattacactgtagtactttttataaaatcaacatagaggtagtacacatctcttttaaatagagattaaaaatattactcccttcatctacttttaatagtcatatttcatcttggcacatagaccaagaataaataattctacttatcatccatttaaatatgatactagtcattccttgtaaacaagcgattcattaatatttacatttctcaatgcccatgtagccaatcatgtgtgaaagaatggagagtcatgcattaaatccgagaaagtcattaagatgataggttgttgaattaaaatatgcctatcaaaaataaaattttcagatttggaaatatgactatcaaaagtagatggagggagtattagtgaaaaattcatgtggacataattaattggtttgtctgatcgaccaacatgtttttaatatatattttttgatcatgtagatttatttgagctcacatagtactccctttgtcttaaaacaacatccgtctcattcattcaaagtcccttatattttaaaacgggggattagtacattgagattgacaggccactgctttactgtacaccagattatttttgctacaaagtaaaggaaattaagccaaacaatttcaacgtgctaattaattagattgatatgtttcattttcatgagggacaacaggctatgtatgcatggctacacatgattccaccagaatttttattgaaatatacaaaataaagataccatattattgatgcacaccctgctagctatctttgacttttagctatcaacttgtgcacagtaatgacctcttagctaggtaactatatatatatctaaaagtagtcagctattgcagtcctatcctgtgaatcttcatctgttcgtccgtttcttcccgtgtatagcaagggaaaatcattcagcccccttcaaattgaatttcaagtaaactgtcaatgatgacatcattgagtacattattttttaaaaaaatacagatcatataaccccaccaatagttaaattagctatatgcaaccaccgttaacgttggtcatgattaacattttgtgtcttggactgccaattttaattatattaacctgacctagaccacaggtaacatgagtaggtactatgtagtatgtatacctgacctgtttgattatttgtgggagagatatatgactccattaataatgcaatatatgaatgaattattccagaacagccacgtatatatatgcttttgcctaagctagaggtagtataactaattgattatgattggagaagagtcaacttcacataacacatctctacgtcccgatcgcctaatgaagatattttttgagcttatccaagtgaccgacaactttctggctactgatcttgcatcatataaacctttgcaaaaaggcataaaaacattcaaggagaaaaatacaccacatcctaattacttcacatgcagacttgtctcgtagcatcggttgaaactcgaagattaatagtgcatgagaaataaaactacactggttaaacctcctcaattttacatatggtaaaaaataatgaactaattagctatttctctaaaacagtaatttatcctttgatgtaccatattttttttatatagaacttatatataccttcagatgctagctatctcagaataccaaaattttggtgcccacaagtactttctcaaggatcataaaatttctctaaaatttttatatgcatgcatgatgtaattaatttgtagacgttttgaccttttagttctgtttttgtgccacaaaagatctgtctaaataattaattaagcaaaagagaaagatgatcacatcatcacacatactctgactatatatactattgatgcaaaaataaagatatattctgtaggcctataccctccattattaataacaactggacccctgctgggtccaattgtaagatatactctcaccaagcataagcatattccatggaatagaacaatccaatgggattatttcaagtcactcgtagtcgacatatatcgcattctcagtactcgtcaatcgaattaaagctctattatcatataatctacttattttatcatttctttagcagatccggaccctttttcccacaccaatggacggctattacttcaactctaggcaacgaaaattttgtcaaaagatatagccgtatacattgaaatagctgccgcgatcatttcctatttttttttctttttcattttttgggggtggacggcactaattaagatcaactataactaaaattacatagtatataactcatttttgtttctttgacaggaactctcttcagaacgtattttgcagaaaatggatcaacctaattttacacaagtcaactactgcagactatctctgacaacagaaattcttatactgttgtactttaaatactaatataagacatggttaaacttgatacggtcttctaaactaatttttgtcttataatttctcatatattataaggtttgtagtaacaaaattataaccatatgaaagtaaattcaaatgtcaatccaatgatataatttttatcaagtaaaattcaattcatattgtagtagttgttggtcaaatgttttaaaggtggaatcttgaaatacgtggttggcttatattatgggatggagagagtaactttttagtcgtagaagagatgtctgtgatttaccagccatttcttggtttcaaaataaaagaagaaaccgcgtgtggctccaatttataaccaccgaacatacagtgtatgtgattatcccgtgatataaatcattcatgatgtgtccttttactagctagatctaccatactttgttgcatttagctctcgacatatcacttttgatatctctacctggcgatcaacataagccatacacatggtgacatggatatacatctcagcacgcatccatggcacatgcgtactgaattattgcccggccctagcactcaataacacacgttgtactacgagacgagcatatgtctatctggcacgatgctgagagagatggcatatgatggcaaacgatcgattaattggaatacggacgattatttagaaattggaattacatgcatggatgattgtacaattcaacactcacaagaaagaaatatgatgtatgtaggttatatatcttgattgattgttcaacttatatgtaggacatacttgcaatatccttcttgcccgattacacttgtaaaaccataaaattcattgttagtggatatatattaggaataatccgcagtccaaaacatatgagtgtagcaaaatgctacttgaaacttagtgccataatttagagtcgaacgtagctcaactagtcatgttttctttgatggaacaacctatccgagttcaagtcctatacttagatataggtgcacatatttacgactaattattctttcagtggtagacgatgaacttgtcgataacgagacgttcacagggactttgtcaatatcaagatatgtccatttagtcttcttgatgtgcccacaagggataggataagcgcgtgtgtttgtaagaaacactagttcatttgataagcttgtattttgcactcttgcatcctgatagtcccaaacataagaatagggtgttacgcaaatgaacgggccaaatctctgctcatcacaaggtgattcatgtgttccgatccagggtgcgggacatgcgcatgttggagaagatggatatgtttacaataacaaaaaaaaactatctaaccccatgcaggttatcttcatatattccagttagttccattcttagtccttactgatactatatgttgtgaagctacaccgttggaatcagcagggatcttttgttctactttggatggtatagctcctatataatatagttagtatagattatatgtgttttctagttgatatttcagttgggtgttatcaggagggagatgcggtttattccataaacttagggcccctttgtgaagcaaaggtttaagaaaatagaggaatatgaaaaacatgattctgatatgaattctactacaaaacagatgattgtaaaatataggaaaaatatataaatgattgtttgattgaatcacggaaaaaatgtaggaattagatgagagggatagactcataggaaactttccatgaggttagacctcatgttaaaaatccttcaaaacttatatggattaagacatttcttattagaaagttttcaatccatggtttcaaagggctgtatagaaaaaaaaacctacaaaataaaaatgctacaaaattccaataatacttttccttcaaatcaaaggaggtcataagtttcttatttattgtatgcctatggcagagatcgtagagataaacaattttcattattggaaagaaaatgcttaattagttgagctgctaccttcgacttcgcgcggctttatccggtgcggattcgatcctcgttcacgcaaacaaatatcccgtcccggttcatccgcacacgctctatcagcgacttgcactacactactcatctgccgacacaagacaaaaaaacccatgtggggcccacatcaacccaagtagtgtagtggtcggtgggcctgcacaccgtccattgtccgctcgcggcgtacgtgtacgtggatcggtggtactacgtctccatcgatacattttttatttttgcccaatgcccatctctctctctcaggacgaattaatcaataataataatgcagatggccatttcctttcatgattatatatattgttctctccgttctaaaatataagcatttttagtatagtaccaaatcaatcatttttaacattaattattaatagaaaaaaataaaaaaagatcaaccatgtaaaattaatattattagattttatcattaattaaactattataatatgtaactctttttatttaaaacattttatttttatagatatggttagttaaagtagcatcttaaagactacgtgaaaatctaaaaatgattatattttggaacgaagagattattaattaatccaagttaacaccggattagttactactccagtaagctagctttacgcctacggttactttagctctttaacggtggcctccgcctataaaagcaggccagtaggacgccaataagcaagcaagcaaagccacatcttattgtcacttccatctcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggcgccctcgccgccggcgccttcgccctggtaattaactaattaattaaccactaattaattgatctaacgccgccttaattaatcaattaatttgctaagaaatcatcaagaagtaattaattaagctgattaatcgtggtgtgtagtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcacaacgtcgccggcggcggcgacgacctcgccgtacgtcgccggccgccgtgtcgtcgatttgtgtgtgtaataatttgtcttcttctgcatgcgtggtgttgctgtttttcacaagagtctccggcctcgaccagtgagaggctgacaggtggggccgtgagttcagcttgtgttgcttgattttctctgcagccttgccctctgtgtgtccaaataagtggtgtgcatggctctctccgtgtcatgtatcaatgtatttttatctgtactttgtacaagtgaagcaatatttatcgaaccttgactttctccattctatttgaaaaaccattaaagttgagtagattttagtgtgttaaattatatcgagaactacagaagtgctataggaatctatcagaaagataaccatctcttggggacaatcaattctccataagaggaggcaagataatcgaacaagaacgcgcatcgaaagatcaggattaattcatgtttaacgaacacaaataaaaatatcacacatatggtattcataattaaagtggttggtagttgaaattttgcactcaaattaaagattttaaagaaaaatcaaattaaagttgatagtgataagtggttgcattggaaaccacatggatccaatgttgacactgatgtaggagaatgcatttcctaaaaaaaattccttggaaaacaaatgttgtcttttttttctaaaaaaaaattgtttgtctgttggagtagtaaaatgccacaaccaaagctattttgctaaccaacaagtattacactcgcaaataaaaaaaaaagactaaggacagcaacatacgacaggtagagattttgctgagtagcaggcacaatgtaaaaaatttagtgaagagataagagcgggtgcgcatgggtaaaaatgttcacatatcaaatgggatcaacttttcttgctgtcatcttcataaacaaatcactaaatttatttttttcttaaggaaaataaagtcgcagctttttttctctactgactcatcctcttctttcccctcctccacacgcgcaatgcttacttcgcatgagtaatcaccagatgcaatgatttattttcaatcaccctcgctagtccaattcggggagcgcaatgcttacttcgcatgggtaatcaccagatgcaatgatttattttcaatcaccctcgctagtccaaatcgggggtggaaataggcgtggggcagttagggcttgagcttaatacctagctccataattctcattataatcttgaaaaatgttatgtaatatatgaaaatatttgaactcccattagctcagctttatgcatgaagattttttctaattctgccactactcctagcacttatccttaattatataaagagtgaagtacatatgtgggtggtccttaaatttgtacggagatttgtacggagtgttatgagatccataaactcccaaaatgcatttttgggactccgaacttgtcatgagtgtcgtatagatccaaacaagctccaacctgctttgtgggatgacgtggcatgccgccatgatgcttaagtgttagtggaatccatatgtcagtcacatagaaaaaataaaatttaaaaagagagggggagagagagagagaggagaaaaagatgtttttaattttgaaaaataaatgaaaaaagagtggagaaaaatatgttcttaaatttttctatatgtgaccgacatatgggttctactgacacgtagatataaccatggcatgccacgtcagcatacggagcgggttggagcccgtttgaacctatatgatagccgagacaagttaaaggaccaaaaatatattttttgagagtttagggatctacgtgacacacccatataaatttagagcccgtctatatacattaatattatataaacctaatacattataacatataagcatatattacctatctttaaaaaggtaccggaaatctatgtggtcacagcccatacgagaggatgctgtgaacgcatgatcgaggccatccaacggttgaacacggaactcggaaggcccagcctatagtagtaacttgtaaggatagacagcatgggcccaatcacctcaagcgacacatgtaaattgggccacaatagaggcccaaaggagatctcggattttgcagtccgaccaagctcgaatccgtgatctcaattttagtgtgcagaattaggccgctaccgtgatcaaagtgggagtgattttgtactagttttaacagatggaggagtgattatatccgattttccaattgagagatataaatcagattcgacctgtattttgttgtaaaccaacacgcctattagcggatcaccagatccgttccctgtccctgccacagcagtagaggcgttagataatgtagaacacccgcgcccatccctttgcgctcaagaacattgcagaagtagacaatgaacacagatatagggtggagctctctcttcattatagatctcatctggagtacaagccaaccattagccatagatgttacaccctacccctgtatatataggggtcttaggaggagatagaccttatctctactccggtttggattggcccacaagaaacttatctcctagttatcttaggagataaacttaacacaacactcccccttgggctaatccgcgactaactcatgcctcatcaaaactcctaccaaaacctagtgggaaaaaggctaggagaaagagtacatagttatcgctcatgcattgcacgttgttgcctcgttaaaaaccttatgtgaggaacaacagctccactcactcaaggaaaaagagtataacactatggactaaccggtccatattgtgggtcatgttctagggtgctctcccgttgaacctagcaaacatcaaagtcttctcatcccaattctccggaaaatcttccgagaactaacagttgggagagactaggtgatcaatcctctagattatcactcaacttgaattgctactcacctcacctcgcctcaggagtatgaggtagcccacttgtattagtggtgttggtttaccaaaccaatctttatatgataggaccttaaaaataggtctaagtgatcatcatcgagtcaatgccccgagcatactctaagacatttcaatgtcttgcaaatgacaatcaacacatagcacatactccccctgatgacaacctttgtcacagaccatgttcccatagcattaaacatctctcagatgtatgcgtaggcaagaatccttcagatcctcaaaccattagtcttaaagacttgtctcatttcaccgctaaaatgagaatagggaacatagagagtaatgcattccatcactatcatataccacaataccatattgttgtgcaacgcaatctgtttcatccttcagaaggattatggggataaataagtcacaacggcacgcacctcctgggcatgactccatcaagaactaggtcttgatcattgcaactttctttgacaatgtcaacaacaattggggatccacaagatcaaccacaagccttccaaagacatgttgtaatgatcagagtaactagctagtctgaaaattcaagcactgtgggggataacacatagccaacaacaccaagtataccttagcaggtattagaggacaccaccgttcctaccatcgggtagaacagatatcacgagtgtacacactccagtgataatcgtgaaatgcacatgtgcctacagaccctgtctgtttgatctcatcaggttcctcattgcaatcttatcgggtcacaattgggtcatcattcctccaagggattacacaattattagtgtgctcagacttactaattattttgtatctcaaaggaaatttcatcaatgaggtctccccctcagagaaaattccatcaatgagattttctcccaacaggagatggtactcttaccggaatacctattggtacgagatttgcatgctgcgatttcactatggagtctattcaagacatccatatggatttcccaaatttgttaactgcatatttaatttcatgccattttgccaatacctttatttagcggaacgttcaactcatgtggaagaggtctcatctaggacctacttgaaccatcgcacatcaccacctcattatctcaataatgacccataaaaatccgaacaacattcgcgacttttacttagcgattcggttcagcctcaattgcatttccatttgacccgatttgagcatcgcatgctcatgccatggactttttccggatccgggttctctctaagagaatcattagcaagaggcgacatagtgtcaacacatttattcccactcacacatttaaccagatcttcatcatttcccaaaacgatcgatccatggttgttccgtattcctagcaccataatatgcgtgcattgctaggaatgtcgtctccatgacgaacatcattatgaggcatatcaccttccaaaggtgaattctccaccaggagaatcagaggagtatactcacatccagtgagaactcttatgctctgactaaggcctacggatcgtgttagcaggcgtccccgcacaacatgatcaaatgccataagtcttatgtggatacgatattattcccgggtctatccacatttaccacaattgggagcattactctttttaacaactatctagttgttcctcatatgattttgttggcaaaaactccgtgcaccaagcaataggagtatgaactaaacatacaagttcagctcatttagtgagttcactcaaagaaatctacaggcattccaaaatgggcaattctctccccctaatgccgagatatcttacaatagcatactaccaatccccatatcgtggcataggattaaggaatttcacctcgatcacaaatgttctcccacgaatgtatgctacggtggtgatatatttgggaaatatttacgcactttaataggagagatttttccattatatgcagtgagcctggacatatactaatacagtgccatgaatactgtattcttccttccttcgaagggttatcctcaacctcctagttaggatatacaggtctgcaaaaaccaccattgctaccaaatgtatatgcaaccaacatgcaaatactttagccaaatgcactctccatggattaatgctcacctagtgccattcaaactcataatcgattccggatcgacgtgcattagacattgcatgttatatgcttaagaaggcaacctatggtggcaaaacgcattccaatgcgctcaacaaggagtacgatagcaaagtgcgcggccactagcctgcgctgccaagcagatttttgtggtgcagagttgtgttaaagtccaactcgtctaatgcccaagtttgactccaattactcataccaaactctagaattgggtcatagttaagcagcatgttttaggtacgatccacgagtgaattatgaaaccacatttactaatgtcccctggacatagccatcaggagataatcaatacctccgacaatggtaatattcacaataaaaccattatattaagacatatccacaaaaatagtggaatgtgtcggtgcaactgtcgttggcataacgagctcaacgcatgcaacacgacaaacctttgcatggcttgcacacgtccacacacgaaaaacgccagtgtgcgactagcatggtcatcaacccgtgggtgatcaaccaacacaaccagggagtagtcatcgactacgagagcgcgataaaacgcaatagtgcatagccaacatttttctgaaatacagttacgttgaactgtgtgagtggttgtaactcctcggatcaaacactaattgttctattaaactaaagcatttttatcaattccagcatgaagataagctttataatagaataggaaagaccaagaactttatctatctaggaaatatcgatttaatgcaaagttccaaactaagcaaaagataaactgcttggcaacattatagccgaccaatgtccttctaggacatgctctaaactagccatacaactcccgttgtcaaagcaacttattagacagacactacaaaccattggtcatcaaccaaaggtcgccatttagcactggatccatccgaggagacgaggacctagaccgggtcaacaccctagtcaagctattggcgttgtagtgaagtgggaatcgtgcctattcacagcatctaccctcgggcttattccgctagatttgcctccaatttttcggcgttctcgcaagacatcaggttccaaataatattgagaagatatgtgcacaccaggggcaaccatatgaacagtgccgttccaccacatggaaaacacttcacatctttcaccggaccgagtgaaaaatatctcaaattattgaacctcgcaactccatgttgctagaaaattgaggtataatcatttatctccaaatcagaaaagcatgctctcaaccattgggaaagcaaaatgacgaccgtagtccgaccatactctgattgagatattaagccactaggggaaaggcacaatgaatcccaaacacattgtctaattccacacatttcaacgactcagaatcccattcttgagtgtgatcatagggatagagtgatctacattaatgcccaaagccatacaatagtcattgaaggcctttacgtgaaatcacccacactatcatccgaatcgtttcatgcggttctcagagaacgcaacacgcaaatggacgatatgtgcagtgaattcggcaaaagcatggatctcgtacaacaagtatacgtgactccatcttgtagacacatcgatattaccatttatgtatggaggagtgtatcagtaaagagtggtcttatccatagccatggatatttaatttcccagaatttccatgcgttatgtgattttttgttatttacttggtcttatttggcattatattcccaatatttatgccacacagaaaaccgtcacacataaatgcaggaaaataaacccatcataatgcttccaggggggattctacactatgtgaacacaatttatggaagcatcataacctagaaaaccatctctagattatgttgttggaattgcatcaattttaaaagcaaagcaatgcttaaaaaacaccattacatagttatttacgagtccggagacccacatgcaaaaccaaactatacagggcctaagcaacaagacatagccacacaaacaaaattaatataatctcttgttaattacaaggttcaaactgtaaaattgcattgaacggtgaactatagcgtaaaaacccaacactccgggggcttaaacacaagttgtcaataaaccgaaattaatccggccgaattaccgttcagagtacgatcttatttgggctatcaagcacagtgtagcccaaaatgcctaataggtcgaatttctgaaactctagacccatgaggatttcggatttccaggtttattatttttattaatttgtttgggctgtctcgttactgttgggctttattcggtcgggcggaggcagaccggtccagccggttcgcctaaatgaccgagaaagaggaaggggaattagggtttcccctttcccattcattgtccgcaacggcgtccaccgctcggcacaccggcccctcgggcacggcggcggcgttggaggccgtcaactgtcgactttgaagggagttagggtggcacacggcgaggaggtcatcgacgacccatccactaccccgattggcaggacggtggcgacgacatcactcccttgttgcaatttggtgtggcgacggctcggtggcacacgatggagctccacgtcgacctgcgcatcctcatgacggcagcgaggcgaactcaacgacggcaactgagaccccaacaacagcaaccaaattgcatctggccatatcgtctcggcggaggttaatctggtagcaggcagccgacgacccatcatcctcccgccacagctcgacgacagcgtcgatgggaggtcaacggcggcggcgcctcgcttcggcattaactccggcggcaatggcgacatgggtttagggctttttctgagacggcggtttcccgcgacggcatcgacgcaaggccgacggcgtacctaacagcgacggcgaacgatggccaacatgtctctaagtccgactacacagactgagaatatgtcaccgcgttcccggcgtggcgtcatcagagaaagagagaaacagatagatgcgagggaggcgggcgagtcagtcaattcggcccagccgaattaggcacgtctccagtccagggtttcccatcaattttaatgatttctcacacggttttctccagttttcatcaaataaaacagatgcatatagatcaaaagtaggaaattaatctaccgctagatcaagagcaggatcaaatctactacaagcaaagcatccataatatgataaaaacgagaaaataatatcaatctataaaaacatatatagaccgcatacctaatagacacatgcctggatgtatctatagattagtaaattagtttagaaaccaatcttactaattaccctggttcgcatgctcacaaaaatctttcacgcgcatgctgcctcctgctgcgtcgcaggtcgcctcaggaacggcgtcgatcggtatatcgcacgcatctgtacgtgcatgtgtatgacaacgatgacgacaggtcgacggctccgatcacggatacgctgcttagcacgcacagcacctgaggctcgtctcgcaaggcgacgcgacgatgactcagatctcgtcgaccggcggcagacatgcatgcaagcaaaacaaccatcaaccattaattaattaatttgtaatcagaaatcaatctactgatgtaagtgcatgtgtcgatgcatgcatgcagcatgcatattggttgatttgccatcaatcttgtgcatggacgccaggagccaggtccatccatgcttgcgtgtggccagcacaggccatcgcgtggaggtgcggcgtccagtgtagccgcagccgcgtggcggatcgcgtggggacgaaccgacgaagaacgggccggtgcactaggagatcgagcaccgacactctctacgggcgcgctcgatcgtgcgagggaggcggggccggcggacatcggacgacaggagtagtgcacgctgctcgcggcgtctccacggtttcccggctacctgctcggtttccctttgcgatgtctccgcagtcgcgtgatctcgcaaagaaaaccaggacaaaccaatagatcaatctgttgaccgaaattaatctaacaaaatcaacacattagaacaacaaaccggtgaacggagagctgctgataacgtgttgtaaaccaacgcgcctattagcggatcaccggatccgttccctgtccctcccacagcagtagaggcgttagaaaatgtagaacacccgcgcctatctctttgtcatcaagaacattgcagaagtagacaatgaacatagatatagggtggagctctctcttcattatagatctcatctggagtacaaaccaaccattagccatagatgttacaccctacccctatatatataggtgtcttaggagaagatagatcttatctctactccggtttggattggcctacaagaaacttatctcccagagatttgtttcacaacatatttaagcgagtaaaagtggactttttccttgttattagctatctaattgggccgcgctttctgttaggcaagctatggtgggccgatcgctttcatcggacgacatagaggaacactacaagcccattccccagtggccgccgcccgccgccggtcgccggagcttgctccgctgctgcaaacacctcgatcgttgtttccgcggcacggccaacttgccgacgtgatggccatggccggaggacgtggtcgcacgcacgcatgatgaggagaaacatgcatgattaattggacactggacagagagcacaaacacagcacgatcaatgccttcccttaatattatacaaacatgtagtagtcaattcgcagtcatggatcaattaaattaacgaagggcctcttcactttcacgtcattttcaaccttaccaaattttagtaaagttgtaaaaaaagtggctacatttagtttgctgttaaattttagtaactatataagaaatgatgccaaaattttgacaatagatttttttttggcatcaaagtgaataggcccgaatagacatgtatcgattcacaacaatctataagtaatttaccaaacaaaaaattaatcaacaagaaataataataatacaagttcatatattgctcaaatattcaactgcaagaattaacgagcgagtttttttttcctcactcgatggatggatggatgcaacagcgtgtgtcaattaatcatcatatcaggatttatggctagcttaaccaatcaaatcaaatcaatttcaatttctccttcttggcatggatacggcgttgccgtcgaagagctcgtcgatgatggcctcgaggtcctcggcggagagcttgatgtacttctccgcctgcctcccggcgctgaagctctgcgagaacctccccaggaacgacctgtacgccggcacgacgacggcggcgatcgacaccctgagctccgactgcagctgctcgtcgctcaccacccacgcgccctgcgtcctctggatctcgtccatggctgcgttgaattgcttgaacctctccttgagcaccggcttctgcaccgaccccttcaccgtgatcaccccgtcgtcgcggagcagcgtcagcacgcggctccacgtctcccgctggtagttcttgtggtactgcctcaggtccgtcgaccgcttcctcgaccacgcctcgccgaccaccgcgttgatctccggcgatccccggatcttctgcagcatgtaccggccgttgttcatcaggaagatgctgcagagcgccgggtccttgtagagtcgggatttggcttctagattgtcgtggaggagctccatcacctccatcagctgcgccgcgaacgggtcgctgccctcgtcgtcggcgtcgatgtcggtgcggtggtgctcatggaagacttgctctagggtgttcttgtactcgcatgcgtacttgaggtagttcattaggtagcgggtgagtgggtgcaccgcgccgcccgggaccggttgcttgccggcgtcggcgcggatggagctctccaggtcgcagaagatggcggcggcggactcgccgaggcgggaacggacggaggcgagctcggtttttatgtcggtgagggcgtcggtggtggtgtcgggttcgtcggcggcggcgtcggtggtggagcaagcggcgatgaaggcgtcgatgacgggggcggcgtcgcggacggcctcgtacatgtcgagcaccttgaagagcttctcgcggcgcgcttcgtcatggcgacggcctcggtgaagttgagcatctggagcatggcgcagcgggcgaggtcgacgaagatggcgcggccgacggcggcgtcgcagccggcgaacacgcgggcgcagaggtcgtgctcggcggagaggccgacgttgatggtgtggtggaacgccttgaatcacgttggcacgtccgactccagcgactcccacgccatcctcaccacgttgtcgatgctcggcttctcgtacccgaagttctggagcaacccgtccagcgcgttccggcgagccaccaggaacacctgggtgcactccgtcatgtaccccacggcgatcatggcgtccgccatggcgcggagccggtccacggtctcgggtgggaacggcgggggggtgtctccaccgccgccgccgccgccgccgccgtccgacgcgggatcgccacccgcatggttgaacgacgggccacgcctcatggacttgccggtggcgctcctcgtgtcgccgttctgcgccgccttggcgacgcgggggtcctcgagcatcgtgtggaactcgtcctcgacgaacgccatggcgcggtggagcacgccggtgacgcggtgcaccccgatggtgaacttgctcccctcggggaccgcggtgagcgccgccgccagcgcggagatgcgcctgatcgcggcgaggagcggcgccgcctcgccattctcgcccaccgcccacttatcgtcgtcgccttccgactgcgccatctcctgctcgacggcggacgcgaacttgtcgagcgtcacctccgagatgctcgtcggcgcgtcgccctccctcccggcgaggaacgcgtccacctccgccgacagcatggctaggtccggctccgcggcctcctcgggcggcgccgcctcctctccggcagcaccctcgccctcgccggcgccggcattgtcgacgccgccgcgaccttcctcggcctcctccttgacgcgcacagcgggggcatgctcgctgatcttgatggcgccgagggagaggttccggccgagcctctcctcccggaacgtcgccggcgagaagctgctcgacttctgcggcgggatcctatccattcttgccgccggagttgatcgatcgatcgatcggtgcaacggtcaatggcgggacgggtcgcgatgcatgcaaagcgagagatcgagaggagagagagagagagaatggagaggttagagagagagtaggggtggggcgcggaagttgagggacgccatgattttgaaggagtcgtcgtcgtcttcttcctcgagctatgcagactttgctaaagaaagcagaggtgttgcatggttgctcacttttggcgccaacgtgagtctcctgacaaaattcttatgaatattttcttctggattgatttgaacattagtaggatgccacatttttagaccgaagtgatatttttttaaaaaagaaatcgttatttattcaaatgctaatgaacgtgtgaccgtgtgtggtgatcatttgtgcttaatttggaggaggtgatgatgattgctgcccacgatgagtccacttcaaggactgtttggagatattgcatgtaattaattagttgtccacagaattttgttcttgtattcaatttaactcggcactgcgaactgaaatggttagttttatgccggcccgattcaattcctaaattgacatgtcagctcgtatttatgtgcaattattctattaacggtaagtgagtactgtttacacctaaatttgacacctctagataaaatagagaaaaattgccaaagtttgaaaagtgctgggtttccttcacatggccggtcagaccgcaggaatgtgggcggtctgaccgcggcctgaactccggtctaaccgcaggtatgtggccggtcagaccgtcagagtttgaactcgagtctgttttcgtcgggtctcgagtttccttgcttgggaaggcatgtttcgggtttcctttggtttctatcccaagttagacgtggaggagaacctgtagagggcaagaccaacccccatttaagggacaaggccggttcaattgtaatcccccaaacacacaatatacttgaatcaccttatattttatctttatttttagccatattttttattttaccctagttttagtccatctttgtcgatttgtgccgtaaatcgtccgccgccgctgcgagagtacgacacctctttgtaggtttgtcctgaaaaccttccgtttgtctacgagacgggtagttatcctcatatcgatctaaatcggtctagatgctgactttaatctctaaatcggctccgctagccggtttagccgttttctacaaaacctatcttgatttggctttttagctagatcgaggtggttggcgactccatatcaccttaagacgtttaggtgttgcgatcgtacttgtcgacttgtcacaaaaagttatcaacaagtacccgtcgatagagagatgtaatttcattagtactaagatatatcagtaaggtctctcaagtaaggtgcgtgcatgttgtgtttaaagcgaaattaaacacctatagtgtcttcgataatcttaagatactcccatccaatctttcagaaacgctcatcgtgatagagtgtgttgtatttattagaaaatgaattaatttggcatttatttgtgaaaagaaatggatccggcgtataacacatgatcatgtagtaattggtagtgaggaaacggcccgaaaatagacggaaattacctccaccatgtttgtttaattttttttgttggaaatggaaaaaaaatctcagatacagaaattataatgaatatagatacaaagtaaataccaacagtaacgaatatgatcatggatagttatatctacaagaatatacttaaactcatgttaaatataatatgtcattgtaaattagactatttattttttaaaaagaaaacttagagttttaaatatgaagtgtatccatattaaaatatcattttcaaattttatttattcaattctaaaattaataattaatgaatgtaattgagatggatttttttttaaaaaaaagaaacaagttactctcccctattcacattataagacattttggaatctctatatctcggttagattttatcacataataatctatcttgttaaagagattttataactattttaagtgagtgacatgtaaataaggaggggttatccccttgaaagtttagaatagtctcctagcctgtcaacatctcgcttgtgttcagtgagattgcactgcatgtatgcatgatcacaacaattgagcagtaggttttctcaggggtggatcccaggattccttgaagatactccctccatcctaaaatataacaattttaaccctcagtatttgttccaaaatataacttctccatcaacattctcttcccaaccaattacaaccctccaccattcattttttccacctacctccactactcatccaatcacaactctcacaatttcaaattttatactaactttacgaaactactaatgtgtaatattcatattggattttatatacatgttagttattaattatttttaatatcaaattttagttatttctaaattatattcctatatggactctagatcgtctttcaatatttcttattttttaattctgaattttcgttatctgtaaattgtatttatatatagactctaggttcttcatccaatattatttatttttaattctgaatttttgttatttctaattgtatttttatgtgaactttaaactcatctttagatattctttaatttttaatttcaaatttcagttacttctaaattgtatttctatattgactttagactcttcttcctctgtttttttaaatttcatcatgttgggtgatcaagccgacaacgtccacgatgaattatctgttaacaaccttttctcaaatagtccagccgtagccgacgttgtacatgagataagtcgtcggccttcgttggtaggttgggtgtgacaactcagcatttttcgagagcgttctcgataatggggtgtacttgaccatatcctactcgagtgctcaattgttcctgaaaaatattttctagaagacaagatatatagcatagaatatcgagtatgtacttaaaaaactgcatgaatcttctagcaatttaatattctagtttttaattccatatttaattttgaatttcagctatttaaaattgtatttctatatggactctattatttctttttctctgattacgtatttcaattagttataaattatataccagtatgaactctagtcttctcttccaatattcattatttttaattacaaattcaactattttaaattgtttttctatatggactttgattaatatgaatttgtagcccatgagagagaatgtggagtctaattttcctattacttaaataagttaatggattagttcttaatccaattacacttgctctgcattggttgaattagaaataaactttgtgtatgtggtttgtttggtcgtttccatctcaaacttttttactccgattcctataccttactttaagcttctgtaaaaaaaagatttctattagttatataactattatattaaatctaaactgttataatctggatctactatgacgcgatggttatttaattttttctctttgtcttgattaacattggaatttctatttttcttgtccgttttcactttttttctatctttctcgtccgtttccatttttttttgtccgtttcaatttttttatccgtttacactacacccaatctaatacccttctttttttgtccgtttacacaaaacctaatcctaatacccttctatttttattttttcttattttctttcgattaacgtgagattttctagaccgtaagagtgaacgtggaggcttctttttctgttactttattaagttaatagattgaaaatgtttctattgaattcttttttattgaattcttttttacatcgctcagtttctgatacgtactatttttcttcggtatatttctatcattttttttgtctatcgcctccgtgatcgagtcggtctcataccctacacggtcgcatgaagatgcacacgctttacgcgtccacctgcctcttcacatattgttcacatgcaggggcggatctagaaaaaaaatagtagtggaggctgaataaactacatcagcataaatcgaacctccagtccccacatcctatggatctatggaaaaaaaatttagtgggggcttagggggtctccactgtcccggagacggtagtggggtctcaagacccccgcccccattgtgaatctgcccctgtccacgtgcccccattgtgaatctgcccctgtccacgtgtcttcattcagttaggcaccgattgtctcgctcgtcatgtctacggggccaccttcgcagcttcgctggatgggactattgccctgaatcatgcaacttcatcatgcgtgtgtgacaaaaaaaaaaatttcacggtatcatctatgatttcgattggatgttctctccacttctttttttttttgtgatttttagcacttatacatatatggatttacgtacccatcacattaattctttcatgcaatgcccgtgtgccaaatctcggccttttacttagcgtaataccagatcctcactgtattggtcaaggttggctttaaacctctatacaataaatagaccaaataaccatagtaaaaatatttttcgtcatacgacccacattattcaatacaagcaaacacatgatgaataaaatttaagtcctccagaactatatgatgtgcttttcccggagaaaacaagcagctagactactcgcatttcatgaatttcctctcagcttacttcctaatttgcctgaaatcaaccaacatttctcaatggcatctaacatctcttaatattttcttaaagactgcgaaaccactcttgagtaattgacttgatatatgggtcaaattacacaatgcatacacataatacaacgaatttgcatgaccacatcttcactagtctgaaacggctgcatgccagggctttacttttaccttgttcactgaaggtttccgtgtgtgtgtgtgtgtgtgtgtgtgtgtgtgtgaaaatatatat

SEQ ID NO: 13965 - DNA, 4580 bp, Oryza sativa
atatatatagacacacacacatatataatgtatcatacgtagctccatgcctccatgaatcatctgaagaaatcagggaaggaccacatgatgaacctggcgtacaaatcattctccaggaactcgatgtgagcagctctcccgatcatggtgttgaggctccggcgacggccatgggaggactggtcgaagctcacgtcgcagcgcatgaacacccgcgtctccgacgatggggctcggagctggtccaggcagttgttgagcatctcggtgaacacctgccctttcttcgagttatccgacgatgaggcagggcaggaatcgattcttgctgaatgatatggaacatacccatcctacagttagttaagcagagttatttgattaggaaaatatacatgtcagataatcagcatacatttgaaaggaatattttgagcaagaaggtacctgtggcgatgataccaagatgatgtttttgaagttatctaatgtattcagctgcgaagattaaaaaatatatataagaagttgagttcatacaggttaattaccctgtgattcctagttcagctctaattttggggaaattaattcttatagttgagttttgttactgaagggacatagagtagatctaccttgcatagcttgtaaaaaaatgtgttctggggatcttgttcatcgctgaaagtgagctggtgcatgcattggactcccttgagccttttcataagccacagaccagagttgaacagagaatttgagctgtaccagtaacctaagtgaggtccagatattgacatgtatgtgtagaggttcttcagaaatggttgcatcttggggtctgttgaatggaaaagaactggttagttagtcagacagagccagctacatatttggaagtaaagttggaaaaactacctgctagggcacttctgataataatgtttccaatggaatgaccaacaaagctaagcttcaaatctttgcagcctccatttcttgaatacctatcaattttccttttgaggaatgcaactacctcatttgatagccttctgcccatttccttaaaatctccacatgttctgtcttcatttgtctgagacagtaggcactcagctccaggatcacacagtatccattggtttctaataagccgtaaatccagatgatgtccctgctttcattcgagtgaatagaagaagttttcagtgtttcatcaacataatatatgagatgaaaaccatcgctacaagtctgaagacacttgcctgaaatccatgcacaaaaacgactgctcgcaatatatgcccaatatttccatcacagctaggcattcttgccacatgtttaccatttagcttatgctgtagagtagtactgtttgcctctgaagcacttctcaccaaacgcttgctagaaccatgttgtggaacaaccatgacatgttgttctatgtgaacaacaggaatttctgaaggattagcataaatttgcatatcttgaatgaaccgtgcattaatctgcagaatgatttgtgtcagtatccttttctttggagtaatgcaaattgtttcagttttcaacattgactgactaccgaccttcatttgtgcaatacttctcctatggagttctgcccgtgaagaagaattctgtacaggctacaaatatatggaaccatcaaaacttgacaggaaaatgctactaattaataaaagagatggtaagaaaagggcagatagttcactgtaagcatcaagacaagacaattacatcaggatgcaactttcttgaactggaacctctcagaagtgaatggcgaggagaagacttgccactcaaactgcacaaataacgatgtggcatgtcaacttttgaatgaacaatccatattgaccattctgattttcggtcagcatcccaaatattgcgcaagtgatccaatatcttgattttgtttgccctgcagtaaatctcaagactttggtcggacagaaaataaaatgaaagaataagaacagtaattaacaaatcattacaccaacacattagagaagtagccaatggctatcttgattctaagacaaaataaaaaaaccacagataacctcacctatgaaatttcaagaatgcattccataaaaatgaaacttgatcgctcacagcttgaaataattctaacaaatcttccttggaaagggtgtacagcagaatgtcattagtgctccgaaccacattatcagatctctggaattagttgtaaaaagaatcgtaaacagttagtaaaagtatcatatgtgacaaaaattgtcacttttgagagaccaaatcaagtgtacctctattagatcatgtaaaacaccagtaagatggccaatgcacttcgtgggtatatagagccctttgctatatttaggcaagcctgcctttgatgaatcgatcggctcatgtttaccaagagttaaatcagcatcatctaaatcttcaagagttttaccaatgccagcactcatcttcatcacttcctcaagcaaaatttctctagaacttaatagtgcttttataatataacatgattttgagcataaaccttgctcagatgcctgcatattggcagcttttagggataataaatgaaggcaacatgttcaggtcattattttttaatatatgaagtcgttgactttttagataagtttgaccattcgtcttattcaaaaaatttatgtaattatcatatattttattgtgatttgatttattatcaaatgttctttaaggatgactttttttttcatattcgcacaaaaaaaattgaataagacgaatggtcaaatatttgtcaaaaagtcaacggcatcatatattaaaaaaggaggtagtatatgctcagcaccctataatgttgccaaatttatcaaatgttctagcaatctcagtctctcagacaagcttttttgtaaggtcaccagtatggcagtgtctaaaagaatattaaagctaaagtatcacaaacctgtgtaccttctgagacgatttggtcacaccagcttttaggtacacgatatgcattgttagatcaacaagcacagggtggaaagcatcaaaatggacaggaaaatatgcgtgtaaacccaggagtgctttgtatgggattctaaattcatgcactgggacatatatgtcacttggatcttcaatctcagtcctacaataattttttttaaaaaaatggaagcagcttcagtactgatgaatggatgttgattttgtaggcacacaagtactccccaaaacgaacaatataatgtgaacaccaaaataagatggaaagggaaagcaaagaacatacctgtcttccaatgttggaacatagatgagctcaaattttaatattacagacgaggttgctgggccctggaatggagaaagcagaagttcagaccagccattgtaaacataattcagttaggaaaagaaagttaagctaacctcatcttcggtgttgggtatgtagaaagacaccataactgatagataaatatcttgtctagaatatttaatctggaatggttgtgtatagaagctattgtcaacgtcatctattttccaaaggccaaatgctcccttcgaaccaatatcaggaactgcacaatccacctagcatgtcattatgtattagccaaagattgacggttcaagatgatactatacaacagaaaaagaaagaaaaacaagaacatgaaaaatccaacctaacacaattgattgtaattgccaacaagacagctctgatgcatcttgaattggttttagttcaaaccaaactaatcaacaacagatcttaaattataggtacaagtacatgattgatgagcaaacgtgcaaaatatatagcacatatcacatattgccatcacagaataggtgcaagaaatgcacaaaccttcatattgcacgaccctggcaggagatacgggcgccctgtactcatcctcctcccacgccgcactaatcttcagccggtaccatctgcacccaaatagcaaacacaatcacatacacctcgatgaaactgaatcaaaattgcaattcagagatagattttcatcagattcataaacagacagaacaatcaaaatcgtacagaataattaggttcaagtctaaatttccaaagcccaaattcatcctggtagaatcatcagcaagaaaggtaaaatttctgccgttcgttccttacccttgctggaacaggtcgaggttgtggaagcggtcgatgtaaatggccacctcgtgcgccgtctccatcacggcctcccacccaccccgccggcgacccgcggccggagaagcttcgcctaccccgctccgctccaccaacgccggcgagatcggccacctcccacctctccctgccgcgcctccgcgcctccgcgcggccacccatttaccaccttcccctctccctattcttgtcttccaacaatgggccgcaccgcgcgcgtcaaggcccaacaacccattcgcgtattgggccgcgcccggaggcccaatactggagtccgtaa

SEQ ID NO: 13966 - DNA, 5271 bp, Oryza sativa
  unsure (1)..(5271): unsure at all n locations
caacggcgccgcccgcacgaccgcctccccactgccgccgccgctggcggccgccgtcgcggcgccgccctcctcctttcccgcctcctcctccgcgcctccgctcgcaagccgcctcgccggccgctgctcagccccgcaaagaggagaggaaaaagaagagaaaaaaaaaagaaagggtaaagagagagggtgacgcggacacctgatatgtgggttccacgtgggtctcttgctgactcagccgccacatagaccaaaaccgaggtcaaaaccaccgaatgacctcgggtgaccggttttgtatagttaagggaccccgaatatctggttttgcatttcgaggacatttttgtatcccgatgacaagttgagggaccttcggtgtactttttccttttggttcccttcaactatacccatagtttgatttttttaagactaaaaaaatgcccgtggatgctattttaatttaattattattatacggtttagttagggtgaaatttattgtgggaattcatttggatatttttttaagaaaatcataagttgtaattaggaggtcgcatttcatctcaagttagcattcgagtttttttaaagagatttcttatatgacttcttttgtatttccaaaagcacacgagcttaaaatgcaactcaaacatggatctatatttccaaaagcaaatgaacttaaaactgactcaaacacggataatgtaccaaaataccggcaaaaacattttcatgttttataatagtagagatagagatataacgggtagaaatccgacctctatatccataattggatttacacagtcaataccctagtttgattgttgtcaagaccagatatgaagactcccctcaacccttaaaaccgtccaattcaacttcccaggaggttttcagagtggttcggtccgatgtgacgcttatatggcattaaattacagtaaaataaaattaataaatgcagtgaactccacacatcagtgaaactcctcgtttccccttcctccctgtattacaatcaaactgtagctatctttgagggaggtaaaataaacattctcccaaccgtaaaccaaaccatccgcgtaatgggccgcgcttgggggcccaacactggaggccataataaaccctcgagaaccccctccaccggcgccgtcgccgccaccgccaccgccttcccctcgatcgccggagcggcgagcccacggcggcgagcgccgcagccatgtcgcgggctctcctcccgcgcggcagcattctactcgtccttcgaccgcgagtcccgtccacaccccaccgatgcttcgcgattggggcggcggcggcagttgacggcggcgagacgtggcgggggcaactccggcagggggagggggaggggaggagcagggcggtgaaggtgtcggtgtggtgggacttccagagctgccacctcccgcagggcgccaacccgtgccgcgtcgccacgcgcgtcacggcggcgctgcgggacgccggcatccgcggccccgtcgacatcaccgccttaggcgacgcctacatgctcccccgcgccgtccaggaggctctcgccgccaccggcgtcgccttctcgcacgtcccttccagtttcgtcttccaaacccatcccaatttcgttactcatcgaagtgccattgtggaattaattaatatctcttgtgttaatggaattaaggagtgatattacttcatgatgtagagagtacatatcatagaagaacactagttttaatgcttttcaatttatgactgacactgattaggctatatatgtcaaaatgatcaccctttttactgattctaattgattgcgttggggttatatccggtgttggattgggtttgtggggtgggattggaagaaacatcctgaattcttcttaatgatactctgctctatatgatttccaatatggtattgagtttgtgctaaatgtgtaagtatttctccaactgttagcaatgaatcataatttttcattttcagacaaatttgcagtgctttggattgttgaaacttgcaaattaaccactggcatgctttaaatgttgtgactttcatgtttaacgaggaaatttagagcagcttatatttcacttatctgatgctgctacttcgttgcatgatattaataaatagtttgatattgtaggtggaaagggcggtcccgaccaattgttcatggctgatctgacctattggattgctcagaatcctccaccggcccatttcttccttatatctggcaacaaaggccttgcaaacattctgcatcgcctccggatgagcaattataatgtactgcttgcctgccccagtgctgactctagtgtattgtgcagtgcagcaacgattatgtggccatgggatgctttagttaaagggttggatttctcaccaaaacattttaaccaaccacctgatggtatatccttttcttggtacggtcactataggggaccccttgatgacttgttcttgaactcagagtcagatgactctatggcagagtcagaggactccctggcagagtcaagggactccaaggcttttcaaccacataccaagtcagtgaaaccacctattttacccaaatctgtggccaatggggttaggcaagtactgtactcctttcctgaaggtatcagtcttccaaatcttcgagcagagcttagaaagaatcatgtgttcatggataaaggattatttggcttcaaaaacttctcttctcttctccaagccatgcctgatgttgtgaagtttatagatcctctaccaggtgaaagaaaccagcctgctgtggttggggtttccaagagatcaatggagcctgctgagcaaatttacaagggaaagagttctgctcaaagcagtggtgagttcaaacgcctcgttcagactcttaatgagaaaccaccatcatcacatgtcccatcttcttcatcagatattttatctgcggaccgcaagaaagttctagcagttgatgccccatcttcccaatctgacttgttatctaggaaccaagagaaagctccccctgttgatttgactacacaacctgaaacacctgcaagctgtatggaagctgatgtggagagtgttgctggagcttctgcctttacaggagagcaaattactgttgacaaaaaggggctatttgaaaggatttgtgtactatggaatgatacagagcctgttaagcctatgctttctccgtctcaagatgatacccattctaaaggctccaatgatttactaactcagtatgccaatagtaacgaacataacagtcttttgacaaggaccttgaagatcttttccacaactgacaattcagatggagacaatgttgacagcacttcagcaattagcagcagtttctcaaatatgactgccaatgaccattcggacaaattaaatgtcaaggagaatgtagggaatacgatcatccattctagtagatcagttgacacgagcaacgctgaacataaagttgggtttatagaaaaaagcaaaggaatatttagctgggctgcaaagtggtgggcgtctggaaaaccagacacagatgacaatttaagttcagtacatatcaatgatggaacaagggaagaatcagaaaaagaatctgcatttgtaaagacagctgctactgcaagtgaacagcaagtaggagttgaactgttcatgaaaccttacttctgggatgcactacagcaatatttgtctacccctcatggatcagatcttgtttcaaaagcaaagacaaggtattctgcttctcaaattacttttatctacatatataaatgtttctactttgcctgcaattctatctttagcagattccaacatgcacagatagtaactgtagttgacattgaacaaaaatgccatatcctaactacaagtccatggttctgattgcaagctgctcttttactatgctaacagcaagcagaaactaatctcttgcagcacaccaagagataatcaaaatggtaagaactgaatatgcaagcatgcggggtgataatggctgctggctgtgatcatattcaataattgtagttcttatattttactttataattgcactttcctcttcaagttcctgattttattctatattttgttaccaatgcaaatcttatcacagaagatacgaaataaatgcagtcttaaaataaatgatgactcaaataatttcatcttttataattcttgttcttaggtggacatggacccaaatgtctcacctcaaatataactagaatcatttctgagtaaagcttcactcaacctagctgcttgtttttgccagggaggagttagcgcatggactacagaagcaaggccattggcctctaaaaagccttggtgggaaacaccaccaccaattagtagatttgcttatctcagaaaagcaatggatcaaagaatcttcatcacaaacgtctccttttcgacttgccctcccccagagaagagctcgttctccactactttcattttttacgaatggaaggccatcaggccagcgtaaacatgtcgatgacagaagcccaactctgtctagaacgtcggtccatgttttacctacaaaaaatgggaagggtcaggccagctgcaagagcaatgagaatcaaagtaagagtgatgactttttggagaaagagcttggtccagtatctgacagtggtaaaccatatcgacaaaatgataaagcagtccggcatcatcctcctacctgttcagatgatgaattttctgatgatgaaaatcatgaggtggtccaagaggctgggagagatgcagcacaaagttcactcttcaaaattattgattcgtggaacactagtaagactatttgttctagcaagaaacagcacggcattggtggtatagtggactgctctagaatcaacagaggtaatggtggtgacaattcgatcacagaaaatgcagaaaaggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13967 - DNA, 378 bp, Oryza sativa
ccgtcccctccaaaaaaaaaatccctcgtccggaacgtctgagatgagagtccaagacaaaaagaaaatcatctagagtccggatcaacaaccaaatgcacgagtgattcagcgaaaattcatcacaaacatagatacaaaatccaataagacaatcaagtgaaagaggaaaaaaaataaaacatcaccggaagccgccgccaccgtcgtagccggcggatccggcgcgggaagccgccgccacacgtgtagctgtcggggccgccgaatccaccgtgggaactgctaccactgtcgtcgccatcggatccaccgcgggaagcaaccggcgccattggtgccaccggatctacccgccgggaagccgccgcattgaga

SEQ ID NO: 13968 - DNA, 7257 bp, Oryza sativa
  unsure (1)..(7257): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggctccattaccccatgattagtttaacactaatgaccttaatgaagcttttggttgtaatgtaatgtaaatgtggtgtggtggtgttgggtggtgtgggaatgaatgaaaagacacacaaatgcaacacaaatgccaaggagaaaaaaggggatctttatgtgcggttgcagcatgggcgattgggcatgcagaagctatgccatcatgctcccaatcctgaccttctgatgagaccatgtgatgtgatcacctgtttctttccttctctgcattttattagccatggattagaggagagtagaaagatcacctgttaattgaatacttctacatttgtggcaagaatgcactaaaatactatttctgaatatttctctccctctctctcttaagttttgtttgactgaatttctgcaatgtcattgtttgcttttcagcttataagccattgtcagaatttgaattttgaaattgactttgtggctttctcattgtagtttctttctagcattttcttttaaaccacgaatagcacagatattgaagttttgcccacaaactattttgtggttgcttatacgctgttctatggtttaacgatcaaacttctgaacatcattctgaatgtgacagttccgaaattcagcaggaagaatgcttgcaatgcaagatgctgttgtgatctcgatggcatgattggtgcaggttgatgtggattagtttggattaatcccagcatccgttcttagcggttactgtgcagtcaaaagagtgcaaattaaagatgtatattagagagagtcaagtaataatgcagtgtagataagatcttcagtttcgcctaaaaagccctgctgctgcactgctcacaatcattagcacttctgtacgtagatttcttctttggaagatcattagcatcgcagattcagaaacggctaatctgtagcatagctttgtcattcatagctagtcttgtcagtctctgcgtgatttggttcggattggcgcacgcgatgatgattggaaagtgatttggaaaaaaatttggaagaaataattccactgtgatacgatcgtcgtgtgcagattttgtggggagagatcccggccgtccacagatcaggaacggacggagaccagcagacatgatccgcgatgcgaggcagcgtcaatcaatctcggccgttcatcacaagaaacagacggtccgcatacttccagcaggttctgcgtcatgcacccctttctggccccacctgtcagcgtcagacgccacggcccttcttgtgacacgtgtcgtgttgacgcacagctgaactcgacggtttttgatgatttgatgttgctagacccacgaacctacttacaggtaaaggatcctattgtttggcttattggtgaaatatgccgaataacatatttacaagcgaaaactaatttatgaataaaacttttatatacgtgttattagtgatctaaaagcaatgcctaaataataaacttcgatgagtgaacctcaaaatcagattcaaatttaagtttgaaaattcaaaatttagctgataagcataagcataaacgaaaatacgaggccgaaaatcagtgggtaacccacgggccacgaattgacatgttgtttacttagaattaattaatctataagtgggttcacgggtcgaaccacttgcatcctcaggtacggcaagctgccacgatatatgggaaccggtgggtcactcacttatctgacctataaatgggttcgcgtgtcggtccatttgcatccctagctgccacatgcacccgtgaattgtatccgttattatatatttattttttatctatgaatttggacattacacttatctagattaataggagtagcttaaaaatattatattttagaatgaaggaagtattattttagaacattgaagacttttaagttgtgatgttttgacgaactaaatagttatatttataataaaagtattctgataatatgacatcttcgacatattgtaacttttctttctaaaaaagtataagctattaaagttggtactctacatgaactgtgtctggtgtaagtaaaaggaacggggagggagtatattgtaatttaatgtataaatgcctttgacaattgacatttttccccttcatgccaactttaatttgagaagagggacaaagtttcaaagaaaaactaaagtttttggcatatgttattcgtcctcctataaagaaaagccactcgctcgcatgtacgcaacaaagaacatttgaacatgcatgagcgcgcgcttccaggttccagcgattagtatacgctaattgcatgttagtatagttcatcacatctgagacccagatcagagaggaactattaatttggaccagatactattcactactagtatagtactccgtagtggttaatcatgcatatacctgggctctgacaatacaaatcatgttgtatttgaacgtgtatgcaataatgcatatactggcaattccacgacgagatacaatcatgctgtatttgaatgtttggagcgcgagaaatctctcttactatttttttttacgaaaactatactattttagtgaaattactgtatttcaaataggatgaaagaacattgagttcatttaaaattatagacaacattgtccaattttattaacgcattaaaaatttatatttgtactgtaaattgccaaagggctggtttggtttgaggcctaaattagacttaccaatatttggcaatttcaatagtgtttagtgtctatttggtttgaagccaaaatttgacatgcctaagaaaataggccatttcaatagtgaactcaaactattttggcttcaatacaaacacaactttgccttaccaaaattagtcatgctaaaacttgctaaaatttggcactgacaaaatttgataaggcctatttaggccacgaaccaaaccaacccaaagtgacaaaaactgttttttatgtacaagtttatgggccttctccaaatccggcccagttatatgtacatgggctggttagttattttgaacattggccaactttgtgggcttcctaattttttgctggtagtctccttccattcacgaatgattttgtagggagtttgtcaacatggatgccatctccaatgttgtgtatatcttgtaaacatcgtatatatgtttcttgatgaaagcagtaatgttttcaatggcgtgtatatattgtaatcatcgtatgttgcttgatgaaagtagtagttctttttattcaagtctgaataattgagctaattaccaaaagagaaagaaatatgaaaaataccatcacatataatagagatactacatgagttacacaatacgaatcatatgtcgatgacacattatacaatggtattttagactctgttttttgcgatggtattcggagtattgagcaaaagagatgccatcagattcaggcattcagctagccaccttggtcaacgagcacgctccagaaatgagccgcacatcgatatcgaatgggttaattgcatttagatatccagccactagcgactgtagctaggagccatgattaagcatatgatacatgcacgcaatgcaaagtaattaatggaagagagccacacatgacaagaacaaagcagaagcacatgcggatgtgtcgaccgatcttatggtgacagagacatgagaatttaatcagcattattgctcgacacacatatatcatcatttcaagacgattgtcaattctgaatgttttaaaagcctaatgtaaatttacatcaatgttcagatcatcatttaaatcattttatttacaaatgccctagctaaattaataatggttcgtgggtacttaccatctatggatcaatggctcatacacatgaacaaggtattcagaagattgggaggtagatcgttcaaaaaaaaagaatattgggaggttatttggcaatactaggactaggaagttcaaaagcatagtagttctagggtataagaaccacgttcaagtcgtttgttggtagtgtcagccaccatctagtgaagctctgatgactcctgtggtgtcatgaaaaccgtagacttatcctcctccacgtgtctaacaaaagtgtctcagaataaatgtgttgtaatataattaatatctagataaaaactacgactacctctgcttttaaataaagggtgatgctccggtgcactctacttgcagtattctactacaagtagaattaatctcgaccgtttatttaaaagggcaggtaagtaatctcctaatatagtttaggggtaattttggcatgggatgttttgttcggttcgcatcacatcaggttcggtggatgggcacggcaggcaccacaggcgattgctgcagcatggtgtcgtcgtctctcgccggcaagggccacagcgcggtgtacaccaccgacggggcacggttcgagggtgccattggtgtacctttgcacggtggttttcggcgagctcctcgccatgtctcaagaggaatttggcttcgccggcgatgatggcaggatcacgttgacgtgcgatgcatcagtgatagagtacgtcatgtgcttgattagcagagatgcctctgaagaggttgagagggcgttcttgagctccatggcaagttcttgccatagtgtcgaaggaatcagccattagttttccactgtgtcggagaatggcgagctgctcgggatcggatgccacggccggccgaggtaggtctccacactgctgccggcgggggcaccgcggaggaggtcggtgtcagcgtagatgctgcagtcctggaacgagaagcctgtggcgcgggactgggcggtgatggtgttctgctggccgcggagggggaagcgtgcgacgatgtcgcagtgctggaagacggcggtggcgtcgccgaagatgagttagatattgataaattatgataatacccctgcacgaattattatccctgaacgaatatacctttgtacatttctactaccactaactctggtgggagtagaaatagatcacaaccctacaattaaatataatgaacggctcagattgctttctactccaagtagaaagcaccggagcaggactcttaaatatatgatgtgtttgactcctgatgataataaattaatttgattattcatcttattaaaaatactactatatccatcctgaaatatataatataacttagctatatgtatttgcataaaagtatgtccgtatatatagctagaattgctatattttaagatgaagggagtatgtaaatatcacttattttatcattaaatatacttcaaatatgacttattcatatttatattaactttttaataagatgaatagtcaaaagtcaacaatttgtattttaaaacatatgtagtagtccctccatcacacaaagactttattgttacctttttcatttgtcccataatgccttcatttttaagacagttaatacatcaaagtttggaaaagtgaaacacaaatacattagagatttaaaaaagcgaggaacaaatgtattggagttcgaaaaaaatggagagcattttagtcttttgactttatattggtatgtgtgagataggaaaataatgaagtttttttttacagaggtagtagcaccatattactatagtatagccatattaatataaggccgatcgatatacacataatcatttaaaaggcgatctcacggtcagtcaaggtgcaatggccctttcatcaatcaggcccatatggccatatgcataatgcataatgctggttagcccaaaagtgatgaattcaacataagctagctagccagccagctctgccttcacgtactcaagccagctgaaagactcctgccatctctctctctagatcgatctcaacatgtgtaatgatcatgccaaaattgaaattaaaggaaacttgcaaatatacctattacacaacagttgatctatcatctgtgaacgtccttttgatgagatggtccgaaagatagagaaattggggcacctctatgcatatgcatggtcccggcagattcagagatgaaaaagtctcagaaataaaggtagctaggccaccatgagatcgagggcggccatgatgagagagattaagcttaagggtaccattatattatattgcacctttagtttctttagtaaccaacagctaactgcagctccaaaggtaatcatgagatcacacagagttggaagctaccaagcaagtaagctcagttgattgattattcttcactccgttccaaaatatagcaacgtaatacaggatgggatacatctcgatactaagaaatccctattcagatttatattactagaatatgtctcattttatattaggtcgttatatatttttaaacggatggagtaacgttcatgtatgaagcataggtcgtttgtgcaatatatatgtatgcacatatatgaagccaattacacaccggcctagctagctattcggtagacattgttgtttcccccttttttctgattgctgattataatatatattccaataattaagttagcttggcagtttggtgcaagtcaaaaaagttggctgatcttcatgaataggctagaaatattccagacattagttaggttggcactctcaacacattgcaacttcattttcattctactgtgtgttgggctggcctttttatagtttttgatatactcgatttgtaattcacttggttaatcagtctcctaagaatagtagaatcgtagagctatttttagatctttattattattaaatatcattcaatgtagaaatatatacgtagcaattactccctccattataaaatataaagatttctaggttgttta

SEQ ID NO: 13969 - DNA, 17990 bp, Oryza sativa
aaataatacttcctccgtttcacaatgtaagactttctagcattatccatattcatttagatggtaatgaatctagacatatgtatgtgtttaaattcattaacatctatatgtatatggacaatgctagaaagtcttacattatgaaacggagggaatactaaataagagacactttggtgtttttcttcactagtaaattttcttagattgcttagagaaatcaagtctttttagacgtatagggagtattaattcctgtctgagtaatgaccaaattactgtagatattacaatactcccttatttcataatactttactaattttgattggctttgttttattttgtccaccgctgacttataaataaattcaagagtattcaaaacctaccatattattgaagtatgttagacaataaatatatccgttcatcataacaaacgatttgaaagttcgtcaaactaattaaaagtaaaacagtgacaatcaaaattatattgataggtatagtgaaacagagaaatggagtattagccgttccgtattataattagtcgtttaaggttcaagtttgacgaagatcatagaaaacgcagtaacatttataacatcgaataagtttcattaaatccaatatttccgttgtatatttgtcttgtgttgagaatgctgctatatttttctatataaacttgttaaaaattaatgaaacttaatttaggataaatcgaaaacttctttttcttacacaatctaaaacgtcttacaatattcataaaagagggagtatcgaaaaactaattaagtgcgtatttttcgtgttaattaactaattaaggatagaagtggcctctgtgcgcatgcatatcttttgcaatcaatcgagatgatggccgatcagtgtaactagctgtcgtgttgagatcttctatatatcgtcggccaatgataaggggacatccgtgttaggaaacgatagacgaacaaacgataaaaaacaatagatcaattacaaaagacatgagatttaacgtggaaaaccctctcaaaacaggagaaaaaaaaccacgggcgctagccagcaaaatatttcactatatctgaggtgaggttacatcgccgcacggcggcttacaagaggtatatatatagtggaaccctaaaagggatgatgatccgtacggcagaagctggcctttattaagtgtaaatgaatttggatcacaactcaacaatccggacatgcatggatcgttgatcattggccaactttgcatgcatgggccacgtctcctagtactaagctccaaccgcatcgatcgatctggctagctatctgctatagagatcaccaaggccggccctggggcagtacgaacggtgcgaccgtaatgggcctctaaaaattaggggcctccaaaatatgtatactatggtattaggcttgaaattcgttaatgacaatgagtttttaaatattatcttgtttttttatggtgaatgggggcctttattttttttccgcaccgggccaccaaaaagtcagggccggccctggagatcacagcaatatatattatcagaaatgattattcagaagatatacatacataatctgtacttccatgtctttgacgactctctgtctcactgcctagccaagccatgcagtagtagattcagagagatatagcaaagatctaaataaactagacaaaactctaaccctttttatatatatgtatgacaaaaagttttagtgagatctttataagagctctcataattctggtaccagtagtggagactcgagcccttgccgtccttatattagatcatcccctggagccatgcatgcagagataatatatacactaaactccgatcttttcatacatgaatatattagtagaaaatcatagctcgtagtactaagaacatgtaatattccatattatgtttatttattttggagcacaatgaacaatcagaatatttatatatacaatagatctctcctacgtatctaaacctaattggtacttgctaaaaactggtcgtacgtacgttaaaaaatatctgaccattttagatggatcatattaacatgatctatatgcatttaacttttcaggtcatgttaaaaacttatctattctacatctacatattgtgggagtttatacttcatgatgaatgtttttttttataatgggaatttataaaacccggcttcaaactggatacaacggggtttttattgattccaaattctagactaagcaaaatgtcggtaagctacaactaagattacaaactgagtacaactcaatatttattaattcagaattatgaaaccattcagttttgctatataattgtcgataaattttcttctagaaatttaacatatataattatagtactatcatgatataattacattgtaatttacatataactataatataacttgtacgcaactttcacaaaaaatttgaattggtagatttgtttcaagattcttaccggcaaggaaggaaaaaaaatcaaattgtgcgtacatgtgagaggattcggttgacctccatttcacgaaaatagcatgctacgaagagatttttaaaagttacatacaagtgacattgtagttacaatgtaattacaactcgattgtaccataattacatctgtcaaatttctagaagaaaagttgtcgacaaatgtatatgtgacctcaaaaaattaaaaaaaaaatatttcaaatgtcaataacaatagctgtgcgacacacggttttacgactatgaaatacaagaaagaagagatcgggaatacaaataagctcagatatatgtgtagttgttatcacttgtttatatcagtggcatggccgctcgtgtgctgctagctgcatgccccatccatatattgcatacatacacacatgctagctactctcatcactctaaattctaaaatacacacgacaagacagtacaaatcgacgagcgtcttctttataaatcaatagccagcctgcaccacagcctgtgcccatccaattaactacaagaccccagttcatccagtggatcgatcgatcagagctagctagatcgagagatcacaattcagaagcaaatcaatcaagcatcgatcgatcgatcgacatggcgtcggagaaggtggagacgatcgtggcgggcaactacgtcgagatggagcgtgaaggcgccgccaccgccggcgaaggcgtcggcggagccgcggcggcgtcgggcaggcggcgcggcaagctcgccgtctccagcctcttctggcacggcggctccgtctacgacgcctggttcagctgcgcctccaaccaggttcaatccgtcgtcatatgacatgacatgacactctcatggcgatcactacgatcgatcttgacgtcatcaatggcgtgattctgtgcaggtggcgcaggtgctgctgacgctgccctactccttctcgcagctgggcatggcgtccggggtggcgttccaggtgttctacgggctgatggggtcgtggacggcctacctcatcagcgtgctctacgtcgagtaccggacgcggcgggagcgcgacaaggtggacttccgcaaccatgtcatccagtggttcgaggtgctcgacggcctcctcggccgccattggcgcaacgccggcctcctcttcaactgcaccttcctcctcttcggctccgtcatccagctcatcgcctgcgccagcaacatctactacatcaacgaccgcctcgacaagcggacatggacctacatcttcggggcttgctgcgccaccacggtgttcgtcccgtccttccacaactaccgcgtctggtccttcctcggcctcctcatgacgtcctacaccgcgtggtacctcaccgtcgccgccgtcgtgcacggcaaggtggatggggcggcgccgcgcgccgggccgagcaagacgatggtgctctacttcaccggcgccaccaacatcctctacacgttcggcggccacgccgtgacggtggagatcatgcacgccatgtggaggccgcggcggttcaagatgatctacctccccgcgacggcgtacgtgctgacgctgacgctgccgtcggcggcggcgatgtactgggcgttcggggacgcgctgctggaccactccaacgccttcgcgctgctgccgcggacgccgtggcgcgacgccgcggtggtgctcatgctcatccaccagttcatcaccttcggcttcgcctgcacgccgctctacttcgtgtgggagaaggccatcggcgtcacggcggcgccggcgtgctcccccgcgcggcggcgaggctccccgtcgtgctccccatctggttcctcgccgtcatcttccccttctttggccccatcaactccaccgtcggatccttcctcgtcagcttcaccgtctacatcatcccggcgatggcgcacatggcgacgttcgcgccggcggccgccagggagaacgccgtcgagccgccgccgcgcgcgctcggcggctggccggggacgttcgccaacaactgcttcgtcgtcgcgtgggtgctcgtcgtcggcttcggcttcggcggatgggcgagcacggtcaacttcgttcgccaagttacaacctttggcctcttcacaaagtgctacaagtgccctccaagacactagaattttaatttttttgaccatggttaatttcttgatgagaagttaattaatcctgctacctactgttgcataattgcattaatgcacagagagagaagaaaaaaaaagttgagagattgcatgcgagcttcatcatctatcttaatcttccatggcgatcgagctcatggcattgttgattatgattagtgtctgtgaggagagagattaattcctgtatgtatgtatgtatgtatgtgtgtatgtgtgtatgattgatgatgatatatgatggatcgaattgaactatatgtatctctctgaatcataggtgtgatgcatgttcagttaggtttttttttgttggcgtttcatttctttcctaattaatttgatagaaatggatatagcttctgtgatgcaatgttgtgcatgcctctgtcttttaaacaagtattggagattcagattcctactagtaagtgaacaagtattattgcaagcaagttttcaacttttcatgccgtggcagtactcaatttagaagtgcacatatgtttgggtgtatcaaatcaaatggtcctaccaatacaccaatgctaatggcctcctttgatcctttacaatgcagagacatccaatggtgctgatgatgctgttaactgatgatcatacccacatccctcaaggacaatcacacttgaagaatcacatgactgacagagagggcaaaaagcttaatctgcatgcagtctgcaagctttgcagatcagaggaagaacctgcatgcaggcctgcatttgcatccatgcatgcaatggtccaccttttgtcccagaaaaggtgatactgaattctaattacaaaagggtaaaggaagataagtatacatcaactgaagctgatgctacaaagctgtggtccatgtccttactgtgatgtgaagaaaggactagcttggagaccatatgtgtgcatctagtcccataaagtcatatatgatatatgatatatgcatgcatggatgcagccacaggacaaaggaggtccaggactgaataaacaaagtagtaattctcagcttctcatatggttgcatcatgagggctctgtagtttggatctgtggtaagattttaggataagttaataagaatcctaatgcattgagccagctaactgggcagttaaagatgttgcaaggtcagaaatttccagtttttcagacgtgttaaaaatgttgcagttaaaaatgttgcaacaattattccaaaaaaaaatgttgcaacatctgaaatctgcaatgcaatgcaatgtattggatcatgcaccatcagcaatgtgttaaattttttttaacatttttaacacattgcattgaaaatttcaggtttatgttaactgctcccaagatttcaggaaatttgcaggtggggaacatgagatgacatgaaacacattgcattgcatagaaacggtataatatctcaaactctactgttctaatagaagaaaaaaaatatccacaatgaaacaaagcaagaggcattattgagttaagtagcttcaagtgtctgaattgttcttcggtcagagcatggacagcttccatgggcacttgtcagacaaacacctctctctctctctgcagaaacgctaacagctagatgacaacggattgtgggaggaagacgaacaccaaacaggaaaacactccacggcatgagctgccttccatcaccacaactgtttcgatcggatgggttctgaactctgaacatttctgaagaaaaacgaacaaggagttgctgccaaattaatcacccctagcttagctcgtctctaccttgagctcaactgtttgttcagctagactccagatgccttggatcatgtgccgtggcggtacgttccggcctcggtagccgcgccgtctcctcggcgtctgtagcggccgtcgtcgcccgccttcttctccgtctccggtgggccgtccggggacagtgatcatattcagcaagctggatgcatgcaatgccagtgcagtgcaaaacagcaaaagttcagagatgcagcaagagcctacaattttcagacttcacctccttgtcctgatgcctgaacacactgtcaacaggaaaattcctttctggtgatggtgatcagtgttctgttgcttgtgcagtgcaggatgattgagttgcagtagccatggataagatgtggggtttagctctgaaaactctgaagttatgtgttaaccgtttcagattagtataggctgctatatgatcctagtaataattagggaaatctttagtctttaccatcctttaaaaaaaaagtatcggaagatattatatttttctaatgaaaaacttggtacctatagatactaggtatcttgaggtataaaaatttttagtgtaaaatttctctactaattaacaaagactttttcaagtaaggtaaaatttctccactaattaaccttgccagagagaatgctactgctgcaagactaagaaattagtagaagaattatcatcagttgattcttatctcaatcaaaatgacaatcagaaagcttgttagaccaaataacttggtaatctgctaaataacctttttctctctctttctgtttgagaaagaacatcatgttagctgacagaaggagacattgcaagaaccaaaagaatggaaaagaacagaatgcatcaacgaaatcacaggatacatagcccagttgcagagaacgccaacaggaggcagcaagagcaagatgctttataaattgcaagaaataaacactgcagcaggaacaagcagacatccctgcatgcatcttcagtgcatccatccacgagcactgattatttagatcctgacatgtctgccgttccatggacacacaaagaacaggttaaatattttgattagcccagcactaactaaccacagctgttgagcttaagcctggcaggtacagtacatgccaagcaatgctacaagcactagcattttcaggccagagactgcagggtgattaagcaacactcccagtgtctctacaagtctaatgtcagaattcagatctaggagaagctcccttttttctcaagtacgtgtcagtgtgtgtgtgatcatcttttttcttttctgtgacaataattgagaagggtccaatctgcaatatgtgaaccccaagattcctcaggtaaatggcaaataggaaagcttaatggtagaagtggttcaaagttcaaaccaacatgcatacagacttgtcatttccaaccatgccactaacatccaaagacacacatattgaacaataccactgtaaagcatatattaaacaatattactgatacagctcaggataacaaaatgtaacacaaaggaatttgttttgtcccgttattcttggaatactgggccagaactatttatggattattcgcgccacactttcaaaagtattacttaggctacttattctaagatatacttgttaggtttataaaatataattatttgattcatttcctataaacaaatcgatcatccatcatcctacatccgcatttcatctagaaagaattggcatcgcgccaccccaatgttgactaagtagagctcaagttttatttgatggcttgcatatccatgtttcttaggttcaaaggaacaagaatgttcaacaaaattggagcccttttgatctaccatgaatgaacttcaaatgcatcactatatccaagctgaaagccatcacaaacctccttaagctgcatggctcaccaataatgccactgaaaagctgaacttctccatgtccctcgagcattggaagatcacatctgacagacaaatcaaaaccactgaccaattctgatatggcaacttctattgttgcctccactcctctacaaacaattccaaaagacatttatgtatcttggattatgaaagctgccattaatgttttaccagaaaatgtagcctactaaaaagaaaggccaattacacacattatgatatgtttattttttttctggaacataacaaactattcctaattttatttgcctttttttgggggttgtgatattactcacaagtcacaacatagtgcatgtacacttcagttcactgaactgagtaatgatgttctttcagttacaatgctgtacctaatttgacagttctcctgaccagtgaacaccaaagattttcgaatcaacagcaaacaatttacatagattaaatttacatatggcttctgaacggaagagcagctacttctaggagcaagagaacttaagacagaattacaccttgttttgagtgtttactgtgtagtcagcagggtcacttcatatttgacttcacttgcaaatacagtgactgatccaaagcagtagactccagcttttgagcaaagcatgaatgaatgtccagaagatgattctcaaaagtcattgttttcaatggctgtcctacaaaagacgaactgtatcgctgcattcagttgcgattaaaaatctgaagagcttatgaattgaattgcctatgcttgctgttggtatcatcaccaagatacaatctttagagtttcagtatctgaactgccacgtttggagaaagaacttccggagaaatgatctggatcattcttaagatgtccaaggcagatgcattggtgttaactggactgagcttctcaacaattaagcttgagactaactaaagctggatgagcccaacatcaactcaaacatgtcatctggggtaagaagggttgttccccaagaataagctccacatcaggtctgctgctgtctgatattgccttcatgacttcccggaccttgcatagaaaagatcatttaatttgttaaagatttactttttcacactgcgatatatactttgccaacacataagcacaaattgcacagagaaaaggaacaatcatagatgggaaaagttgcagatagtccaaatactctctccatcccaaattgatcgtataatgtttgtgtaccaagacctaggataatttaaaccgcattgattaagacgccatgcacaatatgcacatattctcccacagtgcatgcattgattaaaacataatgcacaaatatacacattctcccatgttgtattaattgcactccgatgaaatccgtgtccatgcggttataagatgatcaatttgagaaattttagtttctattatatgatgatcaatttggggagggagtaacaagcactggataatcagttaaaaaatattggataatccacacccaacggatattgatataccaatacaaccatccatatccctttccatatctcctccaatatagaaaggttccttaccattctaacaaatgttttggcggcagattggatcagacattatatgtaccttctttacaaagagaactttttgcaagttccttttagttctattgtggtttgtaatctcttatttggatgagtgcaattttatgcgcttttcaaagtgcactaactaaaacctcatgttttctacatgggaatgtaacctgatattttgaagataggaatcgtgtaccaactgatggttctgaaagtgccacactaccagtacactagcaaaacatagaaaatataggtcaaatttgaggattcttactgtagttttaaacaaaataaacaaatatttatatttaaacaccaaacagtataatagaaacacagcttcaataatgccatactggtatgattgaatacttgaaaccaaagaatatggaccatacctcaagggcattgatgcctcccacaacaaaaacgatgagaatgctttggtcgccaaagcttggtttagactgcagatagtattgagtgtgagaaaggatagctacagagtggtggcaaaggaaccaaggaagtacaaactaataactcacctgtcctagcccaaacctccccagtccacttttaaataaacgtccaacagctgatgagtgatattcaaggccaggaatgtcataccttgccaagacagctaatagcaacttatagagcaagccttttcttgagtatatgtcagtctcaaatctgctcagtgctgctaggccttctccaagagtttggttccttaacctcatactggacaaattgtgaaagaacttaaaaagctggtcaactctgtctcgtacttccaacttaagttgcatgtccccataagcttcatccttctgatcatcagtattatcatcatcatcaccccagctatcccattggtcatcaaaatcatcagtactcttagaagcttcgatggagtcattacttttgtcaccatctttaggtctagctttagcttcaagctcattctccaagccaacaagaaatctgagcttcacagatgatggcctgtcaaggatagagtccaccacaatatctttcaaagaccgctcgtcttcccaagagaatggaccaccagcaatcgatgtaggaaaattttcaccagccaagatatacccgataattgttagaagcaaaacatcctggaaacttagaaggccctgagaggactcagttttattagcttgcttgtgagattcaactgaagtgctagtgttgataaaatcacgaagctcactggcaagactttgagttgtctctgcagatgttacacttaatattctctctgcacttgtaaaggcatcccagcgagaactttgaggctcctggagagccatttcagcagccagtgccaattggataacccctctgtttcttactaaggataactggtctcgagagagcatttgaaccatagaatgaagctctgaaacagaggcagctccttgccgacctttggatgggaaggataacttctcatgttgtaaagcttccataagccatttcttaatcaacattaacccatcttttgctcctctgtcgagtaatgattccaagtagcacactccagcataattggataggaatgaaccatttaaactaccatgttgactgctgagtttgtcatcatgagctttatccgcgtaatcaggtagccaggttacttcagattcaacttcagcagagttccatccagacacaaatgacatgatactttcgggtaacatactggtcctactcttaggttcttccttgctgaagaccttttcaaaagggacctttatatctagtgggatacgtttaacagtagcttcagaatgcttgcttggagtttgtggatttttggacacaaaataggatgaagtcccttccttgcgtgtcaaggaggacagcatcctatcaagaaatgagtcaccgtggaaacaaggagtaaggagatcaagtgtacgatctacgatcagcaggccagcagatctcttattacgaccaacatcatatagacttgacatatccatcatcagcttcccgatgacctttgatgtatctccaagtgaaaatatatcgagctttaggtccatctacacatgttttgtaatacggatcactaagtggttatatgaatgaaaaataagaagccactagtaagaaatatgttcttatgataaatctttaccttactggccagatggtaaaggaactgggcagtcaatgtcactccggggggaatctcatcaccatcaaaagatctaccagtagatatgggaggtagccctggactaagggaatcttcatgatggtttgataaacatgattcagccattgtgccttcagatggcaaaacaaaagtcctagaggaaataggagagaaaatcatcggaaagtgagtcacagttacagataatctttttcctttagtttctagctggcttgactcatcagcaaacaaatccttttttgttgggctagattcagaattagagccataatgcaccccagattcccaattggagtatctaccaccatccgatgtgaaatcttttcctgtgtaaaaagtggtatctttgtgctcatctgacttttcatacttcttcagaagttcctcatggtcctgagtaagtaatgtctcatactcccggaaggcatctggtccaaatggggaatcaacatatgctgagtgaccaacctgcaatatatcacaaatgattcaaatcctgcttgcagaacttaagatgattttgctttcaataaaaaaactcttaagttttgcaaaaagaaaaaaaaatcttataatatgggttgaagcaagattgctgtttatcaacatttggttgagcaccacagaagttaccacaggttgcaaacaaaacaaagtccacaaattagctcatactaatacactcatatgtgttcagctatactatgtacaacaaataattcaagaggacattaagattattcatacaataaataatggtttagataagcttccaaatggacaacatgcaacaatacaaactacatacatgagtgttgagaccatcccctggagaaaggataaatcaaacaatccagatatagtatatgataccttcatgataatatggaaactaacatggactatgtacctttttcaaaggaaattaaataggaacttaagccccaggcaaaaaataaaataaaataaaatctaaagccattttgatgtgaacagaagataattgtaggaaaataatggctggatgttcaagcatttcagaagcaatacaggcatcaaagtaacaaattcttgcaggaatgaagtacctcggaaatagctgtcaacacagtacaatgtgaaatagttccatggtttcccaggcagcgcaaaatataccgatgtgcatcactaagcaggcgtgatgtaatcactactatcttccttgctggatgtgcaaaacttgagtgccattcagcagcctgccaaacacaagttacggcattttgatcatgtaaagaacaggatggcacatttgtcattaaaaaaaagcataattttttcttactttttgtacatgaacaaagaaaattatggttttatataagaaaatatgagtttgacactaaggttaacatgaaggctgttaggtgcactgcttctcatctataagaagttcagaatgaaaaagaaatatgaagtacagaaattcaagatgtcataggaccaaaaaggtagtccctccataccataatataaattgaattttatttgctaatagtatcattggattgacatttgaatacactttcaaatggctataattttgttcctacaaactttatagtatatgagaaattatgagtcaaagattagttttggagaccgtgacgagtttgaccatgccttatattttgggatagagggagtagtccttagctctaagttgacacaaatcaagaaacaaatgccacttgcaactatggtttcttcctaaactttgccactcatgtgccagacacacactaaaaatgcttgagctttggtgcactcaacatgctgcattcagtttgacacataaattactactgagcagacaacattgcaacttttgggaggcattgctattagcttactggctaactaccttgggaggtagtatgcattattaccatatctattctttattactagtataattaattgacttttatggcaagggatttaagtaatctcacagcatcaagcggagatgcattctccaagctgcaaattgcacgagcaccaagctcaagaagcaaggggaaagctccaataaactgaaacgcctccagagtgcctgcatcaaggtacactagtgcatctgcaatctcatctccaatctgcaaagcagcaacagaccaaaaaaagaacataaatttctatagtgaaagccacgaagataaagtccattagttttacatgcaaatcatcaaataggaatttgttttctcaaagttatccacagcttaagttaatcacgaacgaataacagcgacttgtcagctcagaagctaaaaggataaatctttaccaagttaagcagctcctgtaatttatcgttttggaacgagaaagaaatacggtcaggaagctgtaaagatgggtttttttttaaagaacaatttcatcgctccaatagtccaattaaacgcagtagtctcatattcatctccaaagtgcaaaattcagataattagaaactgaaaattctgggaatcttcttacacattcagtttaacccggacaaaattaatctcttacatgataataaaaagaaatcgaacaaacaatgaggaatccgagcaggcaaggtaagagagagaagtcgcgaagagatccgacctggcggatggagtcgaggcaggcggcgatcagatccaccgaccccatagtccactatcccctgagatcccaggaatcttttcgccgccacgcccccaccctccccgtgcgccggcgacgcggtagcgaggatgggaggggagacaccagccgtaaagaactcggtggggttgggggtgttcggcgctgccgctcgccggagatgccgccggtggtgtcggatgaatcgcggcggcggaggagacgagacgagacgacggcgagagagagaagagaagacgaaaggattagtaggcccgtttggagtatccggcccgacccatctgatttgggcccagtaagcaaacgctcatgggtgtcgaccaattgaaaaggaactttctactgcatatccgtttcatattaaaagacacttttaatttttttccagtaaaactcttttttgagtttgatcgaagcttattaaaaatatatagtaatatccacaacgctaaataaatttgtttcattaaattttacattgaatatattttgataatatgttttgttttgtgttactatatgtttttaggcaaacttagtgaaactttaaaatgtatgactaaaaaaatatacaaaacgttatgaaaggaaactagtacgtacctccgtcgcataatataaggtaatgtttggtttggggacaaggtgggatgggttagctccatctctatttttgaatgggatgattatgtttttttgtttggttacagggatggaacgaaccctgttttttaatttggtttgaggaatataatgggatggaatgatcctatacattgtttggatggagggatgaaggtgggatgcctgatagggctacctattgatattagttggtgaagttacccccaactagtcatgaacaccatacagtgcaaaataatacttagtcatgaacaccacactatttaaaaatgaccattgtgaattccaatttcgtttgttcacaaacaatatagctccataagttattaaaaaaatttaataaaacttcatgtatgcccaaaataattgctgcagcagcagcagaagcttcacagtgcacatataatacaagccacacataataatagcaaattttagtcttacatatattagcaacttaaggtcttcacatttaattcttgcacatgatagcaattttaagtcttactcgtactagtaagttctctgcctcaaacatattggcagtttaaagtcttacataataggtaaataagccaaccaacaacacataacaccaaaagaactatccaactcatccaagaagcctatgttgatccagggaacttttcactaatgaacatagcaaaccaatgcatcttgttttcaaatggaagtccatcgaaagctctagcaatgtgagggtgagcagccaaatgagcatagtaaaatgatctatggacctcctcaaaaccaggaagggttcccaatatgtcaaataaaccttttggaagcttattgtccgggtcggctacctttagtatagcagaggcaagcttgtcaccaacactagtgaatgcaccaatcagcccgtcatcttcattctcttgtgtttttgctttctttggcttacttgcagatgatgcctccgcacgatcatcagtaggggcaggaccatcattttcttcatcattgtcatcttgaacatcctctgttcctaggactgaacttgagtcctttgcatactttcctgtagccatggtgctaccaaatattgtaagcatctcaccatagtgtgcaagaggtttgttaaaataatctgcattagccttgtgatccttcatgaaacaaaagttattgtataagaaaatgcaataaaaagttataaaaataaaacaaagaacccacaaggtaagacatatacctcaatataaccattatagtgctcatcatcaagagtaataatgaaaattttctcatcccaactagccagcactcactttcctaagcctatttatctttgaaaactttctttgccgtgtcttcaaatggttcttaatttgctcacccgtgaaagtactattgaacctttcattgaccgccctagcacatgcattgagatggactgccttgaagccagatgaggtccttgtgccaccagcaacaacattaactaggtgagaaaacatgaaagaggacatagctgaggtccatgaagcatgggtgcttcctcccttgccaaaatgaaacaaaaatgtccattcagtaatatatatatatatgtatatatatatatatatatatatatatatatatatatatatatatatatatatatatatatatattaataaaatatgcatgcaacaatatatcaactcagaaaataaccattcagcaatatatctaataaaaaaattcagaattcagcaacatatcaacccagaaaatgaccattcagcaatatatcaccccaaaaatttcccattccccaacatatcaacccaatatatgagcattcggcaatatatctccttaaaaatttcccattccccaacatatcaaaccaaaatatgagcattcaacaatatatcaacccaaaaaattaccattcaccaacatatcaaaccagaatggaaaaagtacgaattacccccccgaactatcgcggtcatccgaattacccccccgaaccataaaaccggacattcttcacccccaactataaataccggacgaattaccccctcgacccaatccgcggtagttttggtctacgtggcgtacacgtggcagtccagtcaacattctctttataaaaaaatgtgggacccacttgtcttacactactctctcctctctctactctctctctctctctctcacttctctctctcacttctccaggcgatggcggatgcggagaggccagcacggcggctaggcagcggcgagcgcggcggagaggcgagagcggtgaagaggcgagcgcgacggcgaggcaaaggcgagcgcggcggagagacgaggc

SEQ ID NO: 13970 - DNA, 14407 bp, Oryza sativa
  unsure (1)..(14407): unsure at all n locations
cgaggaggcggcgcgagatgagaaggcggcaatgtcgtccccccaccaaccgcctcaccgccgctgccgcctcgcttcctccgccgtcgcgctcgcctactccgcacacatagncgctgctcgcctnctcctcttctggcgacgccgcacgctcgcctcggctcgcctcctcgggcgtccattgccggccctcgcgtgccgaccgcccgcgtcgccgcccgtcgccagacctcgcgagccgaccacccgcgccgcggtccgtcgccgggcctcacgagccgaccggccgcacccgcgcccgtcggggtcgacgccgtggccgtcttctccttcgtcggctccacgtccgctgcagatcgatcgaacgacgacgacgtcgcctctgcctgggccctgacgacgagcgcgacagcacaccggcgaggcgggaagccaaccgcggcgcggccagcagcacgcgctcgccgccgctccccccgcccccgcccccgcccccgggccggcgaccgacacgatgttcttgattaggttcggccgccgcgccgacacgacaagagggctcgccgccggctattccgccgccgccgactgttccgccgccaccggcgcctattctgtcgcctgcctcagtgcgccagggagcgagagaaagagagaggggaaggggtgaagagaaaggggataagaagagggattgggctgacaagtgggtcccatattttattttatctgttttggctgactagactgccacatatgcgtccacgtaggaccaaaaccaccctgaatcgatctagggggtaattcatccgatttacaaagtatagggtcaaaaataactggtactgaagtttagggtggtaaatcggacaaccgcaattgttcaggggggtaattcgtactttttctaaccagaatatgagcattcagtaatatatcaacccaaaaaattaccattcaccaacatatcaaaccaaaatatgagtattcagcaatatatcaacccaaaaaattaccattcaccaacatatcaacccagaatatgagcatccaggaacatattaacctagaaattcaacattcatcaattcatcaaactagaaattcagcatacaacaatacatttatccatacaactgacatttggcaaatggactacaacaagctgtccacgcgaattaaataaataaaaaagttcataatacaaatgaaatgtagcaaataaggtagaaatacaagttgcatggctacatattacactccatgatggttattacagtcagcccacatctgatcagttaaacgatgcctgaactgaaccatcaatgcatggtcattcgcttggccggttgacgattcatcaatgtcctcacttgtccaatcagacgggatgagtgtctaaggttgaacaactccttctcattttgcaccggattattctcccactctttcaagtggtaccgcacagcacgaaaaggaggcaagaatccttgtttggctccatatccagcatcaactagatagaattttcctatcatatgatcgataagttggtcacattcctaaatatcaacatttgtcatggagaatttgataaactatagtaatatattaccttgtgggacatgaaggccattttcacgttccaaagcatctcttaaaactacagcatcatgtgttgtcccctccgaaccagccaagacataagtaaaccgaagatcaaaatctacggccgccattacattttgagtggcatgggacttcctaccacgaaaagaagactccacattcttacgaacagaggctctaatatgtgtgccattaatagctcaaatacaatcctattttgtgttcaacaacattaaaaattagggacaatatatcaatgttcacataaatataaaatgagatagggatgaatctcacaccttaaagtaaggatcccatctaggatttcctgctattttagttggagtgtccaatgagggggggtctgataagttcatctcgtagctcaccaattgcatgaaggactttgttgaaataacgacttactgtttctccagacctatcataattagtgcggactaacctatttctaaggttatgccccaccgtatgcagaaacatagcaacttgttcctcaatacacatgtggatggtatcttcaagtaaaccacgatccttaaacagcttacaaaaacgaaaaaaactttctcttctaagtctaagcatatcgatacaagttgtatcattcctcctctagggactcaattcttatcctatccctttcaaccattgggccatatctaataccttctccttaacctcttgttctttttctagaccgaataatcatggccatcattgataacaataaatttatagcagcaatacaaactaaaagcttggtcctcttatccttctagatccaccaccaaaaataacacatgaccatcatctactgtcaataaatttacccaaaaaaataacattgttgaactaattatactacaacattcttgaacaaaaacagacatgcacagatctataaatgaaatccccattcagtgtagggatggagaggatgaagattttttaccttgaacaatggaaaccgagctctgcagtttgtgggtagggatggagaggatgagggagagcagcaaccggcaatggaggaggcacgcgcgccgtcggctcgccccaacttccgcagccgcctcgcccttctcgcgccaccgccactaatcctaaccctagaggctatcgtgaggaggagaaaagagcaaagggaaaaaagaaaagtggtgaaaatatgtggtgggacgcgagcgttaccgcgctgaggcacgtaaaatcacgagcgaggaagtgggatggcacggtccgccaaattttcgcggatgaagcggtaccgaatattgaaggaatattcccttttggaaccatcccatcccttctagcctctcaaccaaacacatctaaaaataggatgatcccatcccatcccgggatatccctccaaacaaacactacctaagagattgtgggtgaatgtgcctcatcctagtacaatgaataccgtacgtatgtccagattcattgtaataggatgtgtgtcacatccacccaaaatctcttatattataggacggagggagtataaatttataatcgtagggggaactacactatatggagccaattgaaagtacacttgtagcttttttttagaacaattgtaatttatacaaacttcaaatttcattatatatatatatttgactacttttatagcggtatgcttatgtagaaataagatatctactgcgcattataatatactagaccaaccaaacaacgatttttttatatatatgttaaaaactcaacctagacaggatgtgacccatacggccatgtaacgaatctggacaaccatctgtccatattcgttatactaggaggccacatcactttctagaccgccaaatagttagaagtgggtatcatcagggatcaatgggctagctcatgataaactatttaatccatgtattttttttgttttcgttcaattggcttactgtcaattgacgaatgacgacatacgaatggaaggagaattgacataacaactacttcttccgttttatattataagactttctagcattacccacatgggtgcctagattcattaacatatatatgaatgtgggcaatactgtaaagccttataacctgaaacggaggtagtagattacaatttaaattaatacggaaaatatcactttgtgcatatgggaaattttaatttccctatcattggtgcactacacatatatagataacggcaagcatatataggataatcatatcagttgcagagaataaccaaatgtttactccggttcactaataagaatgctaattaatgagcaaattaacactaaagaacagctcttgttcttatgcttacatatcctatcttactataaagttatcccccattaactccttaagcttaacatacaaagatgtcacatcatcatccactaacaagatgccacatcatcatccactaattaacaagatgccacatcatcatccactaacaatcatcacatttaaacatcatgcaaacatgctatatctttatagtttttataatttaagagcttttcaaatacaaacatgttaaattatcatccaacataattcacataatgtttcaatgtatatctttattatgttttatgatatcctatatacttatatagttcatcctcacttagttagtgcttaaatgattaatctatggtccaaattatctttttccttttttcctctaattaagtcatatcacatcaattgtttttagcctttagatgattaatctacggtctaaactatctccctacttttcttcttccataaaatcataccaccttacttttacgcttgaatcactattctacatactatttaaatttaaattatcataaaccacattaatttacttaatctaatgttatctagctatcttacacgctgtttttttattgttatcatactaaattcccgcagcaatgcgcggggtttcacctagtatatagctacatgtgcatgttcctattccactattattacatacattacacaacagttctgcaagtacttgattttgtactacaaaagacatgagtattcaaataagtaatgaacaccttagcatgtgtttggtatggggataaggtgggatgggttaggtccatccctgttttattgggttgagatgattctattttttatttggttggaggaatagaacgaaccatattttttttgtttggtttgagggaaaaatatgtttggtttgagggatataatgggtagaatgatcatattccttctttggatgaatggatggagccaggctccgtggatatagacacctttggtgagattacttctcacacaatatacatataacaaagaaataatttttgagtaaacatgagtttagcaaacatatatactactatttgaaaacgatatatttgcggcagcaacaaaaatctaccgtgtcatgctcattgcggcgctggcggagtgggtcggcgcggtacgaccatttttcatggatcgactggtcccagatattagtggaatattctcttttggagccaacccatcccacctagtcccacaactaaacacctatgaaagtgggtgttgggtttagtgctacatcggtaattgatgatgggggagcacggcttaaaagatgggggtggtcctcactagggctgaaaacggtacgaaaactttccggattccggacctattttcaaaaacggaatctgtcggttttttcggaaacgaattcgaaaatattttctcggaaacagaatcaaaaatgataaaggcagtttccgtcggaacttggaatcggtcggaaactttccggaaattttctcggaatttccggaattttttttggaatttccagaaattttgtaactaaaatatactgggttctttttttaagcacttaatagtgaataccatggtattttgctgttattttcttgaaaatatttttttatgcaaatctaaaattacataagaatattttttccttcattgggattttccaacatcattactctcttaaacatagataatttatttcatagattgtgttttgtgatgtactgttaatacttaataattggacttatatgattgtgttttatgatgaatcgttgaccgttgagacttgagaattggatttatcagtttgaggggttttttattccgataaattttcgttaccgtatttacgccggttcgttttcgctccgttttcggtttcgataatattcagttccgttttcgtatccggggtttccgattccgatttcgaaaaaaaatatgaaaacgaaaacgataaagatggtttccgtccgtttccgtaccgttttcacccctagtcctcatacataagactagtcttttgggttgtgtaggctcaggacctaaagttgtggctccggttggacttgtgtggagcaggcccaatgtgacctgggtggcccacggttggtgggccgagttgcgtactctaacaagtggtattagagcccaggtttagaacctggaacgatttctatgggtcacatggtggggaggccaggtaataagtcttcagggtcacatgggttgatgtgacggggagattgttgagcccgatgtcttcggggtcacatgggttgatgtgacgggggagattttgttgagcccaatgtcttcaggatcacatgggttgatgtgatggggagattgtttgtgtttgtcttcagggtcacatggattgatgtgacagggaaggttgttgggcccgatgttcggggtcatatgggttgatgtgacggggagattgtttgtgtttagtcccatatcggtaattgatgatggggggacgagggagcacgacttaaaaggtgggtgcggtcctcatccataagactagtcttttgagttgtaggcacaggatttaaagttgtggctatggttgggcttgtgtggagcaggcctaatgtgatctgggtgacctacggttggtggaccgggctatgcactacagtgggttcgacccaacccacccacgaaatccctccaaccagacagtacaaaacagatcatgcatcaagccatcatcaataatatcactgtcatatatatgtacccgtccattgatccatatggcgtccactatatatatgatgcctcctaaacaaacagcacagcaggtgctacctatgtagcagcagcacatatgtagtgcaggtatatcaaggaagaaagaaaagtaattaaagaaagagctggggatcgaacaagctagttatgtggagccatgggagttggaggcaagagggaagaactgctcgtcctgcccaaagcaatacgcgcgtactctacatattcgtagagtacgcattaggttgctctctcggcatcatattctacatattcgtagtgctgtgctatgggaaatctatggagttccgcgttctgcggaaaaactgagatagactcctggctccatgcatcttcgagtactgtcgcaactctagcctatgtgttgtgctagttgaatccgtgtattagatgaatacatacttcaggtagtatagaattgtacaataattaaggtgcaagcaaagatcgtagtaaaacttgtcttctgttatataggcatagactattactacttgtcttctgttatataggcatagactgtatactacaacagaatgtatggggcagctcaaattaatcaaaagttttagtcaccaccacagtatgcttgagacaataagatccaccgacgattgcataactttgttactaggactgccagtaggtatccattgctcacatacatacccattgggtatggtattggtagaaattatatgtttaaaacttggtaaatatacatggggagggtacttaattattgcacacttcaactataatcattagaagttaaactccaactaaaaagttgtaaaactcgcattcgcattatgacaaacttgttgactcaaatttgatttgatgacgtctccaaaaaaaaagagcgacgaaaaacatcaccgctgtcgtccgttaaggtctcaaagagagacgaatctgggttttcacctgacagccccactggaggagatgggacggcatgacaatgccctcaagagggaagagggaagagacgcttgaaaacgtcatcgttgtcggcccggactaggtcgggctaggtttttacctgtcggccgctggctacgaacccacaattgatgcacccaagctccaccgctgtcaaacctccgtcgacatgtgggaaccgctgcaccgacgccccctgccgaccaggcttcgtgtgccggcattccgcactgccgtccgcgccttctcgcgccgggccgggtttcctttgtcgtgccggccactagccccgccagccaggcgcctgctgcgggcaagcgcccgcgcctccgtagccgtcacgcctactgcggcctcctgcgcctccgccgccgacgccgcgcccacattgcaccaaacaaaatctggcggcggcgacaccggatccagccgcaatggggctagatccaatggtggcggcgccgaatccgcagccacgtgcctcgccgctgcgctgcgccgccccttcgtgccaaagacgggacgcaccgcaggggattggagcctcaccactaccatcccggcggcccgcgcggtttcctgtgacacgcttcggcggtggcaaggcggggaaaagaagggaagggtggcgccgcccaggggctagggttcgcccccgatcgcttttgcaagggcgacagggagtgcgtcattgagaagggatacatttcttgcgttgaattttcccttaataatctttttaatggtttttactatagtagaatccatctaggccgttgattttttttttctaattcaatgaatcatatctaagttataaatcaatgattgagatcgcacctttaaggataatattgaccgtagaatacacccgtagagaccgctgtaaaattactcttaaaaaattatattcatcacccgaaagtgtgcataacaccgtcaagaaagatcatctagttctctacccacctttatgagataaacatatagttgcgatgttcagacaatcagagtgcataaatatcaagagatgcacagattttcgatgttcagtcagccaatcgaagtgcataagtgttgagttcatctacacagattttccatattcaggcagccaatctaagtgcataaatgtgagttcatgtacgcattgtgaaatcattgtcatgattaatattttgtgatgaacaattggctttgcaaatagtttgttcaatgaaaattggtttggaattatatgtggatattggtgtgagcgtgtgtgactaatgtgggtcatgttgtgatatttgtgtccagaaatagttgttttgtctgattgtgtgcaagtgacttaaagtcggccttagtcaatggtaaggattaggactatactcacggaagagcatagatctagcacggtcgtaataccatgtgaaaagtgactagagtcagaattcttagagatcaactttggtcaacggtaagatcgagactaggctcagggaggaattaaggtccaaatgataaatgatactaagggataaagttggatacgagatgccacacacggttgatagacaccgtgttaaagagatcttcgcaacgggcttcacgagatgtccgtgcaagcgtcggttttcgcggaggaggttggaggttggagagagaaattgttggagtatatggtcgggtactgtagcggtggtgctgtgccatgcagtgtgctggttttgtgtaggcccgggcagcaggaggctcagctggcccatgcggcaggaaggaagcagcaggcagtagcgcaagggaaacgtacaagggcgacgtgtcgtcaccggattggcgaggagtcctgttcggattcattgtggctggctgtgtccgcggtgttttgagagaacacaattttggtaaattgtatatttggtttggaatatgagggattgagtactactgtaagcatgtagcagcagccggtataacatagactgatcgacgaagtaaagagcaagtaaagggaaagtttgggtgttcaatcgattatcgtggagacatgcatgggaatcggaggcaaagagcaaggaatttttcgctctccccagtctctactgcccagcaaaaatcagtacatgcaaaaatagtggttgcaatgttcagacaaccagagtgtgtaaatattgagataaacacatatttgtgatgtgcaggcaatcgaagcccataaatattgagatcatgtacggctataccttgtttggtcatttctagatgtaaataatgagccaaatttccactatatatcgttggcatatcaataccagtatcatactgtacataattttctatcggagaaaccagtgccactagcctacactagcagagcacaaaactagctaaaatacatggtacttcgctagcaattatggagcaagaaactagagaaagaagtgaaaatctttaggaatttggtattgagatcggctatgggaacaggaggcaaaagggaatgaaccaagagttcatcaaacctcatgcattcttgcagcggcggatccgaaagactaaaagaaagggctaagcaaactagatgaaactataatcccttcttttgatggatgtatgatagatagaggggcttaatgggagctcccatggttacgacactggtagtgtgtgttcgagatcccgtagcctctatggtggatccaccatgcattcttgggcaccaaacttcctgatgcaaaataagaacatgagtacttgatttctatactgaagttgtggcaagaaaattgatgcttccctttttcttttttagttaggtggatggatatgagagtcctacattttcgatgttggaaatgggagatgatctcctctctgttccataaggagagaaaaaaccgtagtatatagtagtactagatcgatcatcagctactcaccaataatgagtaattgatcggtatttttcttgtttctttttgggaaatcggcttagtgacaattaattaatgagtgaggtgtaaggaagagaattggcatggaagtatgcaactactaaacaacactcaaagtatgccaaagtatgaaaaagagtaaagtgcattggtggttcttaaacttataggattgtgtcatagggttgtgtcatataggtccctaaattctcaaaatgcatattcaggtcatagaacttgacaaagtgtattatctaggtcccaaattaacacgttccttttagggatgtggcaatgccacatggacgtgacgtgtccttttctttttttttcttcttttctttttctttttcgttttcttctcattcttctttttttccttttttttgcacgggtcgcatagaaaggtgaagaaaggggaaaaagagaaaaaaaggaaaaaaataaatggatcctatttgtcagtcaaaataatatcatgtcatgtccgtatggtatgccacatcaacgtcacgtaagatcctgaaggggttgtggtgatttgagacctagatgacacactatggcaagttttgagacttggatatgcattttgaaagtttagggacctagatgacatactcctacaagtttaagtaccgcccgtacactttactctatgaaaaagaagaacattctgctattcgattttaattgtttagatgaggccgtatggattttaattatattgacacgtattatagcagaccagtgcatgttccaattcactaagtaaaaacatactaagacttttggtcatccacgtgataagtcaggattttagttgaactaatagtatggtataaaaaaacataatatcattttagacaaacgtggtagttgagggataatatatatgaacttatcattatatacaattattaatacaattgatccatatacactacagggaattctatttcccgcaacaaaaatttccattgcaataaactttaatttggtgcaatataggcatactgcaaattctgagctgttgctttgaaatgtagtaatattgtaacgatttcaccatgctattgtaacagctaataatgttacaaaaaatatgtatcgcaacaatttcaccgtgcgcccctcctgcggccatccggaggccggatctgccgctcgcgccactcctgcgactgaatcctccatccgcgccgctccagcgaccaaatctaccgcccaagcagttgggttgctgttgtagtcaccaccgcggagtcgctatcgctgtcgtcactgtggccgccgtcgcctttagggacgtgggggtgggagggggtggggtgggtgggtggagaagaatggagtcgatcggtgcagttggtgtggatttataatacagtgatacttatttttgcagttagtactccttagcagccgccaattttcgttggttgtcacttaagaggtccgcttgtacaatgacctttatttttttttcaagcggttctcttaagtgtcaggcaataaaaattggtttccgctggtggttggtgaccggaatcactctcaagtatttttacaagcatgtgttcattaaacccgccagtaaatataaaaggatagtgctatgaaaaatgattttgtactagtggttgtatttctcgggtggacgattgtcggagtttatctctaacacctacatagatcggctgcgtgttcttaaaaaaagtccaattgctgtaagatttcaaagaaaaaaattccaattattgtagaaccataggaattggagacaactggaaaaaactcatcgcccgccccgctcatccccacgctctttcgtccagagaaactcagtacatgcattaggtttctctctctgcataattttgtagctgtgccttgtgtttttttcgcgaacgctagctgtgccttgtgttgcagcatatatatatgatttaaaagaagctgctgcatctggacaaaagttaattaacatgaagggggactggaatatgaagcttgtaccacaactaaaattttttttgatgaagatgaagttgtcctgataatatatcaagataaggtagcagaattcaaggtgatagttagtgaggatcatttcaacctggatgaaaaaacaacttcctgttcttgaattcgtgcctaatttgaacaattgaagaaatggtctgacatatgatccaactgtattaatggtatagttgattaattggtatgttatcaattccgttgttactagcacgaactacctcttgctatgtgaatgatttctaaaatcaaaggtgttatgttacaaatgtgaaatgtccacatgtatatatgtatggggtttttcaaattttagtcaaacaagttaaacggatgacaaaatccgcacaatatttatacattattgcaatgctgcaagctattcgctacccatgtatacatcagcttttcatcaccaagttacaaacattaccatacaacgataggcattggcatgtttgcccttcaacattcatactcaccatggtttataattaattcccaattccaaagtatgatcttgcatcataatcagcccaaactagacagaaaatctaaccggaagtttgattgaacttcacatggctacagctatctaaagcatttcaatctatgtgctctcaatcaggtttagatcttgttgagcatctcaaccacttcttccatggatggccggtgcttagggctctcctccgtgcaacgccgtgccacatccaaatacgctatcatttcatcttggtcagcctctctcccttcccattggatccccatctgacggtccaggatctccaatgcctggcccttgtctaccttatccctagcccatttcagcatctctacctctttccctttcatgttgatcttcaccggccagcttggtcgccggccggtaaccatttccatcagtagcacgccgaagctatacacatctgcctttacgctcgtgcctacgccagcacgtaactctggtgccatgtacctacaatccatttgatcaaatattggtcaacagggccaaatatttgtaaaaagaataagcatatatgaaaaaccatattctaaaagggtacttcattgcaaggtattgaaatgcgacggcaacagctcaattatcatggttatcaaccttatcaagccaataaatatttacaaacggctcgataaatcggtcaagttcaataaaaaatcaaaccaaaatcgagatcaatgtgaaaaaaaattatctgaattcaactggttatcatcgataactgttgcacggttatcgaccaaaccactagggatcggttttcgatgacgaaccacatttgcaaaccatagtttctaataagtcaaaattatttttctagcaccgaaagtttataactacatagaatcataagatcctgattcattttgatagcacccaaagtttccaacgttctcaaaatagcattatgttaacactatcgttatcgaagtgctatatatacttctctgaaacactaaaaaaatagtggtggtgaatagtgagccacagtgacacgaacaataataaaacgaattctataaggagcatttatactgttggaattcttggattaatatttgagacaataatggtactatgattctttcttttaaattcgttggaaggcacaggcattcaactagtatatgaactattggccatagaagcaattttg

SEQ ID NO: 13971 - DNA, 5977 bp, Oryza sativa
  unsure (1)..(5977): unsure at all n locations
agggggtgaggtgacgtgacgttctcgttgggttgggatggggaaggaggtggagtgagtcgtcgatggagtcaacggtgttcggcatgctgcggttgactatttcttcggctgtcactgccacactgtacagtgtacacccctgtcgagggagaccttgacctgtgactaggctgggctcttcagttaattttccaattttccaaacctcttatctctttccgcagtcactttttccaaactataatagatggtatgattttttaaaaaatcttctatagcaaagttgcttaaaaatatatattaatctatttttagctaatacttaattaattatacggtaattcggtatttggtttttcgtgtctggaggcaaaggttgtgaaccttacctcccaaactcaatctaagactctgtttggatgagaaggggactaaaattagtctctcccattcaaacagccctaagtgactacaagtctcacgtgccagctaagctactacaatctatagaaaatctggaatccaagggagaaaaaaaaagagatgagctaacctttggaccgtagttattttacatgatttttttaatatataaaagtaatttaatttatgcaagatccttttacaatttctaacttcaaagcgaagtgagcatagttttactgcttaggttacttgtggttgaaccagcccgctctgattcaaatcccagacttaacacaaatacccgtatttatggctaattattttttaacggtaagtgatgtatccgtcaacagcgagatgttcgtggtgactttgttagttttaagatatgctggtcgggtcagtgtgagctctttttgagcatctatgtttatactgtgtttctaaaaaaaattctacatacatcagtatgaaaattttgccacttcgcgaaccataaaattctatattttgagttgagacgcaaaaggtacacacttttatagcccaaaaggtttgcttttattttctttttctgatgttgctaagaatcgacgggaagtttctaaggccttcaaagaagaaaagcccacccccgtcccaactagcgagcccacgacgtccagcgacaacaccggcgacccaaatcggacgccggctgatctcctctagagtttgaaattttgcgtaccatatttttatgatggctttgttggggggaaatttgtgcatgccttggtatttgtagaatgtttgtgccctgggaagttaggatttcgatattttgttgcttcatgtcaaaaatgtggatttctaatgatgtttcgaatgagaaatactaccttataggaaaacaaatccaatagatggtctaattttcaattaagatatgtttatctcaatccgaagaatgggtccattaaagatcctctgtatttgcaacagctcagtggaaaataaattttagccagtttgtttgcttgtctgaactgacatccaaatggtctgtaattagttcccataatctcaaaagttatggatctgtttgtggtgtttttagatgtgatatgttccaaatgttctttctttctttacatactccctttgtcgtaaaatatagcaacctagattcaaatttggagtactaggttatgtatctgtttgcatctttgtctctcatgtcatgtgactaatgtgaatgcatttctattctacatgtgcggcaaaacaatggtttaaggtcatcagttagatatcagagatactatccctgtgcactaaagtgccttgtcagttagctgatgattcttatttgcctttaagtaccatctacacacatgtcaaattagagttttgctacaggtttatcggcatagatttaaagataatgacatgtcaagacctgacaaggaaaataaaagggattcaaaagcacaggctggtgatctgatggatgatggtggaattcttgtccttagatttcttctgctgcctccttgtcttcgtgatacaatcaaaaactgcgggatcgtctatgtactagtgtgttaggtcgttttcaaaaggtagtgcataatattcgccttaattattgggaagtgtttttctcaagaagaaatcagagtcaggaaagtagtgatgtatagtcgtattggttgccctaacttaatttttaagattttaaattttaaatttttaaacttaatttttttaagattttaagttactttcaacatagttttcttttcagctttaacttttaagtcacaacaaaaaacatatatatatatatataattttatccataaattaatttttattttctaacaaaccatttttggcttattaggaaatatgggcaaccaagagtctaaaccgtgccaagaataatactctgtttttctatcaggcgtgttgattccagaatgtcaaacatcgaaaattataaccaattcttagttaacttgccggtacatcaagctcataaatactataccgatatactcattcaaatttgacttacctttacaaaatattgatttttatatctattaagaatatattgcctccgtcttaacaagagtttctgcagtactactttttttttcctcttcaaccattcctcattcaaatttgtcactcctacctaccgtgaaccactcttccactcccaactagtttgtcttttaaatgaaacaattacactgttttttagatgaagtatctgataagaaattgacagtcgaagtgtaatcttttctaaaatagagttctcagggagaacgtcaatcgtatcaaagtccactcatttctacgactgtcgaaaagggggggaaacccccccaaaaaaaaccccccgggtttttggggagaaaaaaaacccccccaatttttttnncccccccccccccccttgggggggttttttttttcccccccccgggtgggggccacctgccaagttcctcgggtttcaatcggttcttaaagaaaaagttggtagcagttttgtttttttattaaaaaaaaagttgccagctggttcattcattcaggaatcaggacaggaaagggaacaaatagctgaaccaaaaactgtgagagaaacgaagtggaggcataatgtgcattcagactgacaaaaagaccccatttgttcgtttgatggggtttcttgtcagattccttcattccttattccgaattccgattcccctcctttcgccgtttttactctcaacttttgatgacaaaaagcccatgttccatgtcggcaaactccacaatacctttatcctacacatagagtttcagagtttcagctaataaactcagggaatattagtttcaaatgtattgcaattattgtaaccatgttaattaacagaggttatctaatcatctaacaaggcatgctaggcaaaagagattcctgaggtgatctgcacctgccgaatgtcaaccacagcctgcaaaagtcacaatgaaagcagccttgaacccttgattagccttgtcatgtaaacctatccttttgagacacgtgcgtaaatagaggaatctaaaatagatatagctcaaggagcaaaatgtaaaagttgcaggaacatgaagtaagtaacaagcatctactgataaaaaaaaaagcaaccaatcaagaaggaattaggtcaaacccaacttaattgtacagtcaaaccgccgtaatataagctagtgtgaaagtctcactgccagcatttcattgtttaaaggagacaaatttgctctcaaattctcctccagttcataaatattttctctttaaaaacaaatcctccagtctcaggttgtcagtcctcttcacactgtttctactctgtttcacactaactgttctagatcatgaccaagacgaagcgaattcgcatcaaaactggccgataattacgcaacaaaaaataagcaaaaacaattaaactaattattcagtacgaacggaagtagacgatgatgagataaagaacaaacaaaaaaagaaaagaaaaaagcgaaattaattagcagattcgttgcacctcgccgtcggcgaactcactgtgcaaaaaacggcgaaattctccgaaccaatacgagagagcgagagagggggtaacgaggacggctgggattgcgccacgtggcagccttccccgccgcccgccgccctatataaactcgttgcagattgcatggtggacgacgactctagctgtcacgtagctcggtcgccggcgacgtacggacggcggcggcggccgtgatttcatgtgcggtggtggcaaggtggcgagcccgccgggaccacgactgccgcggctcgccggcgccggcggcgaggaagaagaggagaaggcggcggctggaatgctgtcgaggcatggacaggcgagggagatgtctgtgatggtgtccgcgctggcgagggtggtccccgccggcggcggcggcgaggcggaggagtggtgcccgccggcgtacggcgcggcgccgctgccaccgtctacttcccctgcatctcacggtaaggaattgaagtgtgccatttagcttggatagataattagatcttttcgtggcagtattattatgtgttaattttgagtttaattagcatcattgcgtgtaaaaagttaattgcatgtgcttagcagtttagcccaagtagtgtgtgtgtgtttttttttactagtctcatccagaacagagcaacttcatctggtagtttcggatttccagtactcatttctaacttgcattcctcgtttcaatttgaaaactatttcttttgttttatatatagtcttttgctgacttactaatagttttttaagtactccatttctgccttgatgtttttttttcagctattgtctgcttctcctcgtgtttatcaatctagttcttcacatttgtcacgtggagagggtagagagtaattagatggatatataatggatggacgtggtggttagcaaagcaagaaacaattagagaatggataatgattccaaatgtgcctaatgattatcattagaacgcatagttgcatcatagtcggtgaggtacacacgtttttcagattaagtaacagtggaatatgatcacgtcaccttgcaagagtagaacacgtgtgtgtgttccttttgtcactgtcccattgggtccatttggtcacctgcatgtacaccaaactacctttgtttttcaaaagaaaaaaaacacgaatattagaaaatgacctgatatcaaataaatagaaagggtgagaattcaaacccagactagctaacccatcaccttatggagttagccggaaaatccctaggtgtttctcaagaaaaggtaaaacattgtagtaaaattttattgaacactatgttgaagatcttggaaaaaaaaagagggagcagagctaaaggaaacatttgttggttgtttatatagagtagtacatggtaattattctgcttattcgtcagattatcgttgcagattatttactccgatccatgtccttttagaatacgatttttcaaaatacttttttactttattgtttagaccacctattctaatttatttgttaagtttataatgtataacattagctttcatcctcgaacaatgttgaaaacaccacctaagctagagatacgacaaaatttcaacataaatttagaaatatctaaaaaatgactatttttaaaatgaatcataatatatctctaatttcgtttaccatagccttcagtactctgtttcggttggattttgcagagcacgcagcagccatggcggcagggcagtacgcgccggcgacgtcgtcggcgatggcgtcaccgggcgagcaggcctcctcgccgtcgtccggcgacgccgccggcggcggcggcggcggcggcaggaagcggtaccgcggcgtgcggcagcggccgtgggggaagtgggcggcggagatccgcgacccggtgaaggcggcgcgcgtgtg

SEQ ID NO: 13972 - DNA, 1962 bp, Oryza sativa
gaaaagaaaacagttgtagcccatcaaacaattttaagtcatcttattttctcgaaatatccagtaggattaagcaataagcatcgttagtgagaattgtatttattgattttatttcctttatttgaaaacaagtcaaacgacctatctaggtttagcagacgtttttcactgttcatactctatcactaatcagagtatcagagaatgaattcctttctttgaatacaagtcaaacgacccatctagttttagcagaggtttttcgctgttcatactctattactaattagccaatgagagaaatggaggtatgaatccaagcttgtcacatcaatggtgcggccgccggcgccgccgctgccgttttccccgtgcaaatctcctctccggtcaagcgattacacataaaaaaccactcgaatcgttgtcatttttcttcgtcttccgatcaaaatcaaacacgcattcaatccgagagtcgcaactcgcggactccatgataaaagcagtgtgtgcttcttgttttctggtcgtcatctgaagacagcgatcgacatgcgtgtatgaaatctggacttcagtcagccagaaaagaaaaaagaaaaactaaatgcaacattagcatttaaaactaaatcaggttatagaatgtattattacaactctataaaatttatattacaactaaattggagtatttcggtgagaaaggctatgcatctggtgtatgaacccgtttgccgtctgacaccgacagacgaaggtgaacgagttttcggccgtagtatcgtaagcaacgacgatgttaagagcaagacggtcaagttcgcatttggagtcgtgacgaacgcctgtttagctggtgaaatgaaaacttttgaatgtcacatcgaaactggatgtcggaagggtttttcggacacgaatgaaaaaactaatttcataacttgcttggaaaccgtgagatgaatttttttagcctaactaaaccgtcattaacacatatggattactgtagcacttatacctaatcatggattaattatgctcaaaagattcgtctcgtgatttacatgcaaactaagcaattagtttttctttttatctatatttaactagcaaaagtgcctgtgcgtttcaccgggtgatcacggagtgtgtacagtgataaaaagtgttgtttggtttaatcaactaatctgctcaaaaaaaatttttgtttttagataaataatctgctctatatttgtggaatatatatgatgtttagttgggatgatttgtagcatgggagaaaatggatgaacgaacaatgcgattttctttgcccaaaaggcgacggataaaaatttgtatcacaaatggaaatatttatttttttatgtaggtaagtctaataaaatatgagtggaatttttgtactaaatgtactttgagttgcgagaatatatacttttttagaaacacgagcaataagattgacgaagttaccacaaacgccttgagcacccgtcttaaatcaaagatttgaatctaggttgattggttcctccacaagaaacctatccagttaaattatacccactttgcaattgtgggaatatacctgtgtattggtacctaaataaaatgtgttgagtttaacaaatcgtaaaaatcaatcttattatttttgtgagagtaagtattgtttttttatttacaaattgtatttgaggtcaaatattaataagtagatataaaaaaatgaaagaagattataaagggagggaaaaaaataaaaaaagagcggatatggacaaagaaaaaaaaaagagcagagggaacaggtcaagatatttttaaatgttaaacatttttaataatgagatgcccgtgcattgcagcggatgaactaaaaatataataaatataaaaatattataggattaggatttagattttatgatatgagccccg

SEQ ID NO: 13973 - DNA, 15057 bp, Oryza sativa
  unsure (1)..(15057): unsure at all n locations
tttggttgtctagttgattgattgatttaaagatctagcttggggatgtttttttgaagatagactcggactcaaatgaacgaacctaaattttgggagggacggatcacatggtcgtatggatgaaaattaggtgacgaaaggaaaataggcgacgaaaggaaaattatgaataattagttaagataatgggtttattttatatacggatgacgacggaaaattttttaattttttaattagttagagattagagatagagatagagattagagattagatcttttctttttgtgattaggaatttagattgtttatttattttttagaaataaaaagaaaaaaaagaaatagggaggggagctctttttttttctacctcgattcgctattttcttacagttgccgcgttttttttttcatgatcgcgcgatgacgcggcattgcaggcatgatgacgcgagcgacgattttatgtgacgtgagcaacggacgaaacggacaaaacaaaattacagcttgtatttgatacgtactcaaggccattaatcaatcggaaaaaaaaacatacgaaaattctaatgcattagttaagatgtgtctaaagatttgacgttatgtttttgcgaaaagttttcggaactaaacaggcccggaggacaattagtcaactgtaccacccacgtgtggccactgcgcacgtgccaatctgctgccgccacgtcagctccagcatgtggccttcgaccttgactccagcgtgtacaaacatgtacacgtcagcatccaatatgacttgcctggttaggcaggggctcagggctggctggaatcatcagcaacaggaagaatggacgaaacagaattcatggcattcagagcacacgcaggaaggaaacctaggttgttgataaataaacagcagcacagggtgtttggttgtttggtggtgcttttgctgacaggacaggcctagctacaaaaccaagatccagccacaaaatttgcccaatcagtcacaccgccacgggaagtaaaaacatactgatggggcatacggattcatgtcgaaacccccatacagaacagcattatcagataatttaagcacacgagttctcaagcttcaagggcacctcctcctgatttcatcttagaatcgaccacgcccacggccgcgaccacggaatggtcccggtcctccgccccttctttccctgccacgtcctgtgaagccgaccgaggatgagaggagccatgagaagtgagatggcgaaacctggaaacattgttggttatgttagactgagcttaccacggcctggaggggggtagtcctctggttcttcaaagtattcgccctgatcttcataatagtcccccctgccgccataaccgtaatcatagccatatccaccacgtcgaccacctccgtagtagccaccacggcctcttccacgtcctcgtcctctaaatcggcctctccctctgcctctgtagttgtaataatctccttcctcttcccactcctcgccataatcataagcggggggaccattgctcatggctgcacatttgctatgaaagaattagcaaacataatattatctagtcggcaagacattcaacaaataacatacactttttttagacttgcagatggaaaaagacgcataattgaatctacaaatgcagctagcacatttttaaacaaggcacaatgtaggaagtgttagaaactagatcttttatttatttatttaagaacaacaggatggtagaagctgcaaagccagttcataagattgaaagcagtatggcatgctacctacaatggtaacagatactggtaataaccatgtgtgttgtagtctggtagttttgtgctcatagaagacataagaaagaggatacctctgcccctgcctcttctgccaccaccacggcctcttccacgattagtggggaaagattctaaatttccatgaaggaatttgtcatcaaatggttgtgctagtcatatttaaagcaggaagtcagaatcatgcgagaacaataccttcgtgttcatagtcaaaagcgggtctcacttcttcagctgggataggtggctggtacctaaggatttaatcaacagacaatgatcagacatattcactatcagtttcaaattaatatacagcaccaaataagtgaataataagtggataaaacatattagctctggacagggttcaacttaccctggagataacgtatccagtgctttcttggataatgttatggcgatcattgatacatgccgggtggtctctaggctgtggtaagcagtacactagtgtcatggctcacgataagtctttccttttcttttttcttctgaaaaaatacttacgggagaaggccttcttccaaaggttcccaagtgtccgtgatgtcaattgattcagtagatgtaatctgatgaagaccaccgatccttctctgaacaaaaaatttagagtaagttgaaaaaacaaagaataactttggtattagatattactaggtggaagtgatacttagcactaaccttgatcaattcaacaaccatgactgtcttattgatggctcttcccatagctttgatgacaatctcatcatgcccattttcctgaaaaagaagatatggggatgaacatattgaacatatagtcacattatccaggattaaataaaaaacatgagactgcataaggatccacaagaggaaatatagcattgttgaccactgacgacccaataaactttttggcataaggggacatatgcaaacattttgacgatggcatcttatagaataaggaacactgtacataacaagctgaagaaatagcatatgaaaacggcaaaggtatcttctacacaatcaagtgaatgggacgaatgtttgcacatttgtcaggctgacaaactacacatatttcaggagtcaggatcaaatgctacgtaatggatacaacgacaagcgataatattcagaaagttcaggagcagtaacagacattaagaagcacaaggaaatactggaaggaccaggaggtcctctgcggtactacagtggcaactgacgatgtactatgccaacctaaatcataagcagaggcagattcacctccgggcagcacaggtggctgcccagacttcatggtaacatccctggaggtcgacgctaatttttccctgaaatagagtagttcccgggcaatgtgtaaatgccaaaggtgggtgtccagcaaacagcgatcctgcaggctgcagctagcaggttgttgccatcctcggcttcctatatggcctgtctcacagtcacagtcccaacttaacgcctcattctcgtatcatatgcatgaacttgtacatcgaactcccaatctcccatgcatctctaggcatcattttagatgtacagtcaaggcatcaaacaatataaaaaacactgaccaactaaatttcaattctttaccacggtcttgaattagactgaataatcagtgctatagtttcagggacaagctataatacttcctccgtttcatattataagactttctagcattgcctacattcatatatatgttaatgaatctagacatatatgtataccaagattcattaacatctatatgaatgtgggcaatgataaaaagtcttataacctgaaacggagggagtaatacttagttcatatataagacaagtcttgaaatttttcgatgtataaatttagcatgaccgaccaaggttcaccaccacatgtagaaaatgcattcgccttgtaggatgtattagcaaaatgcttcactctaaatatgaatatgtattattttcttatatgttgcatggatataattatttttttgtttcgtgaggtgcttgggtgtgttagcgaattgttgaggcagcagtaatattgaatttagcaccttgaattgattatactgattatcattttttttcatctataaatatttacatgcattttgggcatgtttctatataaaaaaaattgggatgccaattttgatggcgacatatgagaatatggatatgctttagttaggttttcccaggcttcatagaattcctggcacagccactaatcataagagcagatttcgaacttaaaaatccaaagatacctctgattgagctgtgcagaggtgtgaataagacaagcttacaaaatgcagataacagagattttggggccttttgagccatgtacttttttagacttatgcagcaataaaaactgggtacaagcagatgcagaatttaagataaccgaacagcttactattggtaggaaacacttagtgataaataaaggcatatgcatgagtgcagtacatacagggtatccctaaaaatatcttcactgtccacaatgtcaatttgcaagcgcgtcctgttaattgttaaaacatggcacaaaaaaggttgctgcatgttctacctcaaataacaacatagccaaaggaaagtaatagtagtagggtcacctcaagcaacgacatcccatagctgatatagttcctcatcctcccctgtgcagtgatcctgatctcattctcactaattggtgtctcattgcgaggcttctccaccctttggtatctatccatgcctatgaattgatacattgatatttcagtacgacaatatatacaagccacaatgtagaattacttcaagataggatcataaattatgcagaaataagatagggagagagcaaaccgtatacgaatataagatagcatcataattaattttcactcgatcatatatagactgagtgagattccaacgaccggtgaaatttatacaaaacctaagagtaagttaaaaatgaaaaccatcaaagtccccaaccaagatgaatatcttttgaaactagagattaaatctattactgcaatctgacaggtaagaccaccccttcatcgacttgcaagaaaatgattaattttcgctaggaaaatgcaataagattctctttttcactcatcactctttttgattctgtaacaaagcacggacattctgctagtaccatgaaatacacacaaaggagatgaaacgtggacaaactgaggcactaagtacagaaatctggcaggtcaagatgaagctccctctcacacattagtgaatctacttaggaccttagtgacaaatcacagtcacagtgatgtttgcaagtgacactcaaacactgaggacctaaaacacagcaaagttcattagagcagaacgttagtgtgataattcagaaacccaacacgtagcacgtacagaaccattttgcgcctccgaaatcgacaaccaaccgttcagagtagtcaatcacaagagtgcgaacaccggctactaccggtacacctagaactaaaaatataactcgactgctactcccaagccttagtcgtttgatttaatcctaagacagagtgattccaacacaagggaacagaactccaaccgcgccgccgaaccaatccccacccccacgaagagcagcacccaaacacagctacatgccgcggcaacgcgcagagcaaccgaaaacccacccaaaccccccccccccctacacctcgcagtcccgccaccaccgaccaaagcaccggcgagtccagcaccgccgacgcgcacgaaaccacgggaagggggaccacaaccacaaaaccaccaaatcgagccctaaaccgtcaactccccccacctcccaaatccaccaccaccacctccaccgccgccgccgccgagtcagcgacgcgagcccaaccaaatcgaggaggagaggaacgaatcgcaccttccgattgggctcgcctcgcctcgctgcctcctcctccgcttcgtctatgcaactcctccgctgcgactctgcgaggcggagagagaagagaaaaaaaaagaaaaaaaggagaggagttttcaggtggttgcaatgcagaggagaccggggcgcgttcccgtatcccgtacgtggcgtggggttacggctctccgcgtggggctcccacctgggcgcggcgcacgtgggccgcgccacgtggggagatcctgcgcgttggtttggggggatgggtggtgcggattggggttggtccatggaccgggcgcggggagggttttggtggcagcgggtgggatagggcgcctggttcgaggataaggggccccggtttttcactgccgccgtgggtagactgtgggccacagttgtcagtgagcctggttgtgttgtcttgtactcttgtgccgtgctactgcgcgacacgtgtcgaggtaattttgccacttggagtgttccactgtgcagtggtcacatcagatttttcactgtttttacttggagtgagattaaaaattctaaggtttagatttaaattttacagttaactttaagatattttatttttataaaattgtcttctaaatcgctaagaattttgaatataaattatttttattttccaatatcacaaaatatgggaaccgatgaaacctgatgactgagggtgcgtttagttcccgtcattagaagtttagttgaaattggaacgttgtgataaaaaagtcagaagtttgtgtgtaagaaaattttgatgtgataaaaaagttgaaagtttggttgaaattgaaacattgtgatgaaaaaatcaaaagtttgtgtaagaaaattttaatgtgatgtaaaaattaaaagtttgaaactaaactcggcagaaatacggtttttagaggcacatctgacggtgcgcaaatttccttacgcaaaaatacacacctactgacctacataacattaagtacagtgctttcttggaacaaaacagcaatgacgccaaaatcgacaacaagcaactagcaaaaccgcattacgagatttaatccatagggttcaacagagttaaggtagggacagcagaagggagcacaaattcatagatcaacaggtcctgaaacatctgctacaaaacttaataccccagaaaatatcaagagaagagaaccaagtatagagtagtgatgatcgttttgacaaattctgactttgctgaggaaccgcacaaactaagccttgagcttgccgaagaacctctgtttctcgtcggtggtctggaagcgaccgtgcccgaacttggacgaggtgtcgatgaacttgagcttgatctcctcgagcgccaaacgagaggtctgcttgagcagggactggcggagggtgacgaccctcttcttggggccaacacagcaacccttgatcatgaggtagtcgcccttcacaacaccgtagtgagggaagccacccatgggagtgatgtccttctcagtcctgagcgcaagagcaagcacaatatcgtttaagtttcgctcgcaaacagatgcaatagcatatcaaacagaagacagatttgcaatcatggagtgctggtgtaatatctggtagacgaattggtacctgtcaaattcagtgcaggcagcatggctttcctggccagacttgccgatcttgtaaaccttcttattcatctcagtgcggtggtggtacccattctgaccagcgcgagcaacagtataggaaaccctagcaggatgccaggcaccgatacaggcgaccttgcggagacccctgtgggtcttgcggggaaggcgagtgacaccccaacgcgtgacaacaccttcataacccttacccttggtgacaccaatgatgtcaatcatctcgtccttctggaacacagcatcaactgggatctccttctcaaagaacttgtatccatagtccaccttatcggcaatggtaccaccattgatctggatctccatgaggtgagccttcttctgcttcaagcccttcattttcctaatctgaagcacataaagatttagaatgagaatgaacaaacaatttacagcacatggttaccatccaattaactgaatagaagggctcaaaatacaagatagtaaaataacagtaggttactgacctgagtgtgcacgatcacacggacaacagaagcatacttcttcatcttctcaagctgcatttggatttccttcttgccggcatcgctatcatacttgagagcatacttggtgaaagccttcttcttgctcttgcaccagttcttgtagaaccttctccttacttcttcactaagatgctgagcccagacagagttgagactgcgtaagccacgtggagtcttcacataggccacaagtccaacaacgacaataggaggtgtctcaataatggtaacagcctcacaggtctccttcttgtggagttctgaaaagcattagaaaaatgacaaggttaaatctcttcagtagtatgcatattcagatgaatactaaagtcttagtattaaagtcttggctaaaggccagtactcaactatgttaggacttgttgccattaattcagaatattatgttcttccaagtaaaattaagaacaacagatgaaactaatgtagttgcttcttccgcatagtcacaatacatggtcatctatttccaggttgaacaaaatagcattggcaaaaggcaaaaggattagacacatactggaaccaggcttctcgacctcacgcacaatgtgggtcattccagccttgtaaccgacaaaggaggtgaggtggcatggtttgttgacgtcatccttggggaatgacttcactgcaataacagagaacaaaatatcagattggtagtgtaatcacacataaacaactggcagtgcaaaatggcaccgagaagacgactggaacaagaaaaaactaaaagttgaagctaagccttagagactgctagaaagaattcccaaacttggatattattggcaagaaaaacaataaatttcagcattttgaaaaataggcagagtacactcatgtcagatatgcagatatatggggaaatgcatcaccgcaggggtatgctcttagtaggaattcaacaatcaatgatggaagcacatggattgatcagatcaacatagaattattacctcatttttactattttcccccattacactaacaaaaagaaattatgtggaccattacactaacaaaaagaaattatggggacaaatagagcataggctttcaggtcatatatacagagcaccagaatcaaagtccattttgctaagaacactggggcgcacaacaatctagccaggcacacagaactaggcctatagatccatacagcaacagcatctcgtccacgactacatcctattttctaccaagaggatccaacaagtttctactctaccatacaaggcgcaagctctacaaatacagcaccgcacaagcaaaagagagagagagagagagtaggtgagtgagcatacccttgccgcggtggcgggaggagcgcttcctcgggaggaagccgagggatccgtgcctcgggtgctcgaacttcctgtgcgacatcttcttactcctcctcccttacctacaaaatcccgcgagaaaacgcaaactccatcagatccacgacaaaagcaaacgcggcaaagcacccaccggtgaacccgcangccgacgccggcaacgaaatggcctagccgcgccgccgccgcaaggcgagcagcgaatcgaggggaggcgaaggatgagatggttacctggttgcggggtgcggcnnccgagtgcggttgggtngtgtgtgnagncgnagcagggtaacccctaggacagcgcttataaaggngggcgccacgacgagggttttgatgggtcggacgnaaatgcccctccgcgatgaatgcttctagggctttcttgcttctctgggctgggctgggatgggatgggctctggcccacaatacctccacttgacctcttcgtttgctaatcattttctctgttttttttattattcttctaagaaatatcttttttcttttcttcttcacttcctttttttctcccatgctcatatatggggttaaatcaaatagcacttgcaaaatgttgctctctgtttcaaattttcttgtgttaatttatgtgcttttcacttcattcaagcggaaagatgtcaatgatatgtaggataactttttgacatggtctttgaccactcgttgtattccaaaataaataaataaaatattaagtatggcttatacttaagatgtttacgctgattcttttcgaataaaatgaataatcatgagttattccaaaagccaatggtatcatctattaaaaaaatagaggtagtacatttttttctgcctcttgagtctcgaatcacttgtggcagaagagatggaaatgccggggaaaagaatgatatatcacttggcagagccaatttcagaaggaacaaactaccgacacaattacatgcaatgtacttaagctgtctgctctatgcacccgataagaatacacaatgactcaaaactctgcactctcgtatagttctgaacacaacaagaatgttaactcacaccaaatttctcaagtcaagaacaccaaaacgaaaagaatgatgaaaagaaccaccaagaatgctatcatcataatctggcctttcaagctggccttcttcaggaccatggccacccttttctgcacgaaatcaaaagaggggaagaattttcaggctgttggaatctggagtcaaaacagactaggtggaaaatatgatactccctccgtttcagaatgtaagtcattctagcatttctcatattcatattgatattaatgaatatagatagatatatgtctagattcattaatatcaatatgaatgtgggaaatgctagaatgacttatattgtgaaacagaggaagtattccttttgtattgggatagagagagatataacgcatgcctgcacaaagtcgagcctattggtcgtagtttccatgtcaaggcttagctcccccaaaagtctttcctgcgcaagatagacgagaaaacaaacattggcatcacaaaggacaatagcatttcaataacacaatatacagtagtcaaattaagtactgtacaacatttatacaaggaaagagagtacacaaaaaactatttgtacgaaagcaagtaaggaaattagattatcataactttacctgtccaacaagttcatcatgtatggtgagaccaacacctccaattcgctggacactagcactaagctcatccaattcctcatcctgtcgcctacagaagaagtgcaatgcatttatcagtgatcgtttggtccacagttcatacgagagaggaaaaaaaatagaacaaacttatggaaggcaatttcaaatctcttgtttaggaaattatatgattccatggagcagaactttgattctttgtttctttgagctacaagttctaatttgatattcgaacaacatgaatctcaggaaattagatcattttggtaagcgcttacttaatcaggagcatctgctgatctgattctgaagcaatgaagtcatcgttatcttgagcaatgtgctgcttggacctcactaattcagaaggattgactgaatggccaaaggcactcttttgctttccagcttcaacacaccgccttatggagaccacctaggttatttcaaatattgttatttgccacatcaaactcattttatagcagaaaatcaggttgtagactatcatactgcaagactacctggttacgagcagtgctagtccagttcctcctttttcctatttcaacctcgttaagtccatagtaagctggatctctctcagcaactgaaatagctttctccagttcaaccacctggatgaaaggtcgaaggcatatataagtcagagatgaagtaagaacatgaaaaagaaatggagggttaacgacagtttataaatacgtcaaaccattctgaaccttatgggttgtgagtggttgcattggccaaaatatttataaaaaaagtaaaagtacaaaagagtcctgaggcagaataactacaggcatcatgagcctaaaattagtatgacactaaaaatatggtggcaatcccatatacctgccactggatactttcgcagcttgctattatttctttggtcagatgcacatgttctccagtgttttccggtgtttgcttccactgatgcaaagtatcttgaattttttctatctggacaacaatgggacaacagaagagaagttgttatatgcatcatgaaagtaaagaaatgcactacttatagtatcatttgcggtgttattatttgcatcgaaataatcgttggaaagaatataacacaattgtcttcagaccttgtagtaacagaatacatcattaaagggaaaatccttcggtaaaaaaaaagacggtataatgccaaattgtaaatgaggaaaccagatatcatatatactcacaagagaaaaaaaaagatatcacattcacatatactaacagatggcataacaactctgcacaacatcacacatagtagctacattcatctaccacacacccaagagggagcagctctatcaatctctcagatccatgaattggtgagactcactaagacgcattaatttcctgcaattctcctacagggagttaaccgaaaccgaagagcccaggaaacggatccagagctgcaattgtgtgcaacccagagaagatcaaaccgcttgaatgagaatctacacagcgaagaacacggcaaatcaagaccgaccacacaccagtgagtgaccaccagaaatcactggttcaccgcgatggagtctagcgcccgagattcgcatttacacgccacgacacaagagaccccgctgctttgtagggcatggacaacccgggaaacggatcgagcgagcaagtgaacgaatgaacgacggggagaggaactcaccgactcctgaatctcgtccttgacaatgtagaaaggatcctgcgcggaagccatcctgttcccccaagctcgcgaagggaacctggagagggagagctcggccggatcggcggagcggggagtgacgcgggcaccttcttccggtccggccactccgatgtggcgtcgcggacgaaaagggcgggagacgaagatcggggagatgtctacacacacccaattgtggggctgggctccgatcctccttgctgggctttaggcccatgtgatctattgggccgtaaataatccttttattgcgcattattttgagtaaatttgtatttcgctgggtaaataatactccctctattccaaaatatagggcacaactatttttaaaagtggtttcataatataaggcgtgcatgcatgcatgcaattaattagcacattctctcccctaaatcattattattttaaatcctatactcacaagatcttcaattctattggttgcatgtattgtattaattggggtgattcataataacgatgagatattaattatttcttggtctttgggataagggtggttatgctttatattttggaatggagggagtaaatacgtactaggttataagcagagactttactctataccccctctgtactcgtaaagaaagtcgtttaggacaatgtttaagtcaagccttgggaatacaaatcataaataactctcaagttgttgagtttgaaaatataaaaaatatatgaatagatttatcttgaaaaatactttcataaaagtatacatatatcacttttcaataaatatttttatagaaataagaagtcaaaattatgttttggagaccgtgtcgctgtccaaaacgacttcctttacgagtatggagggagtactagtttgcaccaaaaataagtttacaatgtgtttttcctatacgtgtgggttggtgtgtagtaaaactagatgtgtaccccgcgcgttgctgcggaagaattatgtaataatatagtagatatgagttctaaaattttctttcaaaccaactatatgatttcttttcatgtgtttatatattttttacctttattaattatccaaatgtcataaataattgggttgtatggtgtatcttttggtggaaagagatgcaatttacacttttgatgaatcatccaaagtcttaaaagaattgagttgatgtggcttcacgacagaagagagaattagcattaactacacgtagtggggatgaacttgatagatatatatagatataggatttgttttcgtttgccataatatgaagagaaaataatactatttgtttattaagcctgtaagaaactctgtaatatagtaattttgtgcggtaaggatatattatcagtcgctgcagaaacgctatagggcagcattttgctgggtaaataggattgaagcaaaataggtgaggaagccaaactgattactttgcaatagtttgaagcaaaataccaaaaattttatttttgccattgacacactaggtgagcaattttgttaccacgtccatgtgctgatttaaagttttttttttaaaaaagaaacttattttttttctttgccacaatataaagctaaaatatttgtcattaactgatcctgttgcaaacaatgaattttaccccaccatagctaattaactcatataataataagcctgtaagttacagaactgaagaaactctgtaataataataattgatcactaagaatatgatcagtcgccgccattgatcactaagctagtgcagtgtaatggcaatggacgccactaccatcaacaatggcagcgatcccatcccctttccctttctcgcgccctatataaccacagctcgccggcgatcgatcactgcaccatcagcttccacaaacccagctaaccaagtttaattgccaccaagctcaccaatggcgctcgccgtgaagctcgccgtccttctactacttgccgcggcagcagctggaggaaagcagcacgacgaccgtgcccccgctagaggagaggctgggcgcggcgttcgacgggatggcagccgccgccgaagg

SEQ ID NO: 13974 - DNA, 1139 bp, Oryza sativa
gcatgtatatacattactatacatcgtaaaaaagagagcctattaaacatcaaccgttgattcattaaagggtagtttagagattggaaataacataacaggtagtttagttatccatgatcaactggaacttctctcttggccggctgtttgctgcctgcccttgattctttcctgttttcatagtcatcggtgttcgtcgtcgctgagttaaaaaaaaacaaaaactgtaatgcaatatcaagggggcacatgtacacaaagcatgacagaacgtataagctgaagataattactaagaactcattgcatgtgcgtctttgtgtagtttgtcaaaatatttctcacttactatggatgttatcttagaaacccctggggttgaagatgtatcgtcattatgaaacatgactctttgaagcggctatgattatcattgaacacggaaccgagaagaacaagcaactgttccagctaagttattggaggcgaaagagaggaatttgaaacatattggaacacaataacacgaatgagaaaataaacaccctgtgtcatcgatacagagtcaatatatgcagtaagttagagcatcacaacagtcctcctatatttttttctcaaaattgattttgaggaattttatgtgaaaaatgggatccaacagattccttataatcctacatacattttggatttccttccctgtatttctcgctcagttgatttgagggagagaagcgctcccctccgactcccagtccaatcgtgtctctcccgcgctagtgagcagagctatctattcccgcaaggtatttcacgcgcaaggagaaaacaggaaaaccaattctgttgttagttcaacagaagggcacacttttattttttttataaaatttagactttctcttggagatatctaggtagggattatatataatctctcagtgatgctaggaacagttatgaaatataaattggacctctaatctaaatgcatctacttcgtataaccctcgcatctggaattctggattgcgcatatcgggcccgtgcattgtttcgggcccagtgctaagctctattcatgttttcctttctttccttttggcgcttcccacgcttgaagcccatcagga

SEQ ID NO: 13975 - DNA, 461 bp, Oryza sativa
gggtttttgcctgctcacatcattggataatcaagaaaccattccttcaccttacagcgttggacttgacctagtattgtattattattaaatacagtagcatgtagcgattgcattaagcagtggactgcattacgaccaacgcatcaccgaggcttacggcttgtaatccatattgtagactgttgaaatgagtgaggcttaataataaaaaaggagagatgaggatctgacaggattgtgacacgtattataaccttatatgtaacataatcaatttgctgcttgttgttacagctttgtttaaccgccaggttgtgtttgtgatttgcagttggtctagagcatgattttttttttgttttatccacgtcgttgtaagattcttttcacgtgctgacgttctgatagcttgtcattactggagcactgctgatttgtttacccatttgccgtaacaa

SEQ ID NO: 13976 - DNA, 660 bp, Oryza sativa
aggaagaagataacctatgcaagtcatgttggattgtttagtgacagatagctaatatctgtagtgtatattctctatctgtgattttcccatttcacttctattggttcataaaatatggggacggtcataggtagcaactaggttgcattttagtgctgttgttttcatgtccatgctttcttttcaggcttgtaggttttctgccattattgagcttttccatggccactgcaaacaatccaggtccccttgacttggttccaggtttttcacctgaagacatggacaaccccattcataatggtaattgcctttgcattttccctgtccttttaggttgtcaaaacattgaagtaatgtttgctttcttttctttttcacagctgccttatcctacgtgtcatatgatagatatgtgttagatacctctgaagtgtattttgatgattgcatcccattggagtcttatctgaatattagaccaatggtgacttctgattcgtatcagtttcgttcatttggggaaactaatccaagtgtgacttatctggttgcaacagagtcatgtaagaaagtaatcagaactatgctgaaaggactaaggacaaatgagtcgagaaatttgcgttttttggatttaaacatttcaaacatctt

SEQ ID NO: 13977 - DNA, 1665 bp, Oryza sativa
ttgcctgcctgttttcttcttcttgaagagaactgcctccatcgcgcgcgggcgatggcggccaggaacaaggaggaagtcttcttcgatcccgtgtgagggtagtgaggtcctcaagaaggaggcctctctgggtgtcgaggaatgtcccggggtccatggagtgctggttggaggagtctgggaagaaggtggtcaagtacaagatgcctaatgttgttatcaaacaaatgatgagctacccctacacctacccggagtacgcctacaccgaggaggagctggcccaacgttctgcctcaaactcagaaagttcatcgatgaaaagatgaacgcctacgagcagaacctcatcgaccagtacctcaaacatggctatgcgttcgacgaggagcacaagtagcaacctgtctgtgttgtgctgcaagatccatgcatcgtgtccctgtgtctgtgtgtgatccacctatcctaattccttcctaagtgtaagtgtctgctcaccaatgactatattctagatgatgggcctgcacacaaattttgtaatccattgtttacatggtttaataacgtgcaataatcagaaatgtgtgctaaaccaaaatcatatagatacaaaaccctgagtatcgatgataaagcatatggtgtcggttttgaaccctccatctacatgccagccagtgtccctgaccatttgaccaaacacaagtaaaatgacaaccggtcagcaaaacattatattttccatagatgccttctcaaatagcttgcaaaagagtcagtttctccaaattaattgctagactgattgacttcatttttcttttcataaggagcaattgtaaagtccatcttgaagcatcccagatatcctatgctaatacctacactccccctgaaaggcatgcatgaatatggtaactctgagatcacacaattataacttaatatttctgcatgattatctctaagtctcttagcgtgattagaagatctttacttgttccttggaaacctcatgaacaggtgtgcaacattctgtttaatttgaatcaggcaatgtgctctggaactaaacactcggtaatgaacactgaaatgcagccaagagctaactaatcaacacaatacgcacaacacgtctatgataatctgaaacaacagcataaattcacaagaaattccttcgagtgacgtatatttataacctgtcacctaacatcttccctaaaaaaatgttatatcttccctgaaaaaataatccagtttccacaccaaaaactttcaaaaaggtttagacgaatttcccctctattgattttgcatatcaatttagacactgtacttatttgaacccaaccaaacaactcccacgggtcctcgagcagtacaactatctaaaaacttcaactgtgtatattattatgccatggtatattgaatggaaattaaaaataatgtgaaaaatcataatcccttcatgttgaaatgcatttttgaccctaagatataaatgctgggataattcaatatggttagaggtaaaggcaagcttcacatggtgtggcaagaaagctgggttgtaagccatggaatctagtttcagcttccaagccacgtgtattgaacacgttaattgactgcaaaaccacgcagatt

SEQ ID NO: 13978 - DNA, 727 bp, Oryza sativa
ggagacaagaagaagaaggaagagaaaggtgcagcttaactgatggctaactgaatcttcttcacttcccatctgaattttcatcgaattcatcagctcggatgattggtttaatttaattcgttttcaagacaaaagttattttcagatgcaaggattaattaattaagctagcttgcctctttcaatatttgaaagttcatattgtttcagtattaacatgtgagtggtttttgcgtggaaatattgatatgatgctgctgcagttctgcccaccgtgctggacgtcaccgttgagacgccggactacacgcagctgacgctcaaggtgagcgccggggcgcgtattatctccgtcttctcgcatggatattttcgcgtaattaattaattaatatggaccacccagtattctgaccagtgaccactgtaactgaatatgtactgttccttctattcgatggccttaattgtgcttgcatgttaaacgacaaaattaagtaaattcttctctagctttcacttgcaacactttcatcttgttttttttaaaaaaaaagaaaaaaaaactttgtttaaagcgaaagtgcctaccacttttctcttagaaactcctatatttatttttttcaattgcacagaaaacgtgttttacttgggctaattagcaatggcgagcgaccgagcatagccgcacttaacaaagctggcaagaatgaccccactc

SEQ ID NO: 13979 - DNA, 698 bp, Oryza sativa
gtagctagataagagtttgccaatagttgttcaaaatctcatgctaatttgactatatattcattagattagactgcaactcatatatatgaaaactacagttaattaatttatcatagcacgcacgtaaccatcaatatggccaatgtcataaaaaaatgcaatatgacactcatttgcacctgtataattctccaagcgttctgcaattgggtgttggtgtgcaggtaagggtttgtagtgggaagccggtgaccatcgtggcctccaaagctggattctatccagcagggaagcgagcgctcatcagccactcccttgttgggctgttgcagcagacgagccgggcgtttgatggagtacgtgtgaccttggagattttgtgatttgattattaatgaatggtatctcattgatgtggaaatatgtgtgcgattttgtaggcttacaaggctcttatgaaggcttttgttgagcataataaggtgaggtcttgctaatgcttgatttcttgattattttcagacatgcctgaatatgtgactatttaaaaattattaatttcaaagctaaactttaggttagagatcattttctaggtttattggtcaatgcatttgaagagacataccctattttccacggaaacaattgaattcgtggaatggaaataagctaatgcattttgtttcactaaa

SEQ ID NO: 13980 - DNA, 1968 bp, Oryza sativa
  unsure (1)..(1968): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctacgattatctcccttttcatctgcaacaatgttttacatattgtgctatgttccctgaagaccataaatttgctagtgatgagataattcacttatggataggactagacatcctacattcacaggatcaaaacaagaaaattgaagacattggattgagccgattgaatgatttggttagctatggattttttgaaaaacatgtagaagatgggtcttcatactacgttatgcatgacctactacatgagttagcattgaaggtttcatcgtatgaatgtcttaccatatgtagttcaaatgtcaaatctatacaaattctaccatctataaaacacttatctattgtggttgatgacatggacgtaaatgatagagtgacttttgaaaacatcaagaaggatttcatcacattaagtaagagactagatgttggaaaactgcactcattgatgctatttggacaataccatggaagctttatcacccctttcagtgatttgttaagaaaagcacgtgcactccgcatagtcttgttgtctatgccatcttatgctatagtcagtatgttgcataacttttcaaaacttgtccatctacgctacttaaggatcaatggaggaaaattttcagaattaagtctacccaacatcatatcaagattttaacacttgaggaaaattttcagaattaagtctacccaacatcatatcaagattttaccacttgagaatccttgatgtacgacaatgcaagggtcattttggtttaccaagagatatgaataaccttgtaaaactgcggcattttgttgtccaagatgataaactctactctgacattgctaatgtgggtaagataaagtgtttacaagaattaaggagatttgaggtcaaaagacaagttaaggcatttgcactaagccaaatagggcagctggatgagctaaaaggatcgttgggaatttatgatcttgaaaatgcaaaggcggcagaggaggcaaaacttttaaacaaaagtcacttacacaagttaatattagattggaatgttaaccattctacaaaggattattcacaagaagaacatattcttgaaaatcttagaccacatagcaatcttcgggagctacatattcaagggcatgggggtaccacttgcccttcatggttgggtcctaacttatctatcaaaggtttgcaatcactttgtataaacggtgtatgttgggacaagtttccacctctaggggggttgtggttagttaacaagcatggtgaaaaattcctggcttgtgcaagtggccgcagcttccagtatttaaaaaggttagagctagttgctataccaagactagcaaaatgggccggaaatgatgcttgttgtgtgctctccctgttggaggagtttattgtaagagagtgcccagaactcatagagttgccattttcacattccacttgtccttggtcaagacaggagatgaacttgtctcaattctccagactacagaaccttgagattgcaaaatgcccaaagctattaccattgtctccccttccttggacaagctctccatgccatgttctgattaaagaagttggatcgcattttcatctcttggattatcagagaaacaaccaatctgaacaagggttacaaattgagggaaaggatggccctctggatagta

SEQ ID NO: 13981 - DNA, 2136 bp, Oryza sativa
tgctcaaagctgatcctgcagctcgattcatttgtaggcgacacaacacgcaacctaataagaggtgtatgaggaggatacaatacctgcgctccctccaatcattgtgtataaagcattgtcccaattttctctcctcctactcaccctccttgtcttgtttcccatttccatcctcccttcaagatctggctattattgattgtgtgagaggcatggaaactctggtacaaaacctcagctctctcactagattgtccatatgggactttggggatttaagaagcgggagcatgtgttccctcctcacccaaggccaccttagagtgctggctgtccataaaactcccgaattctttgttgggtccaagccatcggggctgcaacagctctacatggatgacatcgtaggggtatttgttgagcctacttgcaggcttctctcttcatcactcaccaagttaagcttaagcatgaaccacaaggtagagcgcttcaccaaggagcaaaacatggcccttcagctgctctcctccctcgaggtccttatatttgtgcaatgctcgaagctgcagtctctccctgctgggttacatagactcaccagtctcaagagattagagatcgcatactgtccaaacattcattcgctgcccaagggctgttttccgagttcactagaagtactacatgtttatgaaagccaaagcgaagagctcaaaaggcagtgccgcaagctaaaaggaacaattgcaatcatcgaagatgaagactacttggaactggtaacaaatactcacttatttgacttagcccagttcacgttttgtttggcacaacactagtatgtcatagacgagcgcttaacatttttttttcaattagcgtgggaacttgtgacttttctagttaatatgggagctcccaagcttctagaaatagagttatgtgagaagtacacaccaaatctatgcatgctgagcttaatgaaagtaatatggtcagaaaacaaatatttacagatcaatgtatggacacaggatgctgaattgatcagaccaacttgatcacctatttgtcatatgttttctgtcgagcaaagactccatcaagtttgaaaggttaaattcaaaatgagaacttctccatgggaataattacatttaactagaatgtgcactacttatatgtaatatgttcctctgttttttcttgatcactacttctggcagtttattagcatgcaaatctggcagaagtatcataccatacattaagaaatcatcaaattatgagatctgtgaagggtgtaggttaagataatagtttccatgttgctatatttgagtctctgcacaggcttcatgtgttgatgccatggaattagaaaagtaataaggaacatacttatacatgattaatggtcctgctaattgatcaactctttgtgggtgctaatgtcgtgctcgtaactatcttctctaaccaaagtatgtatacatttggtaccccaagttttgaagttcttggaataaccggaaacagaggtagccttttgattctttcacagacaccactggtagatgtgattttccaagtatgaaatcgaagactcaatgatgacttacttgttatatgatctttgaacatgattctttcaagtatgttctttatatgttcagctacctgtagttgctgcatctaatttaatagagaaaatctcctgtgtacgtttgaaagttcacctaatcccttctgtatccctgaattttgctcaatcccttacatacccctgaattttagtttggatcccttccatgccctttccgctagttgaccattagttgactattaaattcttatgaaaaagtccattttgccctttggtataaagaagcatataaattaatagagtatattgttgaagcatagaaatttgttatatgagactactatgtttatgagatagttatgcaccatattatttgcgataaatatacttttagatatgatataaaaaattaatatttatttattagttattaaaagattttttagcatatgtgttttgatagtaataaataaatctgttgtattactataaaaacacatatgctacataaaagaacttttaat

SEQ ID NO: 13982 - DNA, 3178 bp, Oryza sativa
aaactaaaattcaggagtatgtaagggattgagcaaaattcaagggtatagaaggaattaggtgaactttcatgcatacataggtgattttctcaatttaatactcagggtggccatgcaccatggacagagatgcagaatcaataatttcaactcaagaaccttttatttttactgacaaaggaatgcataaaaaacaagtatactcttttttttcaacatattataagttctagtgagtgtttaattatgatagacatcatgttgttggtgctgtttatacttatttagttggatgcataggacaaactattatttgtaattacaccgaataaatatataaggctgccactagtcagaacacaatataaatgttacacctgtatggtgataaataggatggtcttaattccgagatgtgatgattgatgatcgcaagtagtaggagatttccccgcacaaagcaaattttgcgcgtgctaattgaatcggatttgttatacaacttttagctcatgcttacgtatatgcaattatatttaatatcttaactaattaaaacaatcgtcacctcgtccgtgcgctttttcatccgtccaccccccccccctcaaaaaaaaacccagaacacaaatacgagtccacatcaaaatctaaattggacccaaatcatagagaaaacactactacaataacacaagaacaagaacaacattaacacaagaacacaagaagaaaaggggagaatgctgccatcgccgccgtcacagggacacatggacatcggtccgccgccagcttccctcccgctggatccggcgaaggggaggacaccgccgccgggtcgccaccgcctcccctcccctcccgccgtatctggcacaccgggccgccgccgcctcctcccccgctggatccggcggaggggagggcgccaccgccgccgagacaccgggccgtcaccggcttcccttcccttccattggatccaggacgtcgggccactgccaccttccctcccactggatcggtggaggcgagggcgccgtccctgcccgccgctttcccttccgttagatcgacccccggtggtaggggagggcgctccccccaccgcctgtgatgagggaggacgccgtccccgccgtcggtggtgagggaggacgccgtcaccgccgccggtggtggggaagccgctgccgccgctcgcgggggaagggcgaccccgcccccccccccgtttgggggagatcgggggcgggggggggggggggtttgaatcctagggttagggttaggtttcgggtatatttatttaggttaggattaatctggaccgtccattcgattggacggctcaagctgctcccacgtcgggctgcctattgggccgccgaatggaggacgcaaaatggacatcaacgaagaaaggaaacaggccagaaccttaggctgcgttcgagcgcaggagaaagagagaaagatagttttgttttccgcgcgcacgcttcccgaactactaaacggtgtgttttttgtaaaaaatttctataggaaagttgctttaaaaaatcatattaatccatttttgaagtttaaaataattaatgctcaattaatcatgtgctaatggctcacctcgttttacgtatctttccaatctcctcaatcccctctttctcaaacacaccctcagggcacccacaatggttatctatagactctctataaaagatccatgtaagcatatttttctacttggaagagattaaatgaagagagagagcaaagctatctactaacctgaagatagtttatagagaaaaacgaggcaatttattagagagctatagatacccatgtagacatactattgagattgtttattattaatctagtctattgctgagatgtacatgttttatagatagcaccttactttaccattgcgggtgctcttagaatagataaaagggaaggaatataaacttttctatattcggcccaaacctaaaagggaggattttgattcctttttccaattaaataattgttaaatgatgtttgtattatttaaattagcaattaagctctgaaaattccaataaaatttcaaagagtgtaactaatcatggagaatttaataaaattaaatttaaccatgtcattttatttctcacttactttacttgtaaattgatttaattatacacctacctacttaaaaataccaaatatttcagcaaatttgtattttaattaattacataatgtaaatttttcttaacttttcctcaattttttggtctgtacattttccgttgcaacgcacgagcacttttgctagtatacaatagatattaaaagtagggaaaagctggaatacggtgcccccaactgcattcacaatttcatcctgaccgccctgtcacgcacgtgagagggaaaacagaagatttcccctttcctctctactccacgtcgcctccaccgccagttgcacttctcccaccgtcggtgcaagaagatgctcgacatcaaataatactcctgttcgcgtggaggtcagcttccgaaccaccgaagaaatcgatttgtatcggtttttaaagtaaagagatacgttatacctagctttgtggttgagggatacaatttgctggtgagggatacaatttgaccggcaagagatgaggaaggcaaaatagacttactcctaacaaaaatgacaatacattgctagtacttcagtaagtcacaaatactgtaatcatgatattatttattggctcaataatcatcatttttatccttgttatttcttattgcaacataacagggaaattgaagagggtattccggtaccaataatattacatgtttgctgtgaagatcatacatttaactcagcctcaggagctaatggttcaaaaactgattccacctcacccttgtccacgtcttccagaggtgctggcttccactttggattctacaaattgaaaaggaaatttagctatacgtttagtaaatatatatctatagagttcatctccaccaagtttagtaaatattatttctctcctcccttattaagacacatcccctcgattatttctagcccttgataattgatatgtggtccaaataatttccctccttttcttctcttataaag

SEQ ID NO: 13983 - DNA, 15665 bp, Oryza sativa
  unsure (1)..(15665): unsure at all n locations
agttaaacaaaacacaccacacatgtaactatgtgcctttttatattattactaggtatatggaaaaagaacagctatgtgcctatgtctagcaaggcaaaggagagtgaactttgcaccgtgccacacatgctataatgtctgtatccctctttcccagaagtcgcacagtgcgcaagacatggttgaattctaaggtctacctctactggtttacttcttattaacaactcagagaaatgttcaaactctgtagtacgaagtgttcttcagaatttcattgacagaagtttcgatccattagtggatagctccgcgaaaagtagctcaaggcttaaatattagggagtggcaaataaacaattgattttaaacaattaagcttcttaagtttaattacaagttgaataagctggcggatgatacgccacaaaagcaactatttaatgtgacattcatagtttgtaatttgcaacccatgtgctagacatgtggccctgggacccacagacacaggaggtgtctaattatcactatggagaggcaaatgtcagaagatggatgtcctttgaattatggaaatgtgatcctaaaacatttactatacgctatggtgattataaattgtccgccaaacaatttaagtaatcggagagtaaagagatactaagtcacatggataacttgcctggtccttgtcaactaagacagcacgtacaccttcaacaaaatcatttcgaaccgatgacctcaaggcaattcgatattcaactttcataacaccagccaactgaacaaaccaaatgtcagaattagcaatgtccttgcaaaagaaaaagagaagcctgaaaataaaatagttaaccaaataaaagtattcaattgtacaggatagcagtcataccttcgatagatagtgttcattattcctatatgctgatgcaacttgagaaaaatgtttttgagttaaacatagagaaaatggagccccttttttgagtcctgccaaggcctcgttggcccattctgccactgcagacaacaatgaaaaggatacacgtgcaactagtcagtactaaactgaatttataaaacggtctcaatatagaaacactgttggcacttgtgcataaatataacaacattctcttgacgccttagcttaaaagcagagtacctgcagcatcatcactttgactacacttcttaagctcttccacagattcagcaactgatttgtcaggaccaaaggaagaaatgatatatggtaaaaacttatctagctggggccctgactctggctcgttcttgaactttgtcagcaatgactcaacatctctgtgaggatcatctgtgctgcaaaaataaaaaacacgatatcagatgtcaagacactatcaaacagaattataaccgagttttgaatgtgtcactattattctattaatgaaaaattatggaatttatacttctttaaaagaatggaatggtggaggcagtgaatctgacatcccacctactcccattgtaaattttgcaaattgccccttgaatctaaatggatagccacatataaaatcaaattaagatggatgttccctatagaaaaaggatgggtaacacatatcatggaaaatatgtttttatttattttcagtagcaaagcaggggcattcagctagtagtaattaaaagaacataatgatcttgctagcatttagtaagtttttaccaaataacagttcggaacatacaagttagcactcaagagggattccctgagaggtcccaggttcgctgaaggtacataatgagttccaagaccaaagaaaagggcatcagcaggtgatgatatccttttccctgtcatcccaaggtaagatcctgaaagaagcagaagtgagcagtgaaccgtgttattaaggcggtatggcgaagtatgccaacccagcaccgccttaccgccatagcgataagacgtatggcgtggcgacgccttaagtgcattgaaaaataagaaagtattaagtaatatgggccctaaaaatactaatggggtactccattcatcacagcccagcccaatagtagcacttacctagcctagtccaaatactttgctcttttgacctagcaaacaacattttaaccctacccaacagcttccctcccagcagccgccacctcaccttcatctagatctctctcccccattgtgcagcacggctcctctcctccacctttcttctctccttgtgcacgatgcagcaagcatacaccatcatcctatcctttctctcctctattgcagccagcagccttctctcctccaccttttctctctcatgtggcacagcagcagcaggtggtgcctctcttgatctccctgtactccccatcagcacaagaagggagagggcgatgctagggaggaccagcagcaagacaacagacttttcccctctgctctcaccctctttccttcagtttatgcctgtaaggcggaggtagcctatggcggaaggatgccttgcccttctgggaacgtcacgatgctatagcgacgccttaataaccatggcagtgaatagaaggaaatgaaaaaggcttttacacatttggagcagcaaataatttaggagagcaaataaagacagagtttagaaccaggttacatatcttgcaaaattgaacaagaactgaataatatgcaatgtccagaactcatagctcagaactacagaacaattcctatgttgtcaagctcaaaatgagttatgatgatagattattaacaaaattagtagcggaagacatggttctacagggttactgaaacaagatagtcaagaatcttaccaacagcaccacctcctggagctttggcaccaatgtaagcaaagccaacgtccgggaacaagccaataccattttctggcatagccaggagcgtcctctgtaacagtagtgcatgcgaacattttgagccttacaattcaaatactgagaatacaaatgatgaacataaaatctaaatcagagttacagaaatttcaaacttgcctcagtaataatgcggtagcggccatgccctgataatccaattccaaatcccattgtcacaccatccatcaggcatatataaggttttgtatactcatgaatcttacaaatcaaagagtactctgctgtgaagacctgaaaacaaataaagtaccttttcagtgatgtaaattttaagaacattttggacagaggacatatcaactacatccattttcccatgcagcagagagaagggggaagggggagggggggggaggagtagaaaatgtgtgctactgcctactaggactaatcatgcctatagccctgtaaacaccatttgttgtgcaataataagatgcaaatggtgtctcagtgctcagcagcctaacctcaagtcatttgcaaaccagctaagcatgctgaatttcagttcccatggtactttaattaaaagaagaagaaactagcatggaataaggttcagaaacccctctacgactgactactaattacctaaagttggcatcaataattaaatatgccaccagagtcatattttagattatttatgtacaaatcagctggttatgaatcatatagaagttgttctgcatagtgtgggggaaacattaagtaatttacaaaaataacaatccatttttttttcaaatgagtcgaaatatgttttgcacaagtgcatgtatacatacatgatagatgtattatgtgaattaggcatggttaatccaaagcaggttattggtcacaagtcataaccagttattttcaaacaagtgcatgcatcaaggagcacaccaaacacagcttgtagtttgcagcagatagaagtgattgtaactgtgttggaaaatgatagtgcttcaaagtgagttggtggcggatcagatggtgttagaaaagaaaaggatacaacagactacgatggattaaacaactgaagtctttcaactgtatgtgcattgcacaacttgagaagaataaataataaatgtcagttactaaacccacagatcagttccttctttctttttatttttatgtgtaatatgaacgcaccaataatatgttttgacaacataatcaaaacccaccaataatatgtgaaaacaatgccagaatttttagatcctcatgtctcagtaggagcaggaggatgtacttgtatttttggatattgcagaatcatcagttaaatttaattatgtgttaaatctcaattattgtttagatgtatcaactacaatattaaactgcaaatcaaaattttcagaaaactatttcaatattgcatgactttcagttcgttatgaacttcatatacaaaaaacctattcagctctcctctcaaattatgattgcaatatcaattccgatatcttatatacactttttcagatacaaagagggcattataatttttagaaaatcagagcaaaatagccgcaatcaacaaaaggttttccatcatgcgatggaaactatctccaggaaagcattaatcatgctattactagacctctattatctctggcattgtgcaatcattagcaagtctcttcacatccccacctgcagtttacactaaacaatatcactatctgagcaaagcaacgattgttaacaacaccgttatactgtcacataaactggtgaacaacaaatagaaaagaaatatgagctttaaaagtaaatcagatcaaaaacacacatgacaaaggtaaaaaccttttgcacaagtggggtgctcttgtccttttgaatttctgctgcaacacccttaatatccatccctgcattggtcatgaatcttatttgcaaacatctccaatgctccggaaataaaaaggcgcaaaacagcatgttcaatgtacaaggcccagctttttcaacgaataaaaacagagaggtgatcaccagctgagaaggcacggggtgaactgctttccacaagaacacacttgacacttggatttgtttcccattcatcaagaaatgccttgtatcgaaggtccatttctgcaatcatatgagaccttaaatatgtgagtgaacctcagaaagctaccaatgtactcgatacacagttggtgtgcatcatttcttcagaaggttagtgtcacttatatacaaaatcaagaagggaattgttgagtaaaaaacaagggatgcttgttaaaaataaataaatatgtaatctacttttctgcaagtgaagaggacataactatcaataccataaatttatggtgtatctattagtgtctacatgacagcgctagaattgtacggagtacatgaaacccatgtaagtgcagtaagctttgcaaattcccagctccaaatgtgggtctagggctctatgctactaacggaacgcatgaaatctgtaactgagtgtcaattttcaaaacctcaaactaaaacaatcaactggatgaaatatttaacatgcattttgactagagtgccaactgtaccaaacttcacttagctgcatgccattgagcagcaaattattttgattgctttcccatcaccactttgagctcacaaaccggactaaaaagccgcacagcatccagttaaccactaacactgtacagacatgttcaccgcacgagcaacactgattttaattcattattcgcaaccttccaaactagtgggaacgccacaaatcgtggagacctccgccgcccggcccggtcgccctactcccagtaacccaaataggaggaggaagagagagagagagagagagagagagagagagagagagagagaggagcgaccctcaccgaggttcatggcgttgagggccttggggcggtcgagggtgatgacggcgaccccgttgggggtgacgcggcccttcacgaactcctccgcggcgccggcggccatggcggcgaaacggcggaaggtaagggtcggggctagggttttggaggcggatgcggcggtggagcaggggcactggaggaaggaagtggtggagatcgatccggggccgggcgggtggatgcgggagaggagagctcgcatagtgacgtgagagcaacccatgtggagaggaagaagccgagagcgagagggggggggggggggggattaatgtgatgaaattgactattgagaattggagggggtgtgttgttggagtacatttttttcccccaaaaaatgcgctgaactcgcgactcgcgaggaactgatgctaaaagtcagggaaaagtctaactgtcaattttcaaaaacgaaccttccgtctgacctgtttcactacatcgctaagatttgatttaaaaaaaaagaaatataattaaaattcataatgcccaaaatacccttgaggaaaccatacccatctttaaccctatccacatgtctctccatgtctctctcctgccagtgagttgcggcggcggcgatgtgtgcagcggggagggaggtggaggttggcgcgcgaagcagggagggaggcggaggttggcgcgcgaagaagggagggaggggcggcgcgacggcagctggcgccggagggaacgcggaggaataaaggaggcgacgtcagaagaagaagagagaagagagaactgacgggtgggtcccacatgtaatagggtcaaatgactaagggtaaaatggaccttttgtgcttcagttaacaccgttagaagcctttaacagaatagggtcataccgtatcttcaattttaaaaagaagggtcaaataagcaaagttgaaaaaagaggatcaaattagtagttagctttcaaaagagggtcaaatgcgcaattgcccctaaaagttagtactaatattataaattatttgacttttttaagtcaaactttgttaaatttgattaaatttgtagaaaaatttaacaacatataaaatattaaattggtttaattaaatcttacattaaatatattttgataatatgtttgttttgtgttgaaaatactgctatatttttccataaacttataatatgaaatgaaggggtactggtttaccgctaatgctaaaagggagcaggtcctaagcgtcatccacaatgcaatgataattaggccattcatagtacagatcctctacttacaggtcactaatatgtggatccgctggtagagggtccatatgtcagtgacacaagttagaggatctcaatccttgcagtgaggtggcgtttggtctaaatacgccactttcgagattcccttccacgtaagcagatgttgttcatagtgagtccctcgtcctcctgttaggatttggtggccttgttagagaaaagtagaaagacgtccagcgaagcagaaaacatgagagagatgttgccatcgcggagctcccatctctgccaccctgcttcgccggtttgccgttgatcttgcctagccaaaggtgcctccggcagggagtgccctcaataactagatctcgcccgatccacctttgagaggttgctgccttgatctaaattgggaggacctcgtcaacacggtgccgcttggcatcctcgctaccgccataatgtggagagaggggagaggaggaggcaccaccttgatccgcactggctaccccgatgtgcgaactgtcatgagtttgtcggccgcaccgccacaaggctatccacctcgctctgccgggccgagcgcaaatgctaacattgtcgacctgcgctgccccgtctactcattgctccatctgctccattaggaagaagggggatggttgaggcaagaaggagtggcaaaaagggcatcgacaagagaccgctgtcctaatctgtgagttgttaggagcttattgggagagggaggtgaggaggttgtcggcatcatcgggcagccgggcaggagggatagtggaaggagatgggattccattgttctgtatcacaaacaggtggggcagcagagaacatctttgatatatttttgtttagaaaaaggtcctttatgtaaagatctaactagaaaaaaaattaatatataacaagggttgaaacaaaatatgcatgggcttaaatgacaaaattgcatgggccaatggaaacacggtgcaccgtcgagatgtgtggttctatttactttcttattatgtagaagttgagtatccagttaggtgtagactacaatgtgagtactcttatctagtggtctcatgttgccagctcggagattctaatccagatcagcactgcgtgccccacgagagcgctcgtgccttgcaggggcacggatgccttgacagccgtgcaggtctcctcctctattgtgcacgtttctttcgcgagatagctagagagagaagttgcggccgaaaagggaaaagaaaatggccggaaaggacagagacaggtctagaacaacctttaaacttatcaaaatgaccttaccaccgtcaccgtcaccgggtgttgagctcgctagttggagctgtctagtacatttaacgcggatctggaagtatacgacgcatatctagtatttaaacggtggcgatactggatgccacaccctccccaggggggctggtggatgggataaggcacccccaacaacaatgatgcgtggaaggtcggaaacggtggccctcgcctatgttcaaccttctcattgaccgcgcggtgcactaggcgagacccagcatcaactccaccaatcgccttcaactgccattgccattgtcgctgggttttaggtaggagataagcaccatggggaggggagaggagaacgatggcggtggaaagggaataggataggtgccagtcggagcccaaaggggatggggggacgggggaggggggaaggggcacgggagagctaataacctagagatggggtgctatgtgcaagcgtgctatattcaagcgcatgccccctattgcttgcctagctgcttaccaatagtacaagcgtgctacatgttagcttatgataagtgttgactgtcaaaagcctagagacaaggacaccgaccctttataattgactaaatggtaagatttgtttgaattaaagaccgtgttttttcatcccatcccagggcaccaaaacctaatggttgttctatactcaacttgtccaaacattcagcacatgtctctcctcacattacattagtgcttgagttgtttaactaggcaagaagcttaatagccgagtaggcagacgtatgaagagaagatcggtccaatgtataatactctagacttattttagtcatcgtaggtaaatttagtaattagtagcgaggggaaaagtctaaagtacttctcgttaagaatagaaaattacgtagtaggagtatcagtgtattaccacgtgataggtaagtgatattgaaagtataagacttctcgattttgttgacgtagttaagagggtagaaattaattaacttatttttattaattttgaatgctaaaaattatgttactaatgtacaatttaagattattttaattttgtcactaacttcacgagtgtattcccgcctaactaccgcatatccatttgtggtgttcattgatcttatagccaaaaccaatcattagacgagacttgatagctccattgcatccaatctcacttttggaaaacggtagttggaacctgatagcttcatctgccaatcaaggcccccccgtacgttcgtttggtcaaaaagagatacatgttttccttactagaaaaaaatgtttgtacgttgcaacgggtaaaaatattttttatcctacgcactatgctccctttaatgcccatgcgttttggaccaaacgaacgcacattccttctgtccttttcagctctagtcctagtacagtccgctatctctctctgctcggtctacctctctttggctcagtccataaatggagttgtaggcccaagtcgaacagtattatgtccgtaccattacaaagccgatcctcccatcaaatccggtaatccgctcgagctcccatagtcttataccatgacggagccgatcctcccatcaaatacggtaatccgctcgagctcgcatagttccgtacccatacgatgactaacgaagccgatcctctccatcaaatccggtcgaatctttctccatatccaaaattattgagggatttttatccacttgatcttccttttccttttttttaccaaaattaaagcaatcagcaaaacttgggataaaaaatgacgacgattaaatggttcatcaaaatcgaagcaatctgcaaaacttgagataaaaaataactatgattaaatggagattcaatctgatgaattaaagctgaatcaaaaggggaattcatggggaaaataatgagagagtagtggggaatcaattattgcaacgaataggaggaggaagcatatggggagtaaaatcaacgtggcggcggcgctgggtttggcccgataaaaaaaccgcaaaaaaatatagcgataaaagaaataaacagaaaaattggtgaaagaaaatacgcaaagaggggaaaaagaaaacggacaaagaaaacaggaaaaaaggtgaaagaaaaaaaaagaaacgggaaaagaaaataaaaggaaaaaaacaggaaaaaaaaagaaaacgaacaaaatgtagttttcttttattttcgccactttcttatggggaatcagacttttttattttaggtttttttttctatttttttatttagacggacgaaggaaacatctcttaaaatttttaagtagtaatagatacaagataatgtaattttttttattgaacttgatgattacaccaaggtaatatagaccggtggagaactcatttttattcccggttaaaaacccccactagttccggttataacaccgtgaccaacaaatcgagactaaagatctcgatcttcaagtatcgactgaaataaccggtactaaatttgcatatcaagttaaaaaaaatatgtgggatgtgagagattcgaactcaagatctctcacctcatcctacgttaccgtccctcctactacacacatctaacttggatagatattaactaaccctgtagacatcttaccggtattaaaaatatctttagtacaccaaccgagactaaagagctaccaaccgagactaaagagctagagagctctttagtcttggttagtgttaccaactggtgctaaagatgcatttttagtactagttggtaacaccaactaggactaaaaaagtttccatgaagttaaatttttagaaccgatactaaagcatatttagtaccggttcctaatctaatcaagatatttgtgattttgggtaccacaataaaagattaattctctagtagtaataactaataattactccgagaatgcgctcggcctctgcctaactaggatgtatgtagctataacagaaaccaacaagtttaaaagaaagaaagtacaagcagcattaacgactaggcaaagtttgctacagaacaccgcgacttcgtggttttagctgtaggacaccgcacgaagtcacttttgagggagcgcactatgtaaatgtggtaatttaccaagggacactacatctattaaattaatattttcgtgctgactagacgagagggggcccacttttttacacagcttgaccaaattacccctcttatctcattctgatcctctcttcttccttatctattcccatctctctttcattctctcttttacacgacagcggatgcccacttagcagcggcagcgtgtgtggcctactcggcggcggctgcggcggcctgctcgacggtggtggcaaagcccggagcacatgcagcctactcagcggcggcgacgcacgcggcggtgccaagagcgcggcctactcagtagcggcggccggcggtggccgtggaccacgccagctgcaacgtgcaggtggcctagtgccggacgagcacccgctgctccagcgtgtgcttctccttcctcaacgcgacgacctctgaccgcaaccgtcatagctcgtcgcaccggtggagctcctccacggccgcccgcttcttccccgcatcgtttctcgcgatgatggtgtctttcgtctactcgacagcacacttgaacggcggttcttggccgcggccagctcgtgctcttcgccgagcggcatggaggaggggatagagagagaagagagataggagagctgatatgtgggctgaagggcatttttgacatttcacgcgatttatctctcatcttcgaccggaaattattattttaatgagtaggatgtccaccagtaaatatttaacttttgagagtgtcttccctaaaagtcacttcgtgcggtgtcctacagctaaaaccgcgaagtcacgatgtcctgtagtaaaatttccctaacaactatcaatcgtaatattagatcaccacacatgtccctgttaaaacactcttgaccacatgctccaaacatagatatgccggcaataatcaaatcctgcaaggtgcaagctgggtttctatagtataacccaagtgcgtaaccaatggatagataaatagatagcccgcatgggagaaaaaaaatttctatcaaaaaaacatatcactccaacataacttaagcaaccagcatataacttaaggggggtttgtttggagggactaaagtggggctaaactttagtccctctcacaaaaatataagtccctatacttttgtgagaaggactaaatttagtccctaattcccaaacacccccttaagcaaccagcatatagcagtcgcccctaacaagatatatatggttgcagatcttcttgaacaccccaaattcaactagtgaatttgcgtgaaatactaccagatggaataattccttactccacactaaatgggctaagtggcattcaaagaaaaagggtttaattgtcttcttcttcttgtgaataacaantaatttaattgccttgtcaattatgtttacataaaatattctttggtaacacaacttcgcgacgaatgtatcaatggaaaaatttaaccctcaaaggccactttagttttcagagatttgggatgtcactatggacttcacattcaaacgtccattaagggttaagttccatataacttaatattgctcctgaattaaatcaatattagtgatgtgtgataataaattattccatgccagtaattttgatctagttagatctgttctctaaaacatctgcaatagttacctatttatacctaacaacactgtagaggaaagtgtactgttctcgtagggttacatctcccaatcatttgtctttccataatctaatttaatttagtaaccattcttaattatgtaggatccaagacaaaagagatctcatttcatcttcattaggctgtctccggccttctactgaacttgcgtgagcggctgtgaactcaaatacttattttgtattagctgtttccaaacatcatctacagtaagcaactgaaatagccacttactgagtaatactgaatttctaaaccaccttatctttaaggcggcatagtatgtctcacttggcttttttttttaccatcactctaacaacaaaaaccagagcaaaaatagtagattttttttaaaaaaattcctctcgctactgtgaagtacttcattcatgaaaaaaaaactcaatctaaatgggatgtgacatactccatccgtttcacaatgtaagtcattctagtatttcccacattcatatttatgttaatgaatatatatatatatatatatatatatatatatatatatatatatatatatatatatatatatatatatatatatacatgaatacaaatatgggaaatactagaatgacttacattatgaaacaaaagaaagaatatagtataacaaatctggatacctttatatctaaatccattataccaagttggtcgtgtcacatcccccaattagattgggtcttgttttaagacgtgaataaacactaagttaattagtgtgagccctccttcaatagatagaaattttcctttccaactatggaagagatgcatatgcgtgtccaaacaccaaataatagtacattagcccgggagcaagccattggagcatactccctccgtccaaaaaaaaccaacctagaaagagtttgtttagattcgttgtactagaaagggatcctttaaggttgtcttaaaaatacccaacctaaaaaagatttgtccagattcgttgtgctaaaagagaaccctattagacttgtttttttttatggagggagtacgagactaactacaaaattttcagtctagacaatgaccaagcgggggggacatatgtcgctggactcaaactccacgacggaactggcaaacagacgacaagatctcgaccgaatctgatcgacactgggtaaggtcaggaagaacagtcttactcgtcttttttctaatccaacttaagctcagtgatgacgccaactaatctggaccgtgtttagttgtttaggtgtaaaaattttaaagtacacgggcacacatttaaagtataaaacatagactaataataaaacaaattacatattccgacggtaaactgcgagacgaatttattaagcctaattaattcattattggcaaatgtttaccatagcaccacattatcaaatcatgacgcaattatgcttaaaagattcgtctcacaatttacatgcaaactgtgtaattggtttttttcgtctatatttaatgctctatatatatatatatgcccaaacatttaatgtggtggaatttttaaaagtttaaaggtaactaaaagcaacgctggttgagttcgtggatgcgacactgccatctcgaactcttgtgcactcctctcgctcgccacacgaaacgccacaccactaacagataaaaaatagctggccaattgccacccattttgcctatgcgccatagctgagctgagctagagctctcactacagctagctaaccgagagccacacgtcggtgactcgtgacctgtggagccatgtcgccgacgccgaggccgcacttcctcgtgctcacgttcccgctccagggccacatcgcgccggcgctccgcctcgccaggcgcctgctcgccgccgcccccgacgcgctcgtcaccttctccaccgccgccgccgcgcaccgccgcatgttcgccgagggggagggcggcgacggcgacggcaggctcgagctcctcccgttctccgacggcaccgagaacgggttcgtcaagcgcggcgacgccgcggagctcggcgcgtacatggcgtcgttccacgcctcgggccggcgcagcgtcggggagatggtcgacgcgctcgcggcgcgggggcgccccgtgtcgagcgtcgtctacacgctcctcctgccgtgggcggccgacgtcgcgcgcgaccgcggcgtgccgtccgcgctctactggatccagcccgtcgccgtgctggccatctactgccactacttccacggcctcggcggcgtcgtcgacgagcaccgccgcgaccattcgttcgtcctggagttcccgggcc

SEQ ID NO: 13984 - DNA, 1334 bp, Oryza sativa
ctgtcgcacgcggcggtgggttgcttcgtcacgcactgcggctggaactcggtgctggagagcatcgcgtcgggcgtgcccatggtgggcgtcccgcggatgtcggaccagcagatgaacgcgcggctcgtcgagcgcgactggcgcgtcggcgtgcgcgcggaggtggacggcggcgacggcgtgctgcgcgcggcggagctgaggcggcgggtcgaggaggtgatgggagacggggaggcggcggaggtgcggcgctcggcggcggcgtggaagcgagcggtggcggaggctctagggaaaggagggtcgtcggatcgtaatctgacggccttcgtggagggtgccagaagtgtcatttgaaaacgacataatttgaaaacgttataagatgtattttaatttgaaaacgatttggggatcctagggtcttcccttgttggtttggctgtttgttcacttgtatgtacaacctctactgaactactccctccgtcctatgatataagggattttgagtttttgcttgcacggtttgactactcgtcttattcaaaaaaatttggaattattatttacttttttgtgacttactccctccgtcccaaaaaaaaggtaaaccctggattttcgtatccaactttgactgtccgtcttatatgaaatttttttataattcgtatttttattgttgttagatgataaaacatgattaatattttatacgtgacttgtctttttaatttttttcataattttttcaaataaaacggacggttaaacgttgggcacggaaactagggtttgtctttttttggacggagggagtactttattatctaaagtactttacgcacaacttttcgttttttatatttgcataattttttttaataagacgagtggtcaaacactacaagtaaaaactcaaaatcccttatattattggacggagggagtagctgccaactgggctctcattttttatgggcttttgctatattgttgggccaaattattaccaccgaactgaactacctgttgggtaagggaacatgggctttctctggtgtactttctactttggggtcccgtgggtaatataccatccctgccctcgcacccagaaatgaccagggcccccacccgcttcccctgcgggttagaattcccacccgtccctgtaggggcgggtactcaccgggtccccaaccccaaccccacgggagaaattaccacccatatatccaatcgttcgtaggctcgtagcatgtttgttctgcacaacccagatatctaattgatgacagtttgctatagttttactagctagg

SEQ ID NO: 13985 - DNA, 5359 bp, Oryza sativa
gtcagggttacgggttaggtataccctttaccctttgatatatggcacatatcggtatggcatgcccacgcgcatacggatactctctacatacactaaggaaatccttcacagagtttacggacgaaaagagtcctactcggacaagactgggtcgtcaatgtatcgtgtagggtttgatgtctccgagttctacttggaaaccgcctgacctgcgatataaaagggaccccccagggaggacctaaggcatcaaatctcaaagccaacacaacccccacagatctagtcgaaccaactcgactacgatcttgtcggatccatcgaattccattgttccctttgtaacctgtgttttccatcatataatcccacgtcaactggattagggctattacctatcaaggggcctgaaccagtataatcttcgtcttttgtttgcttgatgtcgtattacgtggacccttgtaacaacgtactccaataccctctatatccggtctatgggtatcacccgtcgatagtggcgcgccaggtaggggcacttggtgctcaaggttctactactatgtcatccagcttcgtcgacaacagcgtcaacaccaacctcaaccaagtattccctgcttcaacaatgctggtgtagactcaagtcggcaaaatcgtcttcccggtttacaccacgatgccgatctcagccggtccatcagtgaccggaaacgagaacgcagtggatacaaaccaagacgactccatgtcgaaaaatcctcccgccgaggcagagaacggaacatgaacgacatctgagctcgagaaggattccaaggcgaccaaagcttgtcactccgacaagaaccacgagccgacgaggatgacttccaaagcgacaaggtcctggtgtcctatccacaaaaccaggaaacacactttgcaagcctgctgggtttttctcaacgtccgcgctgaaattcgctcctgcaaagagcgtggaattcagcgtatttctccaactcgtgatgtctattctcctattcacaagacaaagaatcacgacctctcaagctgcaaggtctttctcagcgccatgaaggcgccatctcctaaggtccaacagtcacacatcctcatcagggataaagacaaggaatgaggagcgacgccaacttcggatcgatttgttggggtaatcgacatcgatccccacgaaccatcagtcttgcacctcctcgaagactatggatcatcgacaacgagcgtgccacgggagatattggctattgatgatgtcggcacgtcacagcgcaccaatgcagaagcggagaatcaagtagccactccggcccaacacatcagagccgtcaacgctatactgagggaaaccccctacgatcccgttctgaacgatgatctcgcgcgttggacagaacgactacgggaatcagtgaccaacctcagcaacgcgttcgaagaggccgctgccgcagcgcacccagagcagccaccaactggcgatgccaatggtgaaaaccctgaacggagggaatcgcctcaacgagccacccctccacctcgcggcaccggcgatctccgtgatcacctcaacggcagccgagaggcacgacgcacacaagacaacgagaaccgttcccggcgtcatgtctcttcacggcgtcatgataacaaagatcgaggagaccgttcaaacgaagactgagaccgtgataaccgccacgatcacaacgatcgcgaacagcgggtgccaggcgatactggtcgaggacgtcgccataatgacgacgatgatggagaccggcgccgagacaacagcgggagacggcgacaggattctcgagagccaggccgacaacctcgtaatcgtacactggaaccaagcgacccatcgtcatcgtcattatcctcgtcttcctcatcatcagatagacatccatgaaggacacacgatcgccgataacccaccgcccccagcgctgggtgtagagctttcagtcgttccctgcatgatgtccgatggcctgagagattccgacctggagcaatagagaagtacgatgggagcaccgacccagaagagttccttcaagtctactccacagtactctacgttgccggagcagacgacaatgcattagcaaattatttgccaaccgcgttaaatggctctgcacgttcatggctgatgcatctcccgccctactcgatctcttcgtgggcagacctgtggcagcagttcgtcgccaacttctaaggaacctacaagcgccacgcgatcgaagacgacctacacgcgttaacacagaactcgagtgaatccttgagggaatatgttcggcgcttcaacgagtgcagaaatacaatccccgaaatcaccgacacttctataattcgcgccttcaagtcctgcgtcagagatcgctatactactcaggagttggcaacaagacgcatcacaactactcagagattgttcgaaattgttgagcgatgcgcccacgcagatgatgcgctaagacgcaagaacgataagccgaagaccgggggagagaagaaactagccacggacgcacctgagtcaagcaagaagaaaaatcgcaaaaatgggaaaaggaaagctcaagcggaagtcctcgcagcagaatacgcgaaccctcccaagcgcccagacccacaaggtagcgacgcaaagaaagcatggtgccccatacacaaaacggacagacattctttggaagattgccttgttttcaaaaagtcgctcgagaagcacattgcatttgaaaaaggcaagcgagtacgcgtggtcgaaaaggatgcggaagcggctcccaaggagtcggactcagcatatccagactctgacctccacgtttcacacatcttcggaggttccacaacgtactcctcaaagcgagaatacaagaaagtggaacgtgaagtctgttcgacatggcagggggctgcacccaagatgaagtggtctgaacagaagatagaattctcggaagaagaccaccccaagactgccgtcatcccaggacgatatccgatcgtggtcgaacccactattcggaacatcaaggtcacgcgggttctcatcgatggtggcagctcaatcaaccttcttttcgccggcactttggacgcgatgggaattccgcaaagcgaattgacaccaaccgattaaccctttcatggaattactccccagtcatcgtccaaaccattgggcaagattacgttgcctgtgactttcggccaagctaacaacttccgaatagagcagatcacctttgatgtcgctgaattcgatacagcttataacgccatcattgggagaactgcacttgcgaagtttatggccgcatctcactacgcgtatcaagtgctcaagatgccgggaccgaagggaataatcactatttaagggaatgcaaagctggcggtgcaatgcgacaaacggagcctcgacatggtcgagcaaacgcccagcccacccgccacgaccaagccacccaagaaagtgagcaagacaaacaagacgccgaaaccggacggcgcaatcaagatcgttccactctccagtgccaatcccgacaagaccgtcaagatcggggtgacactaagcgagaaataggaactcgcgctcatcaccttcctccgcgacaatgctgacgtgttcgcttggcagccgtccgacatgctgggggtccccagggaggtgattgagcacaaactcatcgtgcgacccgatgccaagccagtaaagcaaagactgcggagatttgcaccagaccgaaaacaagccatacgagaagagctcgacaaacttctcaagcctggcttcatcagagaagtactacatccagagtggctagccaatccagtcatggtgcgaaaggccaacgggaaatggagaatgtgcgtcgacttcaccgacctcaacaaggcatgtcccaaggatcacttccctcttcctcgaatagatcagctggtggactcaacagccggctgtgagctgttgagctttctcgacgcttactttggctaccaccaaatcagcatggcaaaagaagacaaagagaagacaacattcatcatgccattcggggtattttgctatgttaagatgccattcggactgataaccgcagggaatactttccagcgcacggttcagggcgcacttagcgaccagctcggcaacaatgtcgaggcatacgtcgacgacatcgttgtcaagaccaagacaagcgactcattgattgacgatctgcaggaaacgttcaacaacctccgacgatatcgcctcatgctcaatctagagaagtgcacgttcggagtaccatcgggcaagctgctcggattccttgtctccggcagaggaatagaagcaaatcccgagaagatcaaggcaatcgagaacatgaagtcgcccacaagactcaaggaaatacaaaagctaaccggatgcatggcagcactgaacaggttcgtcgctaggatgggagaacgagggcaacccttcttcgctctgctgaagaaacaagacaaatttgtatggacacaggaagccgaagaggcattcattgcactcaagcgctacctatcaaacccccctgtacttgttgctccccaacctaatgatgaattattcctctatattgccgccacgccatattccgttagcaccgtcattgttgtcgagagagagaaagtacaacgaccagtctattacgtcagcgaagctctccacgacgcaaagacaagatatccacagatccaaaagctgctttacgtggtcatcatgacatcaaggaagctacgccactactttcaagcccacagagtcacagttggctcctccttcccgctcggtgaagttgtgagaaacaaaaacgttgtcggccgcattgcgaaatgggtagtcgagctgagccagtttgatgtccactttataccacgaacagccatcaagtcccaggtactcgccgacttcgtagccgattggactatgcctgatgacaaatcagacaaccaagtcgacaacgaaacgtggacaatggcgttcaatggtgcactcaacagccaaggagcaggggcagggtttatcttgacgtctccttccggagatcaattcaagcacgcaatccacctcaacttcagggcgaccaataacacagccgaatacgagggattactcgccgggataagagctgcagccgcacttggggtcaaacgactaatcgtaaaaggagactccgagctagtcgtgaatcaggtgcacaaagattataaatgctctaaccccgagttatccaagtatctcgcagaagtcaggaaa

SEQ ID NO: 13986 - DNA, 3652 bp, Oryza sativa
gacgaagccatcagtaaaagaggttagcggcgaagttagcccggccgccccagacattggcgcggaggccacaaaggcagaacgcgccgttgccgatatcgagatcacagatgactggcacatcccacttatgaaattcatcaacagcgaggagttgcccgaggacgatacagaggccgagaaaataacccgtaaagcaaaaatctaaagtgtggtcagcaacgatctatacaaaaaagcgccaaacggggtacttctcaaatgcgtctcgtccgacgacggcagacacctcttccttgatatacatgaaggcatctatgggtcacatgccgccggtcggacattggtcgggaaagcttttcgacaagggtttttctggccaatcgccctcaaagatgcatgcgacatggtccagcgatgtgaagcctgtcaattccacagtaaacacacaaagctacccgcgcaagtgctccagactatccctcttacttggccattctcgtgctgggcgctagatatactcgggccattcccacgaggacagggcggttacaggttcctattcgtggcgatcgacaaattcactaagtagatcgaagcagtacccacgggggaaatcaaggccgacaacgccatcaaattcatcaaggggatattttgcagatacggactatcgcaccgcatcataaccgacaacggctcccagttcatcagcaccgatttccaggattactgcatcgggctgggaatcaagatatgcttcgcctcgatctctcaccctcaaagcaacggacaagtcgagagggcaaacggcatagtactacaagggatcaaaacccgcgtctacgacaggctcatgtcacacgacaaaaaatgggtcgaagaactcccatcagtactatgggccgtacgcaccacaccgacaacatctaacaaggaaacacccttcttcctcatgtacggttccgaggccatgctccctagcgagctatgacatcagagtacacgagtacagaagtattccgacgaggatcaggaggagtagtgaaacgtcgatgtgaatctactcgaggaacatcgcgaacgagttgccgtccgagcagccaattaccaacaggccctccgccgttaccacgagaagcgcatccgagcacgcatgcttacgatcggcgactacttcctccgacgggttcaaagccaagcagggcgaaacaagctctcacccaaatgggaaggatcttacacgatcacacaagtcttgcgaccaggcgcatttaaaattgcagacggtgatggtcgcgagttggcaaattcttggaacattgaccaactacgtaaattctatgtatgagtcaatgtcatccatacctgtaagacaccttacagcatcaataaagcctattcttaggaccatattacaatcaaagtgttcctgtccgatgatcccttacccagatgacacctaacgttgaaatctatcctcatgtccctttacgccgtcttgacaaggcctccgaggaacctaagggatcttcggctggggacgcccagagccgataaggccttgtcagatcctgtagagacgaaagaccatgtaagacctggtcgtgtaagagttctcgccgtgcgtattaaccaagtcgtgtaatcggaaattaactttccaacttcacggctgggggctaggatcagtgcttattcaaccaaggcaggtcaaaggtccaagagccttatcctctgagaaaactcctccggtgacaaggctgggggctagggagagtgtacgactcaaacaaccgactaaagtcgtgaactgaggacacactcttacacacgatatccggagtaagaaatattttctaaagatagatttcttttctatttcacaaaatactccttacaattcttacacaagtctaaggctatattacactttcccctaagatatctatcacagggtacaaaggctaccaggaaggccaacgccagtccacagattagaagaccttctccgccaatggcgccatcgacttcaccaggtggtctatctctgccagagtcctccgagaacgagcaaaaccttcatggagaaaatcgatgtccagtcgcgggcgatgatctcataggcaggccaacacgtgccccccggcatatcggctcgatcgacgacactcctacttcaaggcttcgtcaatgcgcttgccgacgccctcgagctaagcataggccccgttcagccacgagatgtatctggccgccgactcctcgggatccccacgaggtactcggagctctctacagaccttggccatggacgtgcagcaactcttcaagtacgagttgaaccacacctcacgacctcggagcgtttccacagcttgctccttctttactgctagcattgttctctcaagttccgctacttcaaatttcgtcttccaatattggatacgacgatcttgcccagcaagagcactctcgagatatgctcaatgtgggaataactaagtcaagcttcacttctctttcaagaacacgactgatctaatcggaggagcaaaaagggataaagggaccactaacctaaggaagtcgtcgccatctctatccccgtgggtaggatctggtctacattgtccggcgacgcatgtggttcaaacgcaagagccggaatgatcgccaatgactcaggctgcccacgctgctggacatcctcgtcatcaacatctctacaagggacaaaaagtactcaagatcaaaatgcaagagaaagctagggtaatgactacacgcacaaaggcgatcgaaacccatcgaagttttacatagcacatctaaggagtacaagagatcctactcttcaaaaagggggagaacagattcccccaggtcgccgacttcttccatcacctccttacgcgtgccgctagccgccccctgatccaagatctcgcgcagatcgagtttaggatgcgccagcctcacacacgcaaggacatggcacgcctcggtgtagatcccgttggacgtctcctctccgatcctggccgcatgcttggagggaatctcctccatcgccgccgcgagctccgctagagaagatgtcagcgagaactcatcgggattcgccgggatggtagacttgatgccgcactacccggcgagctggtgcagaccagtataggtgacccgcaacgagccacggatttccgacaaattgttcccgagctttgacatgcggtgctcgagcccctgccattgtcgctcgttgccagccaccaactccctcatcttcttgaggtcttcacgagcttccgccaactcgtatgccagccggtcggcacgctcgtttgccgacgctgccgccgaccttgcctccgcaatctcgcgaccaatgccgcgagcaccagcttcgaggagacaccacatttcgacctggagctcctcccaggtgaggacgacagccggtggaccacgaccagccgcgggatcgctggctgggccgcttggtgtcacctcgcggctcccgggcgcaagcacgacatccgtcgaggctacagcgggagacgcaccggaagtccctccagactcatcctgcaccgccttcgcccgcgccgccctatgagacagctatggttcagacaacgctcgg

SEQ ID NO: 13987 - DNA, 4294 bp, Oryza sativa
cacgcactcggagatcgtggaccacatcgatgaacgattgaagagaaggggtcaaagggggttttgcggtccaagccaaaatcttgtctggttgttcctcaggaacaacgaagacaggatccgaatcttctatctgaagatagaacacctcgtctgccatttgctgcgagaggagggacactggaaggggatataacgcgattttaggccatcccgaagtcggaatccaacgcatccagataccctgttggattccatccaacgcaactcgtagtagaagcggaagagatcgagaaagggctctaccccaatgtaggcttcacaaagatgtgaaaaatactaaggctatagaattggggttcagatggagcaaagaaagaccatagaagtttaaaaccaagagaagaaattcagaaggtggagggagaaaaccgcagagaatgtagtcctcgatcacaaccatgcgacctaagatgggctggggttcagtacctcctgcttccctttccatggttccacgacccggaagggcgccgtcctcctgaagcttcttcagcgacacgctagtggaggatgatttgccgagatccatcgccgatcggagatcgccggagaaagggctgaggtcgacgaactagggtttcttgtgggagcggggaagacgaagaacgcttgcaggcgggaggttttcttcacaataggcgggcttcaaaatggatcccccaaaattcctttaaatagacgcactaccgacggtgcgaattccaaggaaaggagagagatagccgccggaaatttctgggtccgttacgcgcggcagtattttggacttcagtttaaattcactcgtgaccgttgggcttcacatggtgttctcgattacgtcctgtctccacggttctcgcaccgggaacaacaatagcctcgacacgagaagtcgcgaatggttacacgagttcatttaagcagaagtcgggggctactgtcagggttacgggttaggtataccctttaccctttgatatacgtcacatatcggtatggcatgcccacgcgcatacggatactctctacatacactaaggaaatccttcacggagtttacggacgaaaagagtcctactcggacaagactgggtcgtcaatgtatcgtgtagggtctgatgtctccgagttctacttggaaaccgcctgacctgcgatataaaagggacccccctggggaggacataaggcatcgaatcttagagccaacacaacccccacagcctacgaagtcgaagcctgcaggagccaaatcgtcgaggatctagtcgaaccaactcgactacgatctcgccggatccatcgagttccattgttccctttgtaacctgtgttttccatcatataatcccacatcaactggattagggctattacctatcaaggggcctgaaccagtataatcttcgtcttttgtttgcttgatgtcgtattatgtgaacccttataccaacgtaccccaataccctctatattcggtctacgggtatcacccatcaacagggtgggcattcggtctaaccgaaaattttagtctcggtcttcggtctttcggtcttttcggtctttgaaaagtgaagaccgaatttcagcgcaaaaatgttaggaccgacaaattcggtctcggtctcagtctcagtcctgaccgaaattcaacaacattttcatatatgcaaagaaataatggaaagtttcaacacaaaaatcacaaaaaaatttcgtaagcacttatgagtaaagactctggttaggttgcatgcctagaagaagtagggatgtgaaaattagagtttaatcctattaaacatagtggattgtaggttgcatttagacgtttttttgataattctgtcttttcgatatattcggttaaccgaggatactaaccgaattgaccgaacaaaattcggtctttcactgcctaggaccgaattgatgaccgaatttctcggtctcgatcttttcggtctcggtctcggtcttttcagttcggtcttttggttcggtctttttctgcccatccctactcgtcggatcataatctgatgactttcgtggttgggaagtgccagaagtgacatttgaaaacaatttgtgtcaattataagatgtattttaattttaaatttccacctttgtagattttaatgatgaattagtcagataacaagtatatttatacattttttcattttattgattattagtgtgggtgtgggcacgagggagcgagggggagctttctaagaaattataatgtgcctattgcaaaattatcgcccttgaaaggtaggatagaaaaaacacacaagaattaaagttgtattttttaaaaaagtctatagtaaccaaaaacaccggaaatgagaagagaagaaattaactacaccacaggataattttttttctaaaaaaaatcaaaaggtcttatctcttgctttttttttggaatgtaatcctgtggaattagtccgtagaaatgcaattctatggaatatttacaatttctatatgaactaaaggggtctatagaaaaaaaaattagaaaattgaatcctctaaatattctaaaagtttctatgcagacaacataaaacatatattgtatacttggttcgttcagtccataaggtcgcatgctccatacattattgtaggactcatggaagttaaagagtggctgttttcaagacttgatcgtgttgttgactcaataatctccaacgcatagcttgaacattgttagttgtataaatattataccaatagatttacagtgtgcttttacacagcattagtactgctgtcatgaaaagtatgttttctgataaatccatggtcaaaagtttttctagctctagaaattcatggagttggggctgctgctagagtagagttattaaaatgtgacatttaattcatatcttagatcaaataaaagattgaaccattttaattcaatctacaaactctaatttctgcaagcctgcaagaattaatccaggagtttggccatgccaaacaagaatgaactttgttgtgttgtatagtgttaatttgtaaattgtattatgactacaaaagcattgtacagacggtatatatccaagtcactattacatataaaagcattgcaatatataaatgcttttttttttacaggcgatcgggcccatgcctttatttttacatgtctttagtcacagatgacatgatcggtcacctgttaaaacgtgttttggccgcctacgacaaccctatcgtagtagtaagagtataaaaggaattaagcgtatgcgaataatttctgtgcttttttttttatgacgggaatggtcctgaactcctgatccataagttttgagatgcatacaaacaaccatattactccaccacgcaagctgtcatctatggacaaatggtgaatacgtatgtatcttgatctcgtggaggttgagtcgacgtgacacttaccttgttcaatagttgatccatggtgtcgaattcacggcaccttctctttttcacattgtgacacaattttttcttttacaaaataactttatttattttctacccagaccacacataccaatataagtgaaaaaaatagaataccctctattttatcaaatccaatataattgtatcccattttatctagtccaatataattgcttttgaaagatgagttaatttaggataaataagatggtacaaaataaagttatttcggagagagagggagaagtaacctaatgcagatcctagctggagtaacattttttcttaactcctgaatgaagtagtgaatttgaagtagtgaatttttttctacctggcttactaggcgacggccggagatcgctgtctcctggcagattgaacttaattgcttggaggcaatgccgtcgagataagattttaacatgagccgcaggccggcatatatatagctgtgattatctacctgaccggcctgactctttcctactgtttctatcctgtatccacagatcgatataggtcgttttcagttcagctcatggcctagcttatcactataaacatcggtatcgtgttgccggcctagcaagtgtataattaatagtagtataagagttagtttggagcttatgattttttgaaacacagcataggaaaaacgtaatattcaagtgtatttggtacctcaaattttataaatgaaaaacaaagaaaagtattataaatgatcattaaaaaaata

SEQ ID NO: 13988 - DNA, 20298 bp, Oryza sativa
cctgctgcttgtgggcgcggaagaagtgttagagtttatatcgaatatgtgtacgtagtcggttacagtttaggacttggagttgtaaaaggtattaggactagagtatgagtcggactctatcctaggatccctcatagatagaggagcgtgcctgttataaccgcatggtgacttagcataaagagagggagcggttgtcggcatcgaccggccgtaagtcgttgtaactctgatacgctgtatatgctggatcggggaggagcgcccgtaatcagtgccccgaagatgtaggccacggctgaactccgttaccaaatatcgtgtctcggtgtcgtcatcgttttggatctcctatggcattttcttccgcgtttagctaccgatgtcgatttcggggctggttttataacaagtggtatcagagcctgcgggaggtccatggtagaggcgcgatggaggtgctccacaccgcgtagcctgctgtaatgcccagggaggggcattggcgcaaggtggagcacggcggcgatcaacggagtcttgatcggtggatcgaacacttctggcggcggccggaaccgtcgatggctgccttcaacaaggagatgactagacgtggtgctcgggttgatggcggcagaagcgattggcgatccaatcgatgggtcggacacttcgggcgggtggctcggactttccggtgagctactctcgacagggagacgtgcggccgcacgctcgggttgattgaagctggaggcgatcggcgttctcgatcggtggattcgaacactctgggcggggtggcccgggcctttcgaagagttgcgttcgacagggagatggctagacgtagcgctcgggtcgttcggcggctgggaagacggcatgcgacttgtcggcttcggctcgcgactagattgatggcgttcaatcggatgtcggagcgggtggatcctataggctgttttggaggtgttgacaggtatttccacactggaattgcttcaaaagcggcgtattagcggtggatggcagaactaagcgtagggcgtctagactagcatatgtgctagttccaaccctagagaggtctggttctactgtttctagcacagatcaagaaaatcacgatgacaacagatcagtggcactagtcattggtgtagtcggcaagtggtgtttggcagtggtgctaggttccgctggagatacgaagaagcccaggaggtcagggtcgcggcggtgtgcgcgttttgcgtcgaagccgagctggcggcggagatcagggtgatgccgagaaggagcgggctgagccaggacgtgcaaggttcggtggttgtcggattcgtgatgtagaggaagactcggccatggagttatctatgtgtcggtcacggcatggacacgaccgaagacaagctggatggataccgcgttcgacacaggagggagttggatacggattcgatttagactggaaatcggacacgtttttccccaataaaagcagcaaagggaccacgggattgtaacaacgcagtcgaaacaaatcatctagcagagggcgagattcgtacccgattttcgcagaggcaaaggtggtttgggcggcgaggtcacgggcggctggagacgcatcattgcaggcggcgcacggcggcgtggtactcggcggcgttcgtcgcagctcgggcaggagcttgcggcggcggcggcggcggttcccggcgaggaaccggcgccggacttcggtggcgggcgctcctaggtggtaggccggcggcttcccaaggcaggcgacgcggcggctcctcgcagggtcggcgcaagtgacggcggcgggaggcggcggcgccccaggcggtttctgaggcgggcggcgcagtgcttcttgcagggccgacggcgtgaggagcaggaggcggcggcgcatcgggaaaaagtggcgtgggcacggtttctaggaggagcgaggaagccaaaggaagaaggggaacagggtcgatctgtttttctttgactggtggttgaccaagtaaaagaaaccggtccggttttttggagagagaaaaaaaactggttcggtccagctggtactattcgagttagtcggtgggatcaattaatcagggcagatcaatttaacagggcaacagctgttgagttgattatcgttgatggcggcgacggtggtttccaaatttgaggtggtgaagttcgatggcaccgggaatttcgttctctggcagatgaggctgaaggatctgttggctcaacaggggatatccaaggctcttgaggagacgatgccggaaaagatggatgctggcaagtgggaggagatgaaggcgcaggcagctgcaacaatacgcttgagtctctcggattctgtcatgtatcaggtcatggatgaaaaatcactgaaggaaatttgggacaagttggcaagcctgtatatgtccaagtcgctgatgagtaagttgtatctcaaacaacagctatatggtttacagatgcaagaggagtcagatcttaggaagcacgtggacgtcttcaatcagttggttgtggatctaagtaagttagatgtgaaactggatgatgaagacaaggccataattcttctgtgctcgcttccaccgtcttatgaacatgtggtgactaccctgacgcacggcaaggatactgtcaaaactgatgagataatttcgtcgttgcttgcacgagacttgagaagatcaaagaaaaacgaggcaatggaggcttctcaggctgagagtttgctggtcagggcaaagcatgatcatgaagcgggggtgtcaaagagcaaggagaagagggcacggtgctataagtgtcatgagtttggacatataaggaggaattgcctgttactgaagaagaggaaaggtggcattgcaagtttagcagctcgtggtgatgattcagatagcagcagtcatgagattctcacagtgtctaacgagaagtctggagaagcgtggatgttggacttagctagttcctatcatgtgacatcgaagcgggagtggttctcttcatacaaatctggtgattttggtgttgtttacttaggcgatgacacgagttatcgtgttgttggagtgggcgatgtcaagttcaagatgtatgatggaaacgaggtgctactttcaaatgtgagacacgtgccgggactaaggaagagtttgatttcgcttgggagcctacatgagacgggttggttgtatcaggtggattctaataggaagaccatgaatatcatgaaggacggcaagactgttatgactggtgagaggacaagttcatgtttgtacaagttacaagggagtgctgttgcaggtggagtcatggaagatgggtatgctggtgttgttgtgcacgatcctgaaggcggcaagcctggcgtaggctagtcgagcggctcggtgtgagctgcggcagaaccaactcaagtcctggtacacggaggttcgagcaagtaacagattcaagttggtgtggcatattcgccaaggtagagtttgttagagtttgcgtcgaatatgtgtacgtagtcggttaaagtttaggacttggagttgtaaaagatattaggactagagtatgagtcggactctatcctaggatccctcataaatagaggggcgtgcctattgtaaccgcatggagacttagtatagcgagagggagcggctgccggcatcgaccggccgtgagtcattgtaactatgatacgctgtatatgctggatcggggaggagcgcccgtaatcagtgctccggagatgtaggctacggctgaactccgttaccaaatatcgtgtctcggtgtcgtcatcgttttgaatctcctatagtattttcttccgcgtttagctaccaatgtcgatttcggggctgattttataacaagaagtgagatgtcgccacgggacaggagcgcgatggtgtagacgtggctggactagctgtcggtgaggaggtgggagccgtgttgcgccatgaccgcgtggggacaggcagcgaccgcgtgggcgcccgcaacaggaggatggagcaggcacccgtgatatatatacgtgggatgcgacgacgaaaggcccgcaaccgtcaccgtggcaggccacgaggatgagttcgtcgtcaccatacagttctaaatggagtagtattataacgtctagccacacgttaaaaagtgatattttatcaaaatccatctgcacagtggctttcgagcgatactcacttgtgacaataaaacaatgtcaggcccttcacagtgggaggacgtggccagttccttcagatttccagctcggataatcatctacacgttgacaaaacgcgtgcctctgctcagatgctcgggccttagttgggaagcgagttccttcgcctgcaggcaaggacgcgcggcgcaggagacgtctcacgcgtccgcgttactgagagcgtgcccccgcatatgtttccttcgcctcgcgtgcggcagatattctagccatcaaaaagagatcacgagcgttgtggactgcatggcttatgcgttgctgtacagatgactttggactgatttcactgtacggatgagctaaagccacgttatgcgttgcttgcactggtactgccctcagatttgagacaagggatgaaaggaatattcaaattggcggcttaaaggcctctcacagtgctccatgctggaccggtgctatgggcagccacgtaggaattgggcttgcgtggagctagggcgtgcgcccatggtgagcacctcgcacccaaactgaggcacgcggtaccttctctcgcgaggcccggtagcggctgcttttccgcactgtggagctcgtgccctcgcgcctcccgtgcccttgcgccggcaactaatctacacaaatcgcggcaacaaaagcggcaacaaatcgggcggcgcggtcgacggcgaggcgaggcgcacgacggcggcatccccgacgtgccgccgcagcatgggaggcgaggaggtgcgacggcgtgggaggaaccgctggccgcaagcaccatcgtctcagccttctggatccaccgccgcgtccccaacctccttcgccgcgtccccagcctacttcgctgccgccgccgtgaggagaggggagaggagaggccaccggcggggagaagggagaagccgccggcggggagaggggagaggagaggccaccggcggggagaaaggagaagccgccggcggggagaggggaaatgcagtgtcgtcgaggagaggaggggacagccggtggagttggaagagggtgaggggcgtggtgactgagggaggtgggggattcggtgaagtagtatctgtgggtcccacaccggtgcttgccctgtagagaaagtttccttgtagctttttatcctatgtgtcatcctggtgggtgcttgcactgtgaaggcctcgtaatctggaggttgcacatggccacatggatagatcgaagagggaaattttgctccctttattgaactgtttgtagatgatatggcaacatctaaaatttaatgagatctccaattaaatttgctgttacgtcgactaatcaacatactgattgcgtcaacgccacaccaaatgacaaagctattatctgggaatataaaaaaacaacaataatccagccgttgagttcgccatcgccggcggccgccggcggaatcacctgctcgagcacaccgcctgcgtcacggccccggacgcgaacgcccggagattcctctccgacgacccgccggccgcgaccgcctccgcggcgcgctccctccatcgctccgcccgtgcccggacaccgccgtctccgccgcccgccatggcgagctccacgcaccgctgcagctcgccgcgctcgaccacgccctcgccgtccagccgcgcgcgcacgccggcgcccatgcgcgcctcgaccagccacgccaccgtcggctggtccgtccactgcggcacggccaccatcggcacgccgcgggtgatgctctccagcgccgagttccacccgcagtgcgtcacgaagcagcccacagccgggtgcgagagcaccttcatctggtcgcaccactccaccaccatcccttgcgcgtccccttcgccgccgccgccgccggcatcggcggcgggggtgggtgcgctgtccaaggtcgcgccgccatcgacggcgccctggcgcgccacccacaggtacggccggccggtggcctcaagccgcgcctcatctcctcctcctgccgcttgctcatcgacaggagggtcccgaacgagacgtacaccacggagcgcgccggcttcgtgtccaaacaatccacgcacgcgctcgcgtcgtctcgccggaacatgtccgtgctcgagctcgacagagacgcttcgccgtcgggcaccaccggcccgacggcgacgacctccagatcgggcacggcgcggagcgcgtcgggctccagcgcgtcgaacgtgttaccagcaccctgggcttgagctcgtcgagatcctcgaacaggtcgcgcagcatggcgagcagcaggtagtgcttgtgctccggcgagacgatggacacggcggaggggagctcgtcggacctgaggaacggcatcccggggaggcgcacgacggcgccgcgggcagggtcgttcgcgcaggaggcgagggcctcgccatggccatggaagtagtggtagtacacggcgaacgccgccgccggctggatccagtagatcgccgaggggatccccagcgcgcgcgccacggcgggggcccaaaccacgaggaacgtgtacacgatgcacgtcaccgggcgccccctcgccgcgagagccgcgacgatggcggagagcgactcggtgcccgcggcgcgggtgcgcgccatgtagtcgtccctcgcgtgcaccccgggcttgtacccgtcgtcgtagccgtcggagtgcgggacgtacgcgacgccggtgtcgtcgacgtcctcgccggccggggacggcagggacgggaacatgaggcggtgcgcggagacggcggtggagaaggtgacgcgcgcggccggcgccgacgccatcaggcgcgcggcgaggcggcgcgccgggttgatgtggccctgtatcccgctcaccacgaagaggaagtgcggcgccggaggagggctcttctccattgccattgggatttctgatcagagcagctttgcaaagcaactgatactagcaagggctacctcaatttatatggtttggaaatggaaatggctgaatattaattgctcttgctgatgataaatccgaagctcctttgaaccctttcttttttgcctggcttttggctaaggatcgcctcccaacaaaacgcaacttgcacaggaaaaccatagtgccgaccccaacctgtgatctttgcaattctgccgatgaaacagctcttcacctctgcttccagtgcccctttgctgtggccttctggggcacgctgaatatgcaggttaatgacgcgacgttagctgagcttgcttctcttcccacaccgattcgagttccctccaagcactttttgggtattctacttgcaatgcttttggaacccgtggaatcaccaccactgggttgtcttcaggcacgaagcccctctttgcgtcgattattagtgctgtgtattgaagatgcgtccctctggagcgaaagactcaaattagaggatcggcatgtaatttcgtcctggaagaccttttttcttgagtaaagtgcacgggtggtccttaaacttgtagcggtgtgtcatataggttctaaactcttaaaatgcatatccaagtcccagaattttttatagtgtgtcatctagatcccaaatcgccacaaccccttcaggatcctacgtggcgttgatgtggcatgccacacggaatgacgtggcatcattttgactgaaaaatgggtcccatttaaaatttttcctttttcttttttcttctattttttccctttcttctcctttctctgtgactcgagcagaagaaaggaaaaaacgaagaatgagaagaaaacgaagaaaaagaaaataagaaaaaaaaagaaaatgacacgtcacgtccatgtggcatgtcatatcagcgccacataggatcctagaggggatgtgttgatttgggacctatatgatacactttgacaggttctgggacttggatatgtgttttgagagtttagggacctatatgacacaacccaacaaatttaagaaccaccaatacactttactcttttttcttcctccctctgctctctgaaagtgtaatgccctgaatttgtagttctctaaactggacctttgcccactcttaatgaattcaggtggggaacttctcccccccccccccccacccccagtgaatttttttttataaaaagagagtaaatttcataaaactccatctattatggtccaaatttcatggaataaagttattttggcacgtgacatataaccctaagtgttatgttcgtaaagtttcaggaaaccatgccattaaccaaattgtggcacactctcaaagaaaattaaaaagttttacttacattgatataacatttatattatggataaacaacttacaaatttgagacgtgattgtagaacttaagagtttgatagatcaaattcaaaaagatcactagtgtggtttcgtgaaattttatagtaataatatctgaggttatatgtcatgtctcgaaacccctgaggttatatgtcatgtctcgaaacccctgtgattttactggaatttaaaacacaatacctgggttaggtgaattgagtttaaaaaaagatcctcattcctggtgtgttttgttaattcagttcttttgagttttgatcagtcacaatatgcttttgagggtttttttaatccgttgcctagtcgccgttaagcactgctgggctgtcagatttttgggccaattcgtcctttatcatcagttctccaaccatgatggccgacatccactgctcagtaagcacaatgtcgtactccttgtggagtactcattacataaaaaacaaatctagtaccggatataatatattctagtacgatgaatctaggtagatgtatatccagatttatagtattagaatgtgttatatccggtactaggttggttttttatgggatggagtgagtactccctcaaatctagaactagatgtgatatgttatagtacaatgaatctaaacagaggtgtctagattcatagtactaagttgtgtatttatattattaggttggtttttttatggtacggagagagtacttcactacgaagaaagcaaccatgcggagtagtggagccttcatgtaatcatgtagcgtatttgaacttcgaactgaatcctctttggattactagtcgacagcaactacaaaactaatactaccacagaagtaaaatcttagagatacaaatatttttttggccggctagctaataagaaatggagcagttttggccggctagctattaagaagtggaggtcatactcttaatacttcatccgtttcacagtgtaagttattctaacattttatacattcataatgatgttaatgaatcatactagaatatggatatgggaaatactagaatgacttacattgtgaaacggagagagtagttactaatacagagcaatcggcaatcacaatgtagtgtagatttgtttccccatcaaaattgtagtcctctctaagttgaactcacattgtaacataaggattattgtgtatatccagtggattttcctacgtaatcttacatagagttgtgtttatttcacgtcaaaatttaaaatttggttgaaattgtaacgatgtgacggaaaagttagaagtttgtgtgtaggaaagttttgatgtgatggaaaagttagaagtttgaagaaaaactttgaaactaaacagagccctagatgtaaaattggatttgatatatcactgttagcttttgttttgcaatagattttaaaatccaaattggattccatatataaccgtcatcctctatctcaatagatagagttgtaatatacaatagattttaaaaataaaattggtttttttacaacatacgtataaactagacctaccacgatataacaatacaaaaatttcatttttcttttattattaatgcagtaattcccaagtttttagaacgggcgtggtcgccgtggtggcacatttttaactatcttaataatttaatagataatacataaataaaaacagacaaacataacctcaaagcatggcgcgcataaagcgacctgctaggaaggcagctatcctccagagcaaaacctgatacttctgcttaaacagccaaatccgtacagtagttttctccacaagttatcgtagtgtgactgtatgaagtatcagactatcagtggcagaaacataattatcgttttgataattagcgattcctttagggagagaacaaaaatacagggcgccatacaattctactactcagtgcaatacaattcattgcatcttcttcctgacttcctgtagaacagaaactaccagcatttttttagctattaccatacatctcagttttttatcgatgtaaaacttctcctgaatcagtaatgggctgcaataattatctcccatataacccaacaacaaacatgtccaatcgaagctacaaattggaatgagctaaaatattaaactcattccttgtggtctctgaccttctttctcttccatttgagaaagatttgtaaagagagaccagaaaagaccatcacaacacttccccattgcttcaaggagagtgggttaccactgatgacggaggagatgacaatgctcatgaacttgcgggtggtggtgatggtagtgttagtaagagagccaaatcggctgatggttaggaagatgaaattctgacccacggcaccacacaggcagaacaggagaatgtcccatgccacctctgggttctcctggcaaaatctcactgcctcaaaaccgttggcgtaaggccaattactgaatagtaatggagcaacaaacataatcacagcattgtatatggtcccccagagattcatgccaagcattatatcccatggattagtctttggatacctgcaataacacgacattactttccatgtagataagaagatgataaaatttccagaatgctttaatatggaatggacagggtgtagttacctagactttatcaaatcttgggtcgaattggtgtaaccatcaaaagctaagttgaggaagcacaatgtgtagcccagaggcgcattagggttagcaagcttcttgatagtcttggagcttgtctgatacataggaaacaaacataatactcagaaatgaaaacacagttaacatcagcacatcacacataaaattttattaggccatctacagcttctaataacattagaggtgcagattcctagttatagtgactttgatgtggctgttttctcttctaatttgtattcatcataatacaaatgactgtaaggaacaaaacatattcttttctactttcatactacggagtgaaacagtgccaaaatgtttctgcttttgctttaggctcgtgggatattggtgaataattgaaatagattaaatctttaccttcaacaacgcaaaggatgatacacccccagcaacaagaaaggtgcaaatgtactccggaaatgtgtacttgacaccatacagtatagttcccatcagcattactgtacatattaaatcattggtcagagatatgcgcacatcactatacagactatgaaacatgaaagggctactgttaaaagttattcttaacactgattgctctattacctacaccactctgaccaccaaatatcagcactaatggaaatgctcttgtcatgaaattgatatggttttgacaaaaaaaatgcaagtattgtcgtactaacagctaaagcagccaatattgtggtgccaaaccaaaatccaattttccagtgtacttttttttttacacagaaactgctcagatgagtatacccacccaagctcaaattaatgatcagaagaactattcagatgtagataatgttctgtaaggtacattacatagcatgcatagatcaatgcaactcacctggaatcatcttagaagattttgccaggacctgttaacatagagcaaataattccttagcggtaatgtgctatttaatcaaatcagcatatattattacggcacaaaaatgagacacaaaaatgatattcagaaaacacagcttgttgcgactgttccaataagttcaaaagataaatcaaattacattgcgcttgagccaaacacattttgatgtataactgtacattggatggttcaaagttcaatcaaaaagtttgatgaggaaatatggttctgtcttcacccatccatgcgatacagcgataagagtatcatggataatcatattttggcatttgtgcataatactcatggcataaatgttttctacgtataaaaattgctaataaacaaatgatctaaacattgtttatatgttcagatatttctgaatcagcccataagccgtctgacttggtcagaccgaaccaaattcaaaactccaagtatatcagaaccagagagtctgaattcgtaatttcactcaaccaaacttaattttcttctccaataatcactcacacatcataaattctccaaatgaccgtatctatcgcatcaatcaaggcaaaaataaggctatagaacattccaaccactgatttacttagcacagttgaacaatccaaaaatagaacattccacttcgcaggcattatactactgcgttgcctatcacccataacgaaaatggaaacatctaattacagatacaatagctgcacaaaaatgcatagagcaacaaagcaagcgaagcgagacgacaaaagggcagctgcaaccaaacctgagctgggtagctgatgaacttgagcgcctcgatccccatggccgggccgacagtgttggtgatgctgacgccccagtacttccgcagcggcgcgcggccagcggaggagctcccaccactcgaccacagcttgatcactgcgcgagcaaaaccagtgtcacaaactcctcacacgatccgcattctgcgcaatggcatgcgatgcgaccgcactggattccacacgacaggggcaggggatgagagagggaggagaggaggctcacttatgaaggaccagacgaagcagacgacgttctgcgcgaagttgaggaacgcgaggtggtcgaaccgccgcgcctccggcccgaaccgcttcgtcgacctgaacgaacggcggggagagaaaacggcgaacaattttcagaaactcgccgaagcagagcccaattcccctccgctcccgagcaccattagagagagagagagagagagggagggagggagggaggcgggcgcttacagggtttcctggagacgccctggtgatgtacgccgaccagatcccggcgacgcagaatgcgagcacggccacgcgcgacaccatgctccctccgccgccgtcgacgacgcgggggcggggagggcctctgcctccgcggcccttgcgcgcggtgaccatggcgcggttcggttcggtcggtgcgccgccggcgaggggggagggagatcggtgccgcggggaggaaggcggaggcgcgtgttatagaagcgggggcgcaactggggagaaggagaaggggtcgcgcgcgtcagaggggtgacgtggcgtgatgcgattggggagatgtgccacgggagacagcttattggttgggttggcgtggccgcgtggcgggggaagggaagggaaagagatccgagcgtgctgtttccgtttggtgtttcatgggccgttctcttttggattaagtccaatttgactcccttaactagtggatgagtctaattcatatccctgaactacaacaccggatatcataaccctctaactattaaaaccggtgcaatttagctctcttgacggttttgcagagcgatttcgctgatgtggcgcctacgtgacggtgttgaactggtctttatacaacgtggtgttgacgtgtcacttatgtagcattagaattaaaaaaatatatgggtcctatttgtcattcacacaaaaaaaattgtgggatccaccgccatgtaggtccacatgacatgtgccaaccactgcgcgggccatggccgtgccaacgacgggctactcctctcgccgacctccatggacctcatcgccaacacctcctcctccactccgtcgtccctgacctatcgttgccatccccgaccacctcctctctgccctcgatccctcctccctactcaacaccttcgcctcttacccggtcctctcccccttcgacttctcctccgctacgctcttcttgggcctcgccgcatcccgcatcgagcaaattcaaagaggttatccgcctcctccacctagggatgacaattttacccatgggtccaggtatccacagatacccgacccgatgggcatgggtgtgagtgtgactttttacccatgggtacgcccacccgatacccgaagacgtcatgggcaacaggcgggtttcattttttacccatgggtaacccatgcccgacccgatacatatgtattagctaattttgactcatttcttaattcttataccctttctattggttcatttgtaatgctaactgatactaagttgtgatgtaattcaaattattgttggtaaccaataatttcgtaaattattgattttatttttctttcttaaattatatatattttaagttattatttatatgagatccattgggtacccgccggacatacccgcgcccaccgggcatgggtacgggcacggagttttgcacgctaactctagtgggtagggtttggacaggcaatattaggcatcaggtcgggcatggttttgctctacccgtgcccgacccgacccattgccatccctacctccaccgacacctccttgccgaggagctccgccgccacccgctcctcccattcgacgccaccgctccgggcctcggcgacggcggcgtgcaggcgaggggagctgggacttgggttgtgctttatcaggccggcctaaggcacgacggcccgacatgctagaaagcacggtctgacacggcccgtaaatgggctaggccgtacttgggctggcacggcacgcgaatggcccgtaggcacgatgatggcccgatggcccatggcacgatattggcccatcaggaatggctgctagcctgctagggcgcatgcgcatcgggccatcagcagaaaatctgagtggcactacagctccggaccccggcagcaagacgctcagacctccgaaaatgcttaggatcatatgttcgacgcaaccaataaaaaccggacggataaactactacctccctattcactccacaaatacatacatgttgtaatggtcttcaaaataatttttctcatgaactacttatccaatctacgatatgatcacaccattatatttgttataattaaatctttataacaaggtatcacatcattacattccgatgaaaaaaaaacatatgtttcaatccgttaaatttaatgtttcagatgcggtagcaatatgtttcaacgtgtgtttttgttatgtttcataaaaaaaatttaaatatttcaacaactgattttttttcactatatataactcaatgtttcaacaattgattttttgtttcaccaatatataactcatgtccctactctctctctctcgccatctattggctttctcccacaccatgcatgaatcatgatgcaagtatttagtgatattaaaatatttttccttctaaactacttatccgatgaacgattcgatcacaccgttgaattcattataattaaatctttacaacaagatatcacatgattatattctgatgaaagaaaaatatatgttttgacaataaaagcttaatgcttcatacgtgatagttatatctttcaccatgtgttcttattgtgtttcacaaaatttcaatatgtttcataggctcatttttctgtttcaccacgtataatttaatgttgcaccaacggtcaactgaaacatttgaccgtccgatttttttttacatcggacgtctgatttatagctctctcctcgtacctcagaggatctcctgcaaggatgcgatggtgtccggcgattcccttccgcattggcgcaatgaatggaggcggccggccgaagagacacagccgtggcgccgcgcagacgcagtcaagtgacgccgcccggccgaatggacgcaatcgagtactggggatggggacggcggacggccaaacggacacatcctgccatctaccactggacaaacgctcgacctagtattagggactaggtagtagatgcgtgtgtgcctgtgattcccttgcagccttgctctgctgctcctgcgccctgcctttgcctgcccgcatgtggcatgccatcgccattcgccgtaagcgtttgctattatggccccaatttcatattttgtatgtggtcacatgcacgctgtagctgataatacatgtttgcatgttgctgttttaacttgtgcagatgtgcacgtgcagccgcggagaaaaggcgcctgccttggattgagatggagatgggacgcctggcaacagagaatatgggcatggctaatggtgattggatgtgcctccgtggagcctgcaggcagcacgtgtattgtgtggtgtgtcatgtgtgtgtaagtgcaacgagaaataactagctcatgagggcaatttgttctataaattcctcctcctcctcttcttcccaacacaaaaaaatgcagcacaaaataaacagagcaacatagttatttccctcccacagcaaaaatgtggggtgatactcgtcggaggtcgacctcgtcgagacccccgcaaagacgccgccaatgctcgcctagtcttgaccataggtcggtcgatgcccaccaactatccccgggtatggacgactacaggatggatgaccgccatatggatggtttggagggagatggggatgatcctacggaacagcccatccctaaggccaacgatgacacagtcttgcccatgccgggaagcgaggccgagccatccgcaccatctacagagagagcggagtgttggcggcacttcgaaaaaatcagggtaatggtggactacaacattgtggaaaaactttgtctgcatcttctagttcatgaacaggacatctcaaacggtattatttgacgcacctcaaggataaagcaccggcaggagcaaggcaaacacagctgagcttcggacccgacggttctgtaagtacatggacttatgagccacaactagctcgagatgaaattgctcgttacatagtttcggaggacctaccgattaggatgggcgaaaggaaaaattttgagaggatgatccgaaatgctttttgtccacagtacacccaggtttcaaggaaaaccaccaagaactttattgtttcattatatcgttctaggttggatgagttgaaacgcttgttcagtattgttagcttttcttttgttgtgacatctgacatttagacatccaagcaccaaagaacctcttctgttagtgttgttgtgcattatcttgacaataatcgcacactaaataagagggttatagggttttaaatgatgtcgtcacatactagacgagccattgctgccacactactagatatactacaagaattcaatttacaatctagggtggtttctattactcttgacaatgcatcagcaaatacaatgggcatgacgattttggagccaaatctgcaaagctacattggaggttatgttatccatcaaagatgcatttgccacatcatcaacttgattgtgcaagcaggtattactagtcgttgagaatttattgaaattcattttttagtgcaaataatttatcaattttaatgcatatgtgacaaggaatttattatctatgtaggatttactgttattaccaatttacacaacaagatccgtcaagctgtttctatcatcgagggtcagtcagtgatgaaggagagattccgggactattgtcgagcaaaggataaacctgtgaggatgtttggcattgatgtgaaacatcggtggaacacaacatacctcatgctgcgtcaattgaaagggtatgaggaaataatttctgttttcattaattcattgcactttagaagtaatgataccgatgaggatggtgattgtgagattttgcttcttactgaggaagaatgggacatagcaacatgtctatgtatattcctaaagcctttttataaagctatagtcctactatctaggatttactatcctacttcttgtttggtgcttgaatgtctttggaaatcgtcccttatatttcaagaaaaccgacatgatagagttttagcttctgctgttcaaccaatgaaggaaaatttctcaaatacttcactactattccacacctttattgttttgctttggtacttgatcctcgtaaaaagttggaggtcgtggaggctgctttcatatcaataggtgatgcagtgggtcttgattattctgaagcttatcaacatgctagagatgagttgttcagggttttccgtatgtaccaaactaagctaagtgttgttcgttgggtgcctgaggaaaccccacaaaaaaagtaaagcaaatcaagtgcaatgaatttgtggaagaagatcaagggcaaggaacaagcttcctcatcaggtagcaggtcaaattggaacccagatgcggagcttaaccattacctcaacaccaatcgcacagaacatgatcgaacactagatggtgaaaatgttgatctgtttgagtggtggaaagagaaagaaaggactcttcctgtgctagctcactttgcacgggacgttctattggttctggcttcctgtgtctcttcagagcatgcattagtgaggttggaagaattatcgaagaatggaggtcatgccttgcacctgacatagttgaggcaatcttttgccttaaagacttgattgaagcatatgcaaggacgcaacaccggctagaggatccagagattgccgatgcaacggcagacgcgttggcggaatttggcatatccactgattgcggcggtgctaatcaaaattagtaatgtaatttatgtaataatgtaagcaagttgttatactatttttcttaccggggaaccctactctagggtgtaaggtttttaacgaagcaacaactttgcatccctattctgaataaatttgttttccctcaatttttacatctcaggttatttgcattcggtgtgagaacaaaaatacaatacatatttttagacgaggtaataaagtattgcagagccatctgggcgaaaaaaaagaagagtgtgaccatattgttttccctactcccaaaaattccctcctcttttcagatttccatcccaaaatttccctcctctatttcatattacaggctgctacagcagtgcagcatgaggtcattagccatcgctaagggtgcaagcggctacccacaaaacccacttataaactaaactaacccgcgaacttgtttatttcgacctataagtgggttcgcgggtgacccacttcacccatcacccatccacggtcaaaacttcccatgcaggcatgcagctagccgctagcaggtagcagcaagtagcagctcttcttcatcgcctcatcggtggcaggtagcagcaaccagcaagccagcaccagcagttggcaagattgttcgctgactgacgcggccacgtcgccgcgacgagccgacgaggaggagcagggtgcgcgtggccgtcactgccgcgtcgccgcgacgggacgacgaagccgcacgccaccactgccgcctacctgcgcccatcgccatcactgccgccgccggagtttcttctcagcgcagccggcctgctccctttcttttgggctgtgcttgtgccggcccggcacgaataggcccatcgggccattgggccgtgcttgggctgcgtccctgaagaggccgtgctagcacggcacgacacgacgagtgggccg

SEQ ID NO: 13989 - DNA, 14513 bp, Oryza sativa
  unsure (1)..(14513): unsure at all n locations
cgtgggcgcggcagcggggacggcgtgtgaagcccgagggttgtcggccccttccgtcccgacggcggcggcgacagcgctggacatcgtggaggcacaactccgcgcgcttccgctcggcgggcgcggcgacggcgctggacgtcgtggacgaagacgacgaccccaaggtgcggctggcgcgcgtggagtggaagctgaggctggacggggcgacgaacgagctggaggacctcgtgggggagatggaggaggccgtcgaggcggagaagaaggcgcggtgctgggcgccgtggcggcagcggtgcaggggggcggcggaggtggtggccgggtggctgcggtccgaccctaggatcaaggtcaggttggagcttgacgtgggaaggctcacagtcaccggcgtgtacgtccaaggcggagagctcttggttcttggatgatgtgactagcgacggtgaaggaatagctgcattccagtgaagcgatggctgcgctcgacgccaaccggtcgccatgacaaccaaaacaaccgaaccgagggttacccgacgacgacggacgcgtcgtcctcgccgtcgccgctcgccacggaagtgactatgctagcgaggagaacttagatgacatgtaagtagcgaaattaatttcgcatcgcagagcatatgcatcgtaatttcgtcgctcgctgactcgcttgccatgcattgtaattaaccaaaccttaaactcttgtttgcatgggcctcaaatcaatcccgaattatccagcccggaatgagggccatcccgagaggatgacacgtgggtcccacacatatttattttaaaaggaaaaagtacgaattaccccacgaacaatcgcggtcgtccaaattatccccctgaaccacaaaaccggatattcttcacccccaactatgcaaaccggacgaattacccccctcgaaccaattcagagtagttttgtccaacgtggcgcacatgtggcaatccagtcagcatttttgtaataaaaaattgtgggacccgcctgccatactcttcttcctctctctctattctctctctcgctcttttctctcgcggctcgcgcagcgcgcacgacgaggacggcgcggggacgggcggtcagtgtgggcggtcggcgacggcggaggcagcgagcgcggcggaggaggcagcgagcacggggaagcgaggcggcggggcagggtagcggtggcggaggaggcgagcggcggcggggtgcggcgaaggaggcagcggcagcggcgaggcgagcacggcggcggaggcggcgaggcgagcgcggcggcggagccagcgagcgcggggaggcgagcgacggggcagggcggcgaggcagggcattggaggaggcgagcggcagcgggagctcgcattgctggaggcgaggcggcggcggtggggtgcggcgaaggaggcgagcgcggcagcagaggaggcgatcgtggcaacggaggaggcgaggcggcgcgcggacggggctcgaggcgacggcggcgacgggtgacggacgacagcgcatggcgcgggcggggctcgaggggagatggcgacggcacgcggcgcgagcgacgacgacaggcgacacgattggtcccatctgttcctccgcttcgttgcgggcgccgtcgtgggctggggctggttgtcgcgcatggcgtcagccgcctcgccgccgccgtaccccgccaccactcgcctcctcctccaccggcgccctgccccaccactcacctcccagcgctcgctgcctccgctgtcaccttgcctcgccgacgagcttgctgtctccgccgtcgccgaccgcccatgccgaccacccgtccccgcgccgtcctcgccgtgcgtggtgcgcgagccacgagagaaaagagcgagcgagagagagaatagagagagagagaaagaagagtatggcaggcgggtcccataatttttttattaccaaaacgttgactggattgctacgtgtgcgtcacgttggacaaaaccactctgaattggttcgaggggggtaattcgtccggtttgtatagttaggggtgaagaatgtccggttttgtggttcggggggtaattcggacgaccgttattgttcagtggtgtaattcatagtttttccattttaaaattctaatgccacgcggaacaaagaccatgtcaaaaccgccacgtagacgccacgtcatcgaaaccgccctttaaaaccgtaaagagagtcaaattgtaccggttttaatagttggtggtcgagatatccggtattgtggtttaggatacgaatcagaaataatccgtccgcatccgcactggcttcgaatccacttagaaaatatagtatagaatatcgtatgacaactatccatccgaatctgatctgttttcatccctctagacttctatcttgtttttatttccacgtccgccactgattgactataaagcgaaccaacctgatttgtgcccagtgaccatatgctgatgcaggctataaactttctgcggttcattcacggaatttccaaaccttcctgatgaagcatctcttggtgggggagcacgaatcgcaaagcactacttcctccgtcccataaaaaactaatctagtatcagatatgacacatcctagtattacgaatctaaatatacatatgttcagatttattatattagaatatgtcacattcggtgataggttcgttttttaaaggacggagggagtagaggagtaaccgccaagtttcctgggcttggtgggccggtcgccaacagtttgtttgaacccagtatcctttccgtggcaaccaagttcccgtgagcccatcctcagccacccgattcccccatacaactcaaatcaacggcccaaaaacaacggaaccacccctcccggaaccttccagaacaccctatagcctcttgaaccttcccgaatcccacctttctataaatccctccaccttctccgacctcctcatcgtcaaaatcacatacacaagaagagcgtggaagagagggaggagaggggagagagcaatgccgacggggaggttgagcggcaacatcacgcaggactgggagccggtggtgctgcggcggacgaagccgaaggcggcggaccttaagtcgacgagggcggtgaaccaggcgatgcggacgggggcgccggtggagacggtgcggaaggcggcagcgggcacgaacaaggcggcggcgggggcggcggcgcccgcgcggaagctggacgagtcgacggagccggcggggctggggcgcgtgggcgcggaggtgcgcggcgcgatccagaaggcccgggtggcgaaggggtggagccaggcggagctcgccaagcgcatcaacgagcgggcgcaggtggtgcaggagtacgagagcggcaaggccgtccccgtccaggccgtgctcgccaagatggagcgcgcgctcgaggtcaagctccgcggcaaggcggtcggcgcgccggccgcgcccgccggcgccaagtgaatccttcgtggccggaatcgcacctccgatccctcctagttaggcgttgatccgtttgtgaatgtgcagtttgtttgtgttcttggcttaattttggggggaaactatgatatgctaactggctcagacgcatgtgaagtgatgatggctagaaattgaatttccgttggatttgtgaacacatagtttagttgaagcgcttttcgatccggttgtgttcaatcgtcgttgtgctctgcttctagttgtgactagctttgttctctgctcatatttcattgattgatccaagtgattcttcctgggaatcgcaagttcgcaactccgggcctccctaagttcctagttataggcgttgatccgcgttgtgaatgtacagttcgtttgtgttcttggcttggtttggggaaaccatgaatccatgatgctaactaggcgtatgtgaagtaatttctaatagaaattaaatttaccggccgaatcgttgtgctctgcttcttgtgtgttgtgcggtgcctagcttgttccctgttcatgtctcatcgacagctcaggttgctgctacctgtccggagctttggcggtccgtaaaattgatcgagtcactaactcggtgggttcaattaaccaatgtttattcgttcatttttctcggcttgaaacggatgaactccagaagagcatttttcggcttacatatttgtaacaggcttcacggctgagtttttatcttcacttttccaaccaacatctctcgtttttaaactgctaaacgatataatttttttaaaaaaattctatataaaaattattttaaaaatcatattaatcaatcgattttttaaatttattttaaaatatttaattaataatacctaaatgttgttttgttttgcatgctaggaagtgaggttttcatccctcactttcgaacagagccttaaagtatgttgattacagccactggtggatcgctgctctcgcaataggccttgtcacttaattctgccaaattatggactagttatgttttttttttctttttggtacgcagaaaaatatgtttggtttgctacattgacaaaatatgactatgctaaattatgctaaataatatttgtgtattatttgtgcggtattggaagtattggtagtagtaaactaagcgttgccaaaaattaatgcttaaaatgcaaatattttggtatggcaagttttgacttccaaggtaaaaaggagaattttggcttccaaaggtagtataaaaaggaggagaacaccaactggcatatacaaggaaaataatggataatgcaacttattgactctctgtaataatcttccaccgttacaaatactccaccacccagcaaatccaacaacaccaacatgtgtacatacgcatggccgactcgatcggcgacgagatccagaaagaactcagaaccagggggagccatggacgggggtgacgacggacttgacggcgaggaacttgtcgagcgcgtgcatgctgtcgtccttgccgaacccgctcatcttgcggccaccgaacgggcagctcctgtccatggcgaagtagcagttcacccacaccacccctgcccggatcgacctcgccatccggttcgccacgtcgatgtccctcgtcaccagccccgccgccagcccgtacctcgtcccgttcgccctctcgatcgcctcctccaccgtcctgcacccaaaattaatctctcttaccactatagtagtttcttagataataaacattttgaattgatatgacatatcatggtcagatcctctgcgatcgaaatcacgtaactttgtcacttacatgtggatccgatgatccctggatccacaagttagtgataaaggtaccgtgtatttgactagagaggatggcgatccatatatatagctgggtttacttgaacttcatcaggcacatgacggggccgaagatctcctccctcgcgatgaccatgtcgtcctgtcgttcagaatcgcaagcgaatcatcagagataagactgtgaagacacatggtgtgttcgtggtaaattctaaaggttaatttattttttatctttaccttcacattggtgaaaatggtgggctcgatgtagtaccctttcttaccgcagggcttccctcccgtgagaacagttgccccttctgccttgccttgctcgatgtacccgagcaccctctcatactgagccttgtccacctgtatgaacatagtagcagggcaacacagtacggtgatcagtctctggttcagatagttaatcaggcctgaatcatcactgaattattggaactcacaagaaaaaaaatgctcgttggatggatgatgattcagatttttcggaatttaatttcagactcactcacctgtggtccttgattgacgcgaggatcgaaggggtcgccgacgacccagctcttcatggtgtccgctagcttctgctcgaaccggtcgtagatgccctcctgcacgaacacgcggctcccggcgacgcaggcttctccctgcagattgatcagatcacggctatggctctcatcagtcaattcaatcaagatcacggcaatgcatggcgctctgccaattcggatgctcaccttgttgaagaagttcccgccgatggcgagctcgacggccttgtccaggtcggcgtcgtcgaagacgatgaacggcgacttgccgccgagctcgagtgccaccggcttcaggttgctcttcgcggaggcctccattataagccgtccaacctcagtagatcccgtgaaagccacctgcaaaaaaaaaaaaagttgtaagaaaccgatcaatgttcatgtgctaattgacagctgaatgtatgatatcttaccacgtcaacatccatgtgagatgaaattgcagctcccgctgttgggccgaatcctgtcaccacgttgatcaccccatccggtactcctgcctgaatatcacattccgaaaaggtcagagatattcagagttttagactaccagcaatcacacagcacaaaatgcctgatgcaagaacagagctactactatatcgtttttcttttttcaattttgcgtcctgttctaaattgaagattggattagctactttcttgattttcattagcacgttttccaaactatcaaatgttatgttttgtatgaaaattttctatataaaaggtactttaaaaaaataaataaatttatttgtcaattttctataattaataattagttaatgttaatcacatttctcgtttgtgtgactaatcttacttgcttattttttttttaaaaaaaattcttacttgctttgataggtgggcgaggaacagggcgctgaggggcgtctgctcggcgggcttgacgacgacggtgcagccggcggcgagcgccggtgagactttggagaagaacatgatggccgggaagttccaggggacgatgaggccggcgacgccgaggggctcgcggagggtgtaaccctggagctgcctcgacatcttgagcgtctcgccgtggatcttgtcggcggcgccggcgaagtagcgcaggatgccgacgcactcgccgacgtccaccgccctggcggcggcgagcggcttgccggcgtcaaggctctccagtgccgccagctcatccgcgtgccgctccaccacctccgcgtacttcgccatgaccctccctctctcctgcatttgacaaatgcgccattgatcggtcactttccagccattttttgcacgattgagaggaagaagaagatgaccgtactgatcccgacatgcgaggccattcgccgtggtcgaatgcttccctcgccgccttcaccgccaggtcgacgtcctccttgtcgccttcggcgacgcgggcgatcacgtcgccggtgcgggggtccctggtctcgaacgtcttacctggagaagaagcacggagcacggcgaccttccatgatcaggatgagattatgtaaagataaaattaagtgaaaatttcagtaaacctcacatttcatggttaaagttatataaaatcctaggtatcataaccttgatgaagagagttagttttagtttatgactctcatcaagagcaagaagtctttaattttagattggactgctatagaatttgacccatcgtacaaaaagtttctgatgataagaatcatactttcatggaactccataggggcatagggctataggcttcaacacggtagatgttttgttctgaattattctgagcaaacttacgacccaacgatacaatggttttttttctattcacaaagaaaataatttggaaatcgcaatgcttctatacgcttccagaggtgacacataaccgaactactattgttttaaagtttttcaaaacaccacctctatatatatttagtaaatatttacttaaaattgtaaaatgtagaatatatgtggaatttttagttgttgatttttttattaaggttttcggtttaactcttcgctactttgtaaaatattatcttagatatgttaaagtcaattgaaatattgtcttggattttgttagcatgcttttacatttcattaaaaaactttctatataaaatttactctacaaatatcaaataaatatattttttaaatttataataactaaatttaattaattatattctaatgacttcttgattttctgtgcactaacttcaccttaatgaggcaaaccccgaatttgatttttcttcagagcacgaaacgtgtataaaagtacacaagaaaataggatctctagtacggaagcatttatcttcttctgaaaattcagaaatgttccaaatctgaaacgtgctactgctagagccacatatgggcagtcccaatccataacactagacatggtttccataaactccacatcatcaagaaactagtgctagacactactcttccaatgcaaacaccactattccatactttaatttaatgctatttatctcacatgatgtcttagatgttgtgtagaaactatgtctcatacaagacatggttttcttctctttcctcatttattcacttgccacatcattttttgtcctaggtgacaacttatttaatgctatgaacactatcctagtcattgggttgggaatgccctaatgatttgatttgaatagttctttactacttagtactattagtacggagtactagctaatcattgagcaaaaaaaagatgtgagatgaaaacagcaactagccggggacgcgaagcacatggtataacacgggacgatgggaaaaatagatgccagaggttggtagagactgaaactgcaggcccgttcatgcttctttgtcgtgttactccttggcgaactgcccatgatctcatctcgccatcaaaccgtacgatgctaggagcaccacaagtttacggtaactcttcaaaatttactttctcggttataaaaattagcaatatagtactaaactttcttttttaaaaaaactatttttataggcaacacatgcagaaacaaatatattaaaaatgatgtatatggtttgctcccttcgtcccataaaaacccaccagtatgagaggtgatattttcaagcacagtgaatctgaacagaagactatccaaattcgttgtacttgtaaataccatatccaatagttttcagaatgagggagtatggcttatgaaatatagcaatatagtgaattgtttttttcataggcaacacatacagagaccaatcatattgagaacagtgtatgtatatggtttcatatagataaaacccatttcatctttttcatattatttttttcatatttaatgagaatggattttttagtgggagtggcctaagaattaatctaaactggctggtactaattaattatggagagaatcattaagagcaagtttaatagtacagcccactgctagctccaattcatctatatatagtcaatctaacagtcaattcatacaatagttgcttacgatactataaatatttggtcccacatgtcatacacatactgtgtcttggagtccgtgctgcagctggctacagatctgtagtccgctgctcttctctgttatcttttatctcattaaaatatatttatagctcactaatagtttgctattgtacttgctctaagaaacagcactgattgcgataaggaattgaatccctactagtatttggaagaaaggaaataaatcgaagagagcaataggacaaccacggcgattatgaattggatcccattactaggttttggtagagtacaattaagtcctccagtaattaacgcaggtgggctggacgtagctagataaccacagcccacggctagctagcgcgcggctaacacacacgtacgtacgtaccggaggccgcgtcgacgaagcgcccgttgatgaacagcttggtgtacctgatctccggcgtcgtcctgggcgtcccgccgccgtcgtcgccgccgtggaggcaccccgcgccgctgttttccgcgcgcgcctcgtcgcccgcgtggtggtggcccgtgctctcgctctcgctcgccatggcgcgcggcggtgtggctcgatcggtctctctctccgcgcgctgctttgctgttgcgtcgctaaccgagaagcgtagtccactggtnnnnnngngnggggggggggtgatttgggcgaggcgatacgccgatttaaagagaagcgtgcgccctgccctggccaggtgctagttgggctagccgtccttcaaatttgacagttttttttcccattcacagatttgactggtctagctgactagctagtcctttaaatttatcctaaattatagatgattttataatctgaagatgatcatttattgcccatgtacccacccctccctcccatttcaagcgcaaacatgagttgtcaaattttaattgtacgtcttattttattttttttgaaaaatagtacttttaatgttttatcatctgataataataaaaatactaatcataaaattttttaaataagacagatgattaaagttagacaaggaaactcataactacgtttaatatgggacggagggagtatactttatgagtctattaggttgatgttattttaaatctttttggtaaaattgagaaatacgtggatacatttaatttattcccaaacattggtaatgcctagataattttggtaacaatacatctatcctatcctattaaaatttgataatattaccaactcaccaaaactttggcattaccaaaattctagaaatgtttattttggtaataatttgagccagccttatatctcgcttatccactcttttatagtttattcctccacctacctatttttactttacttaatcctcacctatcatctattattcccattcgttctaaaataaacaaacatatcacacccctgtattaggtttgtttattcggatgaaaggagtaatacattattttatctcctatcatcatttttcatcacttgtacttttgctatctccttaataatcattaaaaaagggaaattattctatttgagacgagggagtatttccatcaccttactttactccaagacggcaaggcctgacaggcacccgcacatgggaaacaaacggacgagtcaaggagtgtactcatgtagtgtggtcgcgcactcacgtgattacctgaagaacttgcaaggattgggatctggtctctttttcaattcatcatcgatatgtatatatagagaagggttaattggatccatgccacgcgaattgtggcaaatcaaaaaaaaaaatgctacacctattccggaatccgggtgcaggccacaactgtttcgtcaaattggaaccatgccataatgtacgccctgcgcgcgctttgccaccgttttagggtaccgtattttcgtatggacgtttctgccctcgtgttcacgtgtgcttagaccagctccggtccggctcgaacaacccggtcgccattcgttccccacaccgaaaccctagcttcttggaggcggcgcaggcgacggcgccggcgcaatcgacggcggcggagcaggcttcggtgccggagcagggcggtggcgcaggcgaaggcggcggcggagcagggcggcagcggagcagggcggcggcggaggctacgacggccgaaggggaggacctccaccgatgggaggatgagtgcgcaggggcctacgcctgcatcccccaccgcgttggcaatgtatttgggcgaatcccttgtacgggttgcttccaaaccgtgagtaccttcccccatgaactctttatgcagataaaattacgatttgagtttcgatttgaactttgtatgtgcgatttgagttattgttttgtcattcgttggtaggcattggttttcagtcgatgttagggtgcaaccctatgcgacagtagatgctgatggtaggaaaatcatcagtaaaggaggcactgggcattgggtaatcgattcagagagtttttcgtttgatttcctaatggaaagtttgagggttgagtttaagtggggctcgaaccagtctccctcagtgtggtattttaacaaaaatttgggtgaggatgttaggctcataggggacactgatttgccagatattttcgagatgtatgcaaccgaggccagtttccacttacttgtagcagttcttgaggaaagcatggatgttgcttctgtgtgttgtgtgcatgagcccattgctatcatcccacctgagaacccttcccacaatgatggttctagacaagctgctactaatgatggttctgcacagcctacaacagtggaagcagatgttagagagcctgacatgtttgataattaggaagaatatgttggtgttaatgatgagcagttgtatctgcctccaaaacctactcagccacctgacacctctagccaatcctctcagcctgctgccacagggtttgtgtcacgaccggaattaacccaacgggcgttccttacgtgcatgtattattccttgtcccaggaggcaaggtacaccaaaagttgatacatttcagagtttatcaagcggaagcgtaaatagttaatttattacatgggcggcgaaggcccagcacacacaaagacaaacgggaaagaggggaagactagggcgacgaccacaggcgcttgacggcaggcacgagctagacaccaaagccttcatcttctaggaactccacttctgggtttgggaaaaattgagcaagactgagtacaaccaccgtactcaacaagacacacccacaagtgcagaataaatgcaagggagtacaagggggtttgcagtaaacagcattaaaagacacttagttgctcaaagctattttgtaaacacgattctagagctatgcaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccaagggcgcggctattcgaatagattatactctgatcagaggtgtacatctttacccacaagacacatcttcctcacgtgtaaccatgtgccacataccaccacggtatacggacagaagacgtgacatagtttccaacccatcctagccatagacaagagtaccgacccaaccccacctacggccggaacccccgggacaggtaggcaggactgagcctctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtagaagtacggtagtgctttgcaacagaggcccgaagaccggtccttatatggccgaggtgctactatcaaaaccatgcacccgagcctagcctaaaaccattttgagggttttgaatagagggggaggtgcaaatccaattccacaataatccaaccattccatagtgtccaggtgatgagaatattcccaaagtctagagttataaaaccacctaatgttgcctaattaatcagcgaagcatctacctaaaatcatactagtggtaccatgagtagagtgtccactagttggggttttgtttattctagggtgaacaaggaaataataacaataacaataataaggtcataacaaaggtaaataggcatggctagataaaacaggataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgcagcgtttacacgaccaacggaaaagaaaaggattttactctaataaacttccatataacaagcaggaacaaagcacaaaaatgggttcttgacttcttcaggaaaaattagagacttgaatggtccaattccgagttcaaatggccaagttatggccatttgaagtttatatgctctttaaatgaatatttgcgaatttcttcatttaaattttaattttaaaagggtttattgcgtcagccgaggggaggggacgcgcggaccgggtccacgggagtggggcccacgcggtagcctcacggtccacggtggaccgggtgcacccgggctcacaccggccggcgccgtgggccccacgcgtcagccgcaaccgagggcgcgggc

SEQ ID NO: 13990 - DNA, 3118 bp, Oryza sativa
tttgcgggggcaagtccgcccgtttgaactcgatagagagagagggaaaaatggggggaaagggagagggaatcacggggaataaatccccctattgattgcacgcggggacgacgggatgcggcggattcggcggcggcggtggcgctagggcgcgggcaaggcggcatgagcggcgggaggaaggggatgacgggtgggccccacccgtcagcgagggtggcgggcgggcctgcccgtcagcggcgcgcgcggggagaggccgagtgggccgcggggagaggagagagagggggagggagatgggccgagccggcccaagagggggagggagggaaaggggacctttagggtttttctttttataaaaccattttaactttgtttatttcttaataattattatttgtgctctgaaaattccactaaaatttatttacgcattttaggcttttaggaaatatacaaaaatcctccaagccttatttgactttaactttgcacattttaatttttggaggctttcacacggattttaattattctaggcataatttagaggatgtattttagagtcgttttgggacgtgacagtttggtggccaatcctctcagcctgctgccataggggttagtggtcaatcctctcagactgctgccacaggggttgaagctcctgaggtagaagtcactgatgaagctcaggttgttagagtgttgcatgatccagagaatccaaatatagtgaagaatgctctattccctgacatgatatcttttagaaaagcagttaggcattatgcaattaagaaaggttttgagtttgctgatttgaagacagataaaacaagattcattgcaacctgtcgcgctgaaggctgtccatggagaatacgtgcttccctaatccatgataagaaaacaattaaggtataaatgtattattttagttaatttattttttcatctcctgaaagtagtgttagttttagtaactttttatcaccatgtcatgtcatgcagattacagttcttccctttgaacacaaatatgcatctaccaaactaagagagggcaagatggctacacagggctgggttgctgataggcttggtgattggttgaagaacaatccaaagaagggtgctaaggatgcaagagggaagctgcaagaacagtatgagatcaagttgaagtattcaaaggcatggtcaggtatgaagttagcactagaacaggtacatggtaaatatgaggaaagttttcagttgcttttcaactggaaggctgaaattgagaggaagtgtccaggtagtatagttgaaattgaattggagaagttaggaaataaaatgtgcttcaagcgtttgtttgtagctctaaaaccatgtatagatggctttttgcaagggtgtaggccatatgtgggtgtagactcaactaagttgactagaaaatacactggacagttagcttcagccacctctgtagatggtcacaactggcttttttatgtatcatatgcaatttttgatttggaaactaataacaactggttgtggtttatgaaacaattgaatagagctattggttgtcctgaagggttagttatctaaccgatgcatgcaaggggttagaaaaggctgttagtgctgcatttagtgatcatgttgagcatagagaatgcattaggcacctctatgctaacttcctaaagaagtaccatggttctgttatcactgagcatttgtatccagctgctaggagctacactgaggagggtttcaagtaccatatgcagcaaatatatgcagtgaaaccagatgcaatagagtttcttgagcaacatcattcaagaatttggtacagatgtggctttggagaaagcagcaaatgtgactatctgacaaacaatgtttctgagtgctttaatgctcagatcagaaatctgaaaggactgcttcctcatgaacttgttgacagcatacgagagttaataatggagaagatggccactagaagagatgttggcaagaaaatggatgatggaatcattccaggtgttatgaagcagcttaatgatgccacatctcttcttaaagtggtgaagattaccagaagtgatgatgggtttgcagaggtcacacttgtggatactgacaacaagactagaaggcatattgttgacctagacaaccaaaaatgctcctgtagggcttggcaaataacagggaagccatgcaggcatgcattggcctggatatgcagcagtggaggaaggatacaagattttgtgagcccatattatagtgtgcaaatgttcaggacagcttatgcaggcagagtaccacctatgactgataggacacagtggccagtagttgatttgggcttcaaggtgcatgtccctaagcagaagagaggtgctgggaggcctagagtacagagaataaggggatttcttgagcctggaagaaagagagtgaaatgcaagagatgtaaaagatttggacattttgagaaaacatgcaagctagctgaacctgtagatgcagatgatatgagcagccactgcaccccccaaaaacggtatattgctgtcattgtgcttccattcttaattagtctttgtgcaagcggtttgtgttctttaactccaacttgataaaaaaaacccaacttgataattattgttagttacactcctgatatattgtgctatgttgtagtcactaagattcaggcttgtatgcttgccatatggtctaaaaattctcacttttttgtaggaagagacaagtgtgcaggcaaggaaatgatccaggagtgtcaacaagtgaagcaagctgctctgcaccaaagaagaaaaaaacacctaggaaaaaaaagacaccaaaaaagaagaagactccccagaagaggaaagacctagcatcctcaagtgcaccaccaactagagtagttaggagcctatctacctattttttactgtaatgccagctgcctcctctttaagtattttggtaattgccaatggctgtgatgaacttgcaatgcacgtgggcctgtgaacttgtaataacctatttgcagtggcaatgtagcctgccccatctt

SEQ ID NO: 13991 - DNA, 4289 bp, Oryza sativa
  unsure (1)..(4289): unsure at all n locations
gttccgccgccttccgccgccatcgattgcgccggcgccatcgcttgcgccgcctccaagaagctagggtttcggtgtggggaacgaatggcgaccgggctgttcgagccggaccggagctggtctaagcacacgtgaacacgagggcataaacgtccatacgaaaatacggtaccctaaaacggtggcaaagcacgcgcagggcgtacattgtggcatggttccaatttgacgaaatagtagtggcatgcacccggattccggaataggtgtgtcatttttttatttgccacaattcgcgtggcatagatccaattaaccctatagagaaagatcctccaatccgtttaattttataacctgctttgtttatacgtgatttggtttgacattcatcgatctttgccaataaacccgtatcatatttgatcacagaaaaaaaaaacttgtcgcgtttggcgattttgacgagctttggtataattttaacatcgtcaccgttgcctgccctccaacctttgcagccacctgacagctcagtatagctttgcatatgaccccacttagctctatgcatgccccatacatggcttggcacatccgtgttattgttgtctcatcttctttttctatatatccagcctagcttgacaagtttttgccttgttctgtcctcgtactctggttttaacagttacaagcctaccgttatactccctccgtctcataatataagggattttgagtttttgcttgtaacgttgatcactcgtcttattcaaattttttgtaaattattatgtattttatttttgacttactttattatctacaatactttaagcacaactttttgtttttttatatttgcaaaaaaaaattgaataagacgagtggtcnnacgttgcatgcannnactcnnaatcccttatattgtgggacggagggagtattatttgtttcgaaaaatgttactgatatgggttgccagttgcccctcgcacaatattcacttatctcttttagacctatatggtactggcaccactgccatacgtactccttttatctatcgttgtgtataagatccatctctattcctatgttccaataaattaaaaacttttcaagtttttttaaataaaccggtatctttaagtgggtctaccagtgtaaggggtcggtccatccaactataaggacggttttaagttaagaaccggtacctacaaatgagaataggcataggttccaattaaatcggtacatatgagcatcatctatagcagtgtacgcgcataatttttcattagcaagtacgcaatgtcaccttatttccttggggtcaggttgaatccagcgacaccgaggctagaggagctgagataggacgtaggatttgaccagctttataaccaaaaggttaaacgaagtggacgattcactattgtttccacaaagtcttcggttatgatgtaaagtgaccagggacatgacatggaaagatgattctttacgtagttaatgatcagatgatgacaactatactactgtctttgttttttaatatataagatcgtttgacattttgacaaatgtttgatcatctgttttattcaaaactcttatacaaatataaaaaatatttaacttttataaaaaaacatttgatgataaatcaagtcacaataaataaataataattacataactttttaaataaggcaaatagtcaaacgagtattttaaaagatcaatagcattatatattaaacaacgagagtacttagctaaagcaaagaaaaataaacatgtacgttttgtttccttgtgtatttacaactctggtaggctcactcaagaaaggacagagtacatataaactccaataacgactgcacgttctaaacgccaaactgtgcaaacgtacaacaatcaataataaatctcatgttactgttttgacatcttctttatagcctttatgtacgttatatgcgtccattttctagcacgcacaagttgggagaagaaacttagctaaaattgcgtcagtgccgtaattaatttcttgtatcatcaacaagcaaaattttctccgagatctgaaaatgcacaccgacacactgtacgccccataacagatgccgcacgtgggagctattataccgttgaaattttcaagttaagaaatactagctctgtttcattttaaatgcaactatgtttttccgtacctaattttgatcgtttgtccatcttatttaaaaaaattttgaaaaaaattaaaaacataagtcataagtaaagtactattcatattcatgttttatcatctcataataacaaaaatactaattataaaaaaaattttaaataagacggacgattaaagttggacgcggaagcacttaaatttggacggagggagtaataccgagtctcttttatactaggtactataggagtaccattcaagtgcccatattttagatcaaaggtagcatcctaattggctgtgttttgtgatgtatggttgattgttgagacttgagacttgaggcagtaattttttttagataattaaacttgacgaactttgaagcacaatatgaaggaatttttatttcgataaattttcgttaccgtattcgagcctgttcctattcacttcgttctcatgtttaccaatcactaagtcgcgcgttgcgcaacaatgaatatacactcctaagtgttaacctgtacatattcctaagttgtcttgtaagtgttttatactgttattttagaaaagtagaaattagtggcacatcgttttgttgcccaatattaggatacaaccattcaagtatttggtggtggggcatatgacacccccctctctcgatcactatattttcactcaacatattgaactttcatcacgatatatatattataagtatttctaaggcattttttatgctgaatggaatataaatgataatttagataacataatgttataaaagatgcttttgagctcaactataaacacaacactttagcgattaataaaaaaaatcaagcgtatactccctctagtttttaacggacgacaccgctggcttttgaacatgcttttgactattcatcttatttaaaagccatgtaaatatgaaatatacatataagttattctgaaagtacttctaataataaaataaataataaaaataattatgtaattttggtcaaatatatatttaaaaatcaagagcatcatatattaaaaactgaaacaaaataaagcatatcgaagtccatctaatatgctagtactttgtactattcgtaaatacattttataattttatttgaatttgagttgtgccattcttttttttctatggctgaccatgtgcctggcagctttgagacttcctcgttggaagtctagaagtttcttgagggcagctcctgtgccttgaaattttttttctggttttttaatagaagtatgaatctaatgtttcattttttgcttgctgtctgcatccaacagtggttctttcgtgacctagctcgattgcaagaaactttagttctttaatactttagattcggaattttcccctgagaatcatgcttattttggcccggaaattccttccgagggcccccacacaagcgtttatctggccttcttttcccatgacaagccaacaaggccaaatacggattccatctccatacgttcatcatgttacgatggaccgaaatccaagcccatttatgtgttaacaaggcccaactatgctaaagttgtttcatatctggcccatcaacacgttgcagttatgggtcgtcattccacagtgggcttgtcacaacaaaactcgtaggaaaaagtccaatttactcccttaaatataggcaaaatctaattcgtacccctcaactggaaaaccgggtaggacgactcccctaactattgtaaccggtgcaattggactccctcggcggtttcggagggcggttttgctgacgtggcaatgttgacccggttttcgtcccacgtggcgcttacatggcattagaattaaaaaaatatctgtgggtcccatctgtcattaaaaaaattatattgtgggacccactgacatgtggggcccacatgtcatcctctcttctctacctttttcatcctccccctctctttctcttcacgagagtgggacgagggccagcggcagcagcggtgaaggacgggcgggcgagggccggagcaagggccaaatcgtcgg

SEQ ID NO: 13992 - DNA, 7546 bp, Oryza sativa
  unsure (1)..(7546): unsure at all n locations
acccccgtccgtcgccgccgccaatgcctatgtggcccctgctcctgtgaagacaaacgggggagaaagagatgagggagagagagggaggagaaagagctggccccgccgccgaccactccctcgaccgccgccgccctagtgtcgctgaaagggtcaattaggcctagaggagggggggtgaataggctaatttaaaactttatgcggaagctaaaactgagttagggtcggaaagtctgatccacagtcagactatccgaaaatatcagatagtctgatgttggatcagactgtctgatccactaaaggaacactacaagtagatctagtgcacaaacaagagtatggcacaaacagcgactagatctaaagcggcacaaaagcaaagctaaataataggagaagagatatcaccaacaatgaagttcaccgagttgttcccggagttcaaatccttgaggggattctactctacgttgaggagctcactaagagccgggtctttgctaaccctttcctcaagaggttgcactaagcactcctctttccactaaggggtatctctttccttgtggaggcgagatccggccttcacaaacttctcccggccaaccacacgtagatcggtggctcgggagtgacacctagccgtttaggagtcctcaacctccaagagtaacaaacaccacacaactcttggtcaaaccctagtgctcaagatcgagtgaaacacacactaggccctcaaacaccaaatccacaaccaccaagatctactacacaaagaacaaagagggatttgagagagggagagagagctcaaagatccaaaacactttagcaccaagctcaacccaaagtgaatgtgaatgaatgagttgggtaaccctagaaaagggttaggtggggggtatttatagaagcccccaaaatgtggccgttgggagagaatcttttcatcccacctcggaaagtccgaggtgacatcggatagtccgatgtttttgacccccaagcaggccagagacagagaacaaaattctagaggatttcggacaatccgatcgatcggaaagtccgatgtcatattggatattccattatttttgaaccaagaatttcatcctctcacagagactcaagttccattgaatttcggagtctctggatcatcggatactccgatcacatcggatagtctgatttaaaactcactcaaaaggaataaaaagcaattcaaaatagagagtgaagttctgagaaatttcagatagtccgacgtatcggatagtccgaccttatatcggatagtccgatattttttagccaacactcagaccgaagacagtgagcaaagttctgtgaaatttcggatagtctgagcatcggatagtctgatcaacatcggacagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacacccaaataaatgaggggtcctagatgcactttcattctccccctttttggtgattaatgacaacacacttagaagtaataaaagattaggattttggtggagctccccctaaatatatgctagaaatgaaataggagagctccccctcaatctatgcactagattagaaatgacaatataacctcatgcatatgccaatgacaagatatttcacacatttgagcatggataatagataattgcacataacaagacacaaaaacccaagggtcgactagccatcacgaaaggagatagattagagatttttgatgataggtggttctccccctttggcaacaaggcaccaaaagggaaaaaatagaggatcactcatccttatcagaatcctcgccctcctcacttgactcctcagcatagtcaccttcctcctcctcttcttcttcctccataggagccttgccatgatccgcacgagaggagcttgcctcagctgcaaaagggtcctcaatcacatcctccccactgtcctcaacctcagaaccatcgggagaacacggcaaatgggtgttgcgaaggagggtcttgatccgtcgagtgtccttcttccttgctctgcgttccttggcttgccgaactgagatggtcttgcataagttgaagatggacttgaagaacctcaaggacgagttggagtccggcttggtgacggtagcggagggaccggcacgagaagaagcacgagtggttcgtccagccggcacagcagcaaccttgatgggacggacttggtaatcggtatgtgccacctccttgtgaaacttcttcttggacacaatctcaatcatcttcataatgtaaggcccatagccaagtcctcgcttaggcatcatggagataagccggatttcttcaaagatgaagtcaaaggcgtcaaagagctgtgggtgagccttcatcttgtaaagcaaatttcttgtataggcaaggacgttgctagcatcaccttccttgggattgagagttttgcgcaagagcttgttgagataggcatagaagggaaggagacctttgatggtgcctaactcatagtccacatcttggtacaagaagtgaagagaatttgtgtccatgggcttctcatcatgaatcttgacacgattggtgcgagagcgagtcggaaaccccaaaatggcagcaaacttagcatatgtcacggagtatatgatgccatctgtcatccaatgaataatcttttctttgttgggctcaaaataaagtgtggcatagaattgtgcgaagatttctttgcaccatgggtattgcaagcccatgagttccttcaagttttgccgagcacaagcttcaatgacttcatcaataattgaatcatgcaactcctccatatacttccaatcaacccactgcataagaataggccccttcttaggtgcattcactgtctcatagtaatcctgctgaaaaaggttccaaaaccgaggatcagtggacaactgttgaaatttgtagagatctttcttacgctctttctccacttcagtccacttgcggttccaccttatgactctccgatgataattaggatctctagagggagcagtgataaagaaaggcccttcttcctgagcggcttgctgagcggcaatgtcctcttctaaatgaatctcttcctcaaaggatggtgcatgagaaccactaccttgacccggctcagaagaatccgtaggattgcctctccttacttttttagcaggtgcacttgatctttctccactgactcggctgcggcgaggaggaagaggagcaccatgctccacattagccacttgagctgcttggtcagaggcttgagcttgcgcgtcaatggcatctttgcgagattcggacatacgccgtatagcatgacgagccttggaagcgggagagcgacctcgagaactcattgtcccacggcgagagtaaacttgattcttgaactgacccgtgatcatgaggatacactgatttagaacagaggataatgattaagaagaagtggaagaagaatatttaaatgtgaagcaaggagaaatttggactgggccaaaaggaggtcggatagtctgatttgacgtcggactatccggtgtacatcggactatccgacagcatatcagacaatccgacggccttttgccctagaccaacaaatctcgattcacacaaacatatccaatggaatcaaaggatcttctaggtactagatctaggcactaaaacaagaagattcaccgaaggaaatcttgaaataatacaccatgaggaagatcgagggaaaacaaggaaatacctcaagaaccactaagagaatcactggggaaccagtgatttggaaggagttgagggagggaaaccaccctaaagtgaaggaatagcaatcggagactccgaaacgaagatttttggtggcctagaactagggtttggagtggagaagaggggtggagagagaaacgactgagacaaatgactgaaggggtaagaaagagttacccccggggaggttaagtccccttgcccttggccccacgtcggatagtccgatttgaaatcggactgtccgattgtagtcggatagtctgacttgatgtcagacagtccgacatcctttgtggcagagacaataaaggatggctcaaggaagatttttttcaacaacattttgataggatgaactcgatggctagactattacttggacaaatgcagcaaaagaaagaaaactaggcaccctcgagagagggaatgtacgaatctatagcaaattgtgcaaggaccaagattcattagagaatgagatccccgtacacatagatttcaagttatccacatagattatgactagtgtttattcatgaattgaatgttcactttgtcatgatatggcaagcaaacctattctagtaaatgaaaaacacatgcatgcaaaagatcaagccacattccgagaatccaagatatttagctcacttctcaactcacaaaacctagcttcatctagaggcttggtgaagatatccgccaattgtttgtcggttctcacatgttggatgtctatgttgcctcttgtggaatggtctctcaagaaatggtggcgaatatctatatgcttggttcgggaatgttggatggggttattggctaacttaatggcgctctcattgtcacataagagtgggattttggacacatttaggccatagtctctcaaggtttgcttcatccaaagaagttgagcacaacaactccccgtcgaaacgtattccgcttcggcggtggatggggcgacggagttttgcttcttggaagaccaagaaacaagggacctacccaagaattggcaagtacccgatgtgcttttcctatccactttgcacccggcataatccgcatcggcataaccaatgagatcaaacctcgctcccttaggataccaaagaccaagattaggtgtgtgcactaaatatctaagaattctcttcacggccacaaggtgacactccttcggagcggcttgaaatcttgcacacatgcacacactaagcataatatcgggcttagatgcacaaaggtaaataagtgagccaatgatggaacggtataccttttggtcaacgtctttaccttgctcgttgaggtcgaggtggccatttgatggcatgggagtgtggattggcttcgcattctccattccaaacttcttgagcatgtccttcaaatactttgtttggcaaatgaaggttccttccttgagttgcttgatttgaaggccgaggaagaactttaattcacccatcatggacatctcaaaacgtttggtcatcatcctactaaactcttcactaaaagacttgttagtagaaccaaatataatgtcatcgacatatatttggcacacaaaaatatcattatcatgtcttttagtaaaaagagttgaatcggctttcccgatctcaaagccgtttttcacaagaaaattgtgaagacactcataccaagctctaggggcttgcttaagcccgtagagtgccttgtggagcttgtacacgtggttgggatacttcggatcctcgaagcccggtggttgctccacgtataccaactcgttgatgggcccgttgaggaaggcgcttttaacatccatttgatatagcttaaaattgaggttagtagcaaaagcaagcaatatgcgaattgactcaagtctagctattggcgcaaaagtttcaccaaaatctaatccttcgatttgggtaaacccttgcgccactaacctcgccttgttccttattacgaccccggcctcgtcttgcttattgcggaagatccactttgtgccaatcacattttgccaaggtcgctccaccaaagtccacacttcattctgggtgaaattgttcaactcctcttgcatcgccatcacccaatccggatcattaagagcttcttccacccttagaggttcaatagaagacacaaacgagtaatgctcacaaaaatttgcaatacgagaatgagtggatactcccttgttgatgtctcctaagatgttgtcggtggggtgatctcgttggatactttggtggattcttgggtgagctagatttatcggagagggtggcacttgctcgccttcttcaccttgatccaagcttgaagtggagggattgtcggcttgggttaatgtaggtggctctacttgtgttgaggaagaggccccttgttgtggctccctaggacgcacgtctccaagagccaatcttttgattgcttcgctagggtcctcctcttcacctaacacatgtgagtcgacttgctctacttgagagccgttagtttcgtcaaatgtcacatcacgcgcgatctcaacaataccggaggtgttgttgaaaacgcggtatgcgcattcatttgacccatgcccaagcaagaacccctcatcaactttaggagcaaactttgaggatctagccttcttattaagaatgtagcacttactaccgaaaacacgaaagtaagagacatttggtttgttaccggtaagaagctcatagggagtcttcttaagaaggcggtgaagatagaggcggttgatggcgtggcatgcggtgttgacggcttcggcccaaaaacagtccgatgtcttgtactcatccaacatggtcctcgccatctcgatgagagtcctattcttcctctcggctactccattttgttgaggtgaatatggagccaagaactcgtgcttgatgccttcttcatcaaggaaactctcgatgcacgtgttcttgaactccttgccgttgtcggttcgaatgttcttgatcttgaggtcgaactcgttttgggctcttcttgcaaacttcttgaagattgcttgtgtctcactcttgtcatgcaagaagaacacccacgtgaagtcatcaacaataacgagaccatatttgttacctccaatgcttagataagcaattggccctgtcggtgacatgggaccgggggtatcgtgactagaggcttgggtagccgcggtcgcccacgtggcctgaccccctcggggggggggggtcntntccaactgtaacatgtccacccatgctttatatgaacttgttggatttggctatatgtttatgctatattgaatgcactttggaatccacaaaatgagaagttatgctgtcaaaattttgtttaattcattttgtcaaaattctgacaactttttagtcaaatctgtcaaaatgaatcatttttctcaaatttatggcaaatctgtcataattgtgatacattttatttaatttattttcataa

SEQ ID NO: 13993 - DNA, 4028 bp, Oryza sativa
  unsure (1)..(4028): unsure at all n locations
cacccctccctctgtctccccgaggggtcgggccgcacccgtttcggccccgagggttggggcgccccgaccccctgtggttttggcgccacgtgtgtgggttaggtgagcacagcaggcgctcacctaaccgcatttatagcgggttagacgagcgcgccacgccgcattcaatgcggcgcagcgcatgcttatccggtccgtgaccagtcgcggtgtgtgaccggtcaaagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccagacttcagcgcaagaatggcaaggaagtcgccggccattaaatgaagtttgaaatgggcgtcctccggaaaagctgacgagcggggcaggagacgagcgcactgcttgtcaagggtcacttccggctgtagactagccctcattgtaaaaagcatgtttcctttcttaggcagctagaggcccctgtggtgaccgctgaccagataaaaaggaggcccaggcctagaagaagggggattttcttgggggatttttgaggaggagcctgaactctctctggctctcgagctctctgtattccttcacatacagatccaccagaacacaggagtagggtattacgcttctcagcagcccgaacatgtctacgtcgcccgcgtcttgtgcgatccttctcgctgacattcctctgatcgagggcgaagaacctcacatagcgccctcggccgaaccggcaaaggggggcctgcgcggtcttccggtgaggggccccacgctccgtcatctggcgcgccaggtagggggcgcgcgtgtttttcgaagccctcgtcctctttcgtgtgcgccaagcttctcccgctcagcccaatggccgaacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgcgacatcgccgcccgcgggcgacgggggaggacggcgagacggggcgcgtcgccgcctcgactacggcgatggcagcacgccccagggcgcgctccaggctgcgggtgcgctcttgcgtcacccgcccgtcgtccccgatccagagactccagcccgacgttggctggatgacgtggccgacttggtcatgacggcgcagcagcgcctaggcgccggtgggcggccctccgcccccgaggcctctggcgctgccgccgccggctccacgtcgtcaaggcggagggcgcggcgagcggcggccgtcacccgccgttcgtccgccattccctcgtcaacgcctccgacccaagaagatgagcgtggggggtcggatgcccggctcgatatcgagcgccagcgcgacgatcgtcgcgccgcccacgcaacggagggcgctttctcgtccggagcgccacttcggtccgggcacgggggccggcccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcctgggaggatttgtgccagcagttcaccacgaactttcagggcacatatccgcgcccaggcgaaaaagcggacttgcatgcggaacagcgagggtacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggctctggcgtggcagctccggccgcccccgagtccgccgctcggtcagggcggcgggacaggaggagaaagaagaagtcggcccgttccgacgacgagggtcatgtactcgccgtcgagggcgcttcgcgggccccccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaagaggcaggagcgccgtgagggcaaggccccagcggctcccgccggcaaccggcgaggtgaggccaagcagaaggcccccggcgaggatattgacgatggcgactatgacctggggttttaggagcctgaggccaccatcgccaccgtcgatgggggagcgtgcgctcacgcttctcgccgaagcctcaaggccatgaagcgagagcttctggccgcggcccctacccatgaggcgacccggcgggcgtggtggtcggaggttgccctcaccttcgaccagaccgaccacccgccatgcgttgcccggggaggacagatcgcgatggtggtttcccccaccgtttgcaatgtgaagttggggtgtgtcctcatagacgggggtgcagccctcaacatcctttcccctgcagcctttgacgccatcaaggccccggggatggtgctccggccgttttagccgatcatcggtgtgacgccggggcacacctggccgctgggtcatatcgacctcccggtcaccttcggtggctccgccaacttccgcatggagcgggtggacttcgatgtggcggacctcagtctgccctacaacgcggtcctggggaggcctgcattggtgaagttcatggcagcggtccactacgcttatctccagatgaagatgccgggccccggtggccccatcaccgtccatggcgacctcaaagtcgcacttgcttgtatggagcagcgcgcgtaccacctcgccgcggcgtccaagcccacgggtggcgacgaaaggctcggcacctccgtccccgccgccccgaggcagcggatggtcacgtgcgacgaggtcccggtcaaggaggttgccctgggcgacggcccgtccaagaccacacgaatcggtggtcttctggacgataaataggaagacgcgctcgtctccttcctgcgggcaaatgccgacgtcttcgcctggagaccggcggacatgcccggggtccccagggaggtgattgagcaccgtctcgccgtgcggccgggcgcaaggccggtccggcagaaagtgtggcggcaggccccggaacgtcaagccttcatccgcgaggaggtggcgcgacttctggaggccggattcatacgtgaggtcatccatccggagtggctggcgaacccggtcgtcgttcccaaggcgaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13994 - DNA, 654 bp, Oryza sativa
cagtgctgataattggcccaatgtgaaagacagatgattcgtaggcagaataagtttatttttcctccctcatgtcttgctctagtcgaatcgcatccctcaagcataaaactaggtataatggtctccctcaatttcaaaaaccggtacaaatcgacttctttctgtgggtttgggaaacgatttatgcttatgtgataggttgacttggtcccctgttctaacaaggtaacccattcattaaagaggttaaaaatagaagtgggatccatatctaagtgataagagtaaaattttttaaaaaatacagtgggacctacttttcagcctactcctctctcgagccccaaacagcggcacctccatgtgttgctctggcgtcgcctctactggaggggtccgtcactgcgccagaggacgcggtcgacgggtagaagtgggcagtgatgggcctgacacatagaaggaacacctccatcgagagcgtgatctcgttgacctctggtgacgcatctggttcctcccagagaggcggggagagagccacagggtatcaccatcgcctgtggcgacgacacccaccgctgtagcacatgtcgccacacgctcgtccttgaaagaggtcccccattgaagtcgggtgcagatacaatg

SEQ ID NO: 13995 - DNA, 570 bp, Oryza sativa
ttgatttgaagaaatacctcaagaacgcgaagaacgagtgaagaacgcggtgaagatcaacgatgtaagtgcccacaaggtccccaaacgtgctcccacgaggatgaagtggaggagagcgtcggagagtcggcggagaggaggtggtcgccggggaggagtggatgggggagaggaacccgtggggaaaaggatagcaaagagagagaagaagagtccatgggttggaggagagttttatacccccgagaattttcggaagtttccgaaaattttcggatttacagaaccactgagcacgcttctggatattttcggaagttccgaattttttttcggaagtttccgaaaatatacagaaacacagggattgtttgtactaaggcagtaaattttcccctgcgagattatttacagcacagtgattgcgtgtgttcttttattttctggtttcctgctttacttgaaaaccctataaaccccattgaaattgataggttgtaatttttctgtgtgtcgcaggttttattttttgacatagttcagctaaaatttcggattcttgcatga

SEQ ID NO: 13996 - DNA, 942 bp, Oryza sativa
tctgaacgaggaagctcttcctgaaaggctttttcctccacgcttagattttcattcagattctgttgctaccagggtttacatttccgacaggatttcgcgaaattttgatgtttcgatgaggctcgaaagtataaaccgtttaagatttcgagaagtttcatccaaattcaaatttgaattcataaaaaaaaataaaatcaaataaaatcttataaatactatgatattcatataacttattgagatataaattttcgaaaaacattatgtattatgtgtatttactgaaacttacatcagaaaagaaaagaataaagaattaaaaaaaggaaaacaaattactgatcgaaatttcgatgatttcgatcggaatttcgccaaaactgatcggttttcgaaaatttgtcggtaaacttagggaatttgtattcaaattttggtttatgaaatttgttcagaatttaccggttttccaccggatttcgcgaaattccgaattccaccagtgcccgaaacggaaaagcctgtcggaattgtaaaccctggttgctacaaaccaagtttcccaaacagggcgtagaaaggaagcaatatcatgatacgcttgaagaatactagctatcaaatttcaaccgtttcacttcacaggcaaaatccgtaagctgaatattagctgaaccaataccatgatactatcttcatctatgaattatctcatctcatcttcaaagtgacacagcagttcaaacatagaccctagaaaatggagcctttgccatctctctgcctgctagtgagactattgactgctaatttgtaagctgaatattgttagcagccgggttgatgatgattgaccaacctgcacaatttttcaacacacctgtatcatccttctcaattgacagctgactgaggccactcttttattaggcttag

SEQ ID NO: 13997 - DNA, 730 bp, Oryza sativa
tgtgctttcagtggtaggcgacatacccgtcgacggtgagcgcctgtggtgacttcgtcaatctcaaggatttgccggcttagtcttcaaagatgcttatagaggtagggtttacgtgcgtatgttcataggggtaagtgtgcgtgcgttgtgagtgtctgcgttgtaccatatgattaaaaaaaaggtgtgtcatatattaagagcctgattagttgcccatattccctgataaaccaaaacggcttattagagattaaaaaatcatttatatgtaaaacttttatatatattttttcgtagcgacttaaaaatcaataataaaaaaattacgtagaaaatatcttaaaatcaataccaaatttaaattttttgctttgacttatttggcgaaacgatgggatctctaatccccacccatccgaactcgatgaggcttctttaataatgccccaggtcataggagctgcttccctccgagctctatataaaccacataaacctcttccaaatcaccccaattcccaaagcaaccgacacacacacacacaagctacaaacatggctgcttcttcttggtgggttgtagcggcgtgcgtggtgttggcggcggcggcggcggccgacccgagggacgggttcacggcggtgagcctgggcgatggcaacttccagctgcagtggccgtacgacgtggagagcagctcgaggtacagcttcgacggcacgg

SEQ ID NO: 13998 - DNA, 278 bp, Oryza sativa
cgcgtggggcgaagggcataattcctgggtacaacttaacttgcctaaaaaattgtcaatgccacgatgtttcctgtcaatagttgtaattgaggacaaggtcaattttatgttgacaggtcagtggagtttcttttgattcgtattggtctcctccgaattctgatggaacaggagaaaataccgtgtatcgttttggttctgttggtcaggtatcacaaatttatatagctggagatatagtatgcagtctgtgcttttatgacatgtccttaatg

SEQ ID NO: 13999 - DNA, 650 bp, Oryza sativa
aaaaaagaacaatattctagcgagctgacattcagcgacaaagataaatagccattgtttttgaggctttataataaaaaaaagtaacggtacagcagcatgagctcaccaatcgggtctgatgaatcgacaataatagcatcatatgtcccttcaggagcattccttaagaactccacagctgaaataaaataggacagttatgaaaattacaaaccaaagaattgaaaggtgcatctaaattgcaaataggatatatttttttcacagttataaacaggtaatattgattgtgaacgtaccatcaccaacatgaagccgaacacgaggatctttgaatccaacagataaatctgggaagaaatctttacaaacctacataattaagatgcatatcaggaaagtttgttgtgcaatgacatatatttattcaaatatcaaaggagaattgttacatcaataactagctgatcaatttcacatatatcaattgactccacagaaccatgtctacatatctcccgaaggactccaccatcaccacctccaataaccaaaacctgaaattcggtaggtccaaagaacattagcgaccaaactaaaattttctatagaagtaaggataaaaggaagaaataattcaagacaat

SEQ ID NO: 14000 - DNA, 629 bp, Oryza sativa
ttcctgcagcccattaaaggtaaaactctatcgaatgcttcgggcaccggtcctcccctggtctgccaggctgagtccggtcttgagctctatgatgtacccaaacattgagggatacaagggatggacaaggctgtcaccacttgcattctacctcactttccggggagcacacaacaaacaaagaaaatttctaacctagacaccacacctatgttattaattactactctaaccttgcgcaataacttccttctttatctaaagtcctagtactagaacatagtttcacactaagcgatgaaccaacatcgatgagaatatatctcacttaaataaactaactaaagaacataaagaaactcgaatacttaccttatagaaggaagcatccgctgaaatacaattgagagaagaaggccaacagtaccggctttctccagaactccatttgaagaatgccgactttctccggaattcaatttgaagaatgccgacagtccggcaaaccctttccccccctttttcccccccccaaaatccatttcggaggactccaacagcaacatactaaagtaatgctaaagtgagttgcactctattttgttgtcaagttaagtgtgtatgaa

SEQ ID NO: 14001 - DNA, 481 bp, Oryza sativa
attgtgctaagtctccactagacaaatactagtacactggacaaatattagtagagttctcatactaataaggcagaatgaatgatgtaatgcatttatgtgcatggtgagatcttggaacttatagatcagttttttctaatcaaaccccttatccttccaagggcatttccaatggcaagaaaggagacctaggttatatgcaaaaacaagaagaaatcggtgttaacctatattggggatgggagaatgggagctgggagggcggctgactttggcgcacgcgacgggagggaggtggccggcgacgcccgcgcggctggaggggcggtggccggcggcccgcgcggcgggagggcggcggccggtgacacccgcggggcggaagcggtcgtggccgactgcccgcgcggagggaggggccgtggccggcagcccaagcggtagggcgacgcctgcgcggtgggagggcggtggccgg

SEQ ID NO: 14002 - DNA, 3517 bp, Oryza sativa
catgggcacacaagggattggctctaaaatatatataaacctgactccatgtatgcaaacaaaaattagcacctgcaatttagttatcatgacacatcagctgctatacgtccgactagcgcgttcgactggcgtacgactcaacggcgaattacacggcgtgaggcagtactgacttggtcagatgggctgctgctccaactgtcccacgtaacataatccacatcaaagcccatatattatttcaagcctgaacttataaggacacaacatgtccttttagccgcacaacgatattttgtctcatgtctatgattttttagataaaaatttggagtaggcataaataaatcagcagctttcacatactttttttttcggggaagcagctttcacataccttgtgtgatgtgatcagtgaatactattggctagataaaacaacgtggccgtgtggccaaattacatcttattgaactcaagaaattgattagagatggaacacaaaggaattagatcgtggggtttaggatagaaggagatggaaagtcacgttgaggcaatattatcggctagatgaaacgatgagcggaagtgcggccagattattgaattgggcttttgtaaggcccaactgaattagtgatctatgcggatgtgtagacacggacggcggacgtcttagtcgtacaagggtcggatgctttggttgtatgtatagcatttttggttaacaatatagtgaaatggactaaaatatagttagtttcaaactgttaatgctacaaagccatgggagaactaaaacgtgatgaaaggtcatcagaacagccaattaggggcggtttagatggggtaaaattgtttagtccctatcgcatcggttgtttggacactaatttggagtattaaatatagactaataattaataaaaaaactaatttcataaataagagctaatccgcgagacgaattttttaagcctaattaatccataattatcaaaagtttactgtagcatcacattgtcaaatcatgacgtaattaggctcaaaagattcgtctcacgaattagtctaaggttatggaatgggtttttgtaattagtctatgtttaatactctaaattagtgtccaaacatcctatgtgacagggacttagaataagtcgttgtttcccaaacagcctgtaataaagctaaatctacattttggtgcatggcagggaggagggagctcggctctacgtacggctcagctcaaacgacctcggctctacgacacatgcgcgcgcgaggagggagctgtggcagggtatggcgagcggtagagaaggtgtcggccgacgtgacccaagctctccggtgggcgcacgcgaggaggctgtgccccggccgacagcgaccccggctctctaatgggcgcacacgaggaagcgaggaggagcgaggaggtggtggggattcgcagggcggattcattgcggcggagtcatcgcttggggcggaatcggcagaatcactgatgaatgcgtactgcgagaaggacagtggacggatgagattagatgagacggtagatggacggatgagataagaggggatgatttcacctgtaggatttctaggcacaactcctccttttttatattagtatagattgtgctgatcttgtttattttttcttccggcatggactcgtatatccctagtggagaactgatctactcccgtgctacccaaaatcataattgtcccagttagattaagaactggtactaaagatgctccaagtccctcgaaatatttttagtctaggttggtgttatcaaccgggactaaaaaaaataatctttagtcccggttggtaacactaacacggactaaagatggaggatctttagtcctagttggtaactgatcaggacatcactccttcgaatatacacaacaatcctctaccggtcattcaaggagcaatcacaagagctcgctcctatgtccttctttatataattttgagaatagattgctatctaatgattatgattatattacaattaggaacaatggagaggacaaagagatatttagagagggacttagaggcgtggaggaccagcaagggcgtccaagtcaagatggaggtccaaatctagttgacttcgagtacgtttcaaagtccatgaccaatctgtactaaaacgggcgcccaggtcacatacgtgctcggattggggtgttctttatatggatggaaagctaagaagataacatttccaatggttccaatcccatatccaaattctttccgagtcatcgggaatcgaccgaacaagttgacttccaaattttgttccggtgctgtgtcaccgtattttggcctttgggccgtgtatcgtgttggagcccattagggttgcgtatgttagattaatgggctagacccaattaaatcctaataaattccattggtccacattaagtgctatgggtaataataccaccttggaaatctaagtgaagaggtctcaacttaaatatggagctagtggagagtctctgttgaccggttgagatggtgggcgaacagcaacacgcgcgcgccgggccgtggcgtgggcgtgggtgagacaaggctgctttctctctcgttttgtgtcacgtcccaaaacgactctaaaatacatcctctaaattatgcctagaataattaaaatccgtgtgaaagcctccaacaattaaaaggtgcaaagttaaaagtcaaataaggcttgggggatttttgtatatttcctaaaatgcgtaaataaattttagtggaattttcagagcacaaataataattattaagaaataaacaaagttaaaatgattttgtaaaaggaaaaactctaaaaagtcccatttccctccctctccctcttgggccggctcggcccatctccctccccctctctcctcttccccgcggcccatccggcctctccccgcgcgcgccgctaacgggcgggcccgcccgccaccctcgctgacgggtggggcccacccgtcatccccttcctcccgccgctcccgccgcctcccccgcgccctagcgctgccgccgccgcggattccgccgcatcccgccgtccccgcgtgcaataaagtgggaagaatcacttcccgtgatcccctctccctttccccccaaatttccctccctctctcccttggattcgtttggaaaccctcccctaatcccgccggcgccattgatggagcccgagaacgccgcgccggtttccttcccctccggccgccctctcccccttccaaccctatttaaaccctccccgcacctcctccgtccgtttccgcctctcgccaccctttctcctcgccggattcgagcttgcgacgtcgctctctctctccgccgtcgccgccaagctccggtccgccgccgtcgtcgccccggaccgcctcccacctcggtgacacctccttcgggttcgccgcatcctcgggctgc

SEQ ID NO: 14003 - DNA, 7985 bp, Oryza sativa
  unsure (1)..(7985): unsure at all n locations
atttaaatggagaaattcgcaaatattcatttaaagagcatataaacttcaaatggccataacttggccatttgaactcggaattggaccattcaagtctctaatttttccttaagaagtcaagaacccatttttgcgctttgttcctgcttgttatatggagtttattagagtaaaagccttttcttttccgttggtcgtgtagacgctgcagcttcggaagatccgctcttcgtggaagttgaagccgacgtttggcaaagagagcaaggcaagtcacatcatccttgaacatattgaatcccagtttataaaattattttgatttaaattattgcattatcgctttatttaaattcccgcgttatcactgttttatctagccatgcctatgtacctttgttatgaccttattattgttattgttattattaccttgtccaccctagaataaacaaaacaccaactagtggacactctactcatggtaccactagtatgattttaggtagatgcttcgctggttaattaggcaacattaggtggttttacaactctagactttgggatattctcatcacctggacactatggaattgttggatcagtgtggaattggattcacacctccccctctattcaaaatcctcaaaatggatttaggttgggctcggggtgcatggttttgatagtagcacctcggccatataaggaccggtcttcgggcctctgttgcaaagcactaccgtacttccacatgtttagtgggtaaggcttagtttgtggctcagtctggttataaacaaaagtacacggatggagatggacgaagtcgggggtcgatggacatctctagggcaaatgaaggctacacgagctgcggctcggtagtcgagatgtcatggcacagggccggtgtcctgctgctaggggctcagtcctgcctacctgtcccggaggttccggccgtaggtggggttgggtctgtactcttgtctatggctaggatgggttggaaactatgtcacgtcttccgtccgtataccgtggtggtatgtggcacgtgtgatgaaccctgagttcctctcgacactcaaggctgttgttggcccgatctttcggtgagttgtgatatctacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccaaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatggaccccacctgggccggggtcccaaatgaagttacaagcccataggcccattataggtgatgcaacaccttgttcctgtgattctggccacacgagatagaattcagagaagaggctggatccgttaaaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaacgtggttacatgtgaggaagatgtgtcttgtgggtaaagatgtacacatctgatcagagtataatctattcgaatagccgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcagtctgaatcatcgtaggccttgggttaaggcaggttcgtgtgggttcacggccttgattaataatattgtatagctctaggatcgtatttacaaaatagctttgagcaactaagtgtcttttaatgctgtttgctgcaaaccctaaccctttatattataacccccttgtactcccttggatttatcctgcacttgtgagtgtgtcttgttgagtacggtggttgtactcagtcttgctcaattttttcccaaacccagaagaggagcccctggataatgaaggctttggtgtctagctcgtgcctgccgtcaagcgcctgtggtcgtcgccctagtcttccgctgtttttcgtttgtctttttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttctggtcgtgacattttgtaacgaacaataataaatatgggaattgatttagtatgagcgagcgcgtcggttacagaattaaacaccgtggttgatgatcccgaacattactctcgcgctcgcacatactctctcgttttgtaacggacaataataaatacgggaattgatttcgtatgagcgagcgcatcggttacagaatttaacaccacggttgatgatcccgaacattactctcgcgctcgcatgtagttcgtctcttgcacttatgttcattgtggagattatggataccccatatctgcatgacagttatactttagtcggatatacggcaccaaatatagatggaatatctttatgagaactcgggttggtttttaacttgtatgtcaagaaaatatccgggatcctagtcggttacgattgtattttatctataatcccatattctgttaggatatggactgtattttgtaaagcggactccttcccctatataaggagggtccgtgtgcctcttggggcgcgattctttttccagtttatacaatcaataacacactcggcggaatcatccccggacaggagtagggtattacttcttgaataagaaggcctgaacctgtataaaatcccttgtctccaaacccatccactttcctagcttgatagccaccccttttattattgccgaaatcttgtttcaacagttggcgtgccaggtaggggtagcgtcaagttctcgccgactaagtgcgatgggctttgtttctggcatcgacgacttcgccttccctctcgggcaggcgttccggttcggcagcctcaacttcatcaccaacgacttcggcaagatctctctccttgactcggattcaaaccagtcggggagagaccaggtccccgtgccattcggtattccgaactcggcctactctaagatcatctctcccgagtcggcttcaaaccacttggacgagatccaatccgctcggcctcgtccagatcaagacgacgggtcctatccctcaatcttgatgaaacttcctgatgatttggccgccgtcttcactgccaagacatctcccactcgaagatctaggcgagctccggcttcggccccgatccaatctagatccagggaggttggcgttatactccaacctctcgggacagtctcgacggaagagttggatggctacctcagctcccccggcgtcagttctcgaccaaccgagatcctcgactacgacgatttcggctaccactacgaccacggcgacctcgacaacttcgacgacagctatgaggataactacacgcccctcttcttcggcgtattcatggctgacaacgaaacggaggaacagcgccaagcccgagaagcggaccaagatcgcgcacggcaagaagctgaacgtcgccgactggaggaagagcgacagcgacaggagcgagaacgactacagcgtgagcaacaagatcacgaacagattgcaaaggaggctgaagatcgacgacaacgcgccttggaatctgggcggcgagcgagagagctcattgggcaacaagacgtcgatggaacagcggtctttcacaccccccagcagaacgcggttgcagcaatcactctcctcgacaccctcctcaaggaagacgcactcaaccaagctgatcatgttgtcaacatcttgaaccagatgaagaccatgatcgctgcctcggttccagccaactccgcaagcacccgcactccgactggtagccgagtccctcatctccgatctcatgattatcatcagccaagcctcagcatcatcggcacaggatctagccgcaggagcaggggtcacgacgaacgatctgttcactcgcctcccgaacgtcacagggagcgccgagtcgaacggcctcgctctccacttcaccagcgtcctgtcgaccttcgcgacatgatcaaccagcgccgtgcagcacgaggtcaccgccattcaccaaatctctacgacgacgacgtggatggagtagctgccttcactaatgacctgcgtcgagtggattggccagccggctttaagccgactggaatcgagaagtatgacggcaccactaatccggagtcttggctcaccgtctacggactcgcaatccacgcagcaggaggagacagcaaggccatggcaaactatctacctgtggccctagcggattccgcccgatcctggctccacggactaccccttggcatgatcggatcatgggcggaacttcgtgatcacttcatcgccaacttccagggcacctttgaacgccccggcacacagtttgatctctacaacgttgtttagaagtctggagaatcccttcgagattacatctaacgcttctccgaacaacgcaacaagatctccgacatcaccgacgacgtcatcatcgccgccttcactaaaggcattcgccacgaggacctagtcggcaagttcggacgtaaacctcccaggtcggttaagcagatgttcgaaaaagccaacgagtatgtcaaagccgaagatgctattaccgcgtccaaacagtcgggcaccacttgaaagccaaagaaggatacgccgaccgcaggagagagtggaagtaacaaccacaaggatcgcaagcgtaagcccgaagaacttgtggcgaccacctctccatcttcctgacaacgttcccgcatcaacaccttcgacaagataatgaactcccaatgtccgcatcatcccaactccaaccacatggccaaagattgcttcgtctacaaccactttggagcaatacgtcaagaacgcacgtaaaccttcagacggagatcaaggcacatcaaagaagaaagatgatgaagacgatgccccgactggttttcaagatcatcgcaaataacttaatcacatcttcggtggacccctggcttatgagtctaagagaaaacagaagctaacataatgggagatcaatgcggtttagcctaacacgccccaatatcttcggtagttagaaatagcaattaagtttgaccgctcggatcatcccgaccgagtgatccacccggggcggtaccccctagtactagacccagtggttcgcaatgtcaagctccgacagactctcatcgatggtggcagcgcactcaacatcctttttgctaagaccctggactatatgcagattcctcgcacggaattgaagccgagtaatgcacccttccacggtgttatcccaggattgtcagctacaccactcagccaaatcactcttccagttaccttcggcactcgggagaattttctcacagaaaatgtttgtttcgaagttgttgatttcgagacagcatatcatgctatacttggacgaccggctttagctaaatttatggtcgtcccacactacacctacatgatgatgaagatgcctggtcctcgaggagtcatatcactacggagcgacatcaagcaggccgtcacatgtgacaaagaaagttgcgagatggcccaaacccacgagactactctcacccgcgaagagatccgactggctgcgaccacggcaagcgagggagaagtgcctgcaaccaagctgacgaagaccgaagaacgtgatgctaagacgaaaaagattcccttagatccctccgatcctgataagactactgtaataggcgctgagttaaattgtaaataggaaagcgcgctcatcacctttcttcagaataataaagatatttttgcatggaaaccatccgatatgcctggtatccccagagaggtgattgagcactctttacatgttaggaagacgccaaacccatcaagcaacgactccgccattttgcacaggacaggaaggatgcgatcaaggaggaattaaccaagctgttagcaacaggcttcattaaggaagtccttcatctcgactggctggctaacccagtcctggttcgaaaaaagacggggcaatggcacatgtgtgtcgattataccgacctcaacaaatcttgtcccaaagacccttttgggttacctcgcattgaccaggtggttgactcaacggccggctgcgagttactcagcttcttggactattactcgggatatcatcagatccgactaaaagaatccgactgcttgaagacctcgtttattacgccctttggggcctactgctacatcaccatgccctttggattaaagaacgcaggagcaacctatcaacgcatgattcaaagatgtttttcaactcagatcggtcgcaatgttgaagcttatgttgatgatgtagtcgtcaagaccaagcaaaaggatgacctgattgcagatttagaagaaacttttacaagcattcgtgctttcaagatgaaactaaacccggaaaagtgcatcttcggagtaccgtcagggaagttgcttagatttatggtatctcaaagaggcatacaggccaacccggaaaaaaatcaacgccatcctcaacatgaaaccgccaagctcccaaaaagacgtccaaaagctgattggttgcatggcggcgctcagccggttcgtctcacgactcggcgagcgggggatgcccttcttcaagctgctgaagaagactggcaatttccagtggggactcaaagcacagaaagcctttgaagacttcaagaaacttctcaccactccaccagttttggcctcgccacatccacaagagccgctactgttatatgtgtcggcgacctcccaggttgtgagtacggtcctggttgtcgagcgtgaagaggaaggccatattcaaaaagtccaacgtccaatttattttgttagcgaagttttagccgactccaagacaagatatcctcaggttcaaaagttattatatggtgtcttaattaccgttaggaaattatctcactactttcaaagtaactcggtcacggtggtcacatcgtttccactcggagatatacttcacaatcgcgaagcaaatggacggattgcgaagtgggccttagagttgatgtctttggacatatcgttcaagccacgaacttcgatcaagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14004 - DNA, 23602 bp, Oryza sativa
acataagctaggtataggcacaatgacacaaaaattcaaacaatgttgaataaaacatattatatttcactaataggaactttaaaatccatagattaaacgagtgtaataattatgatatgttctgtaatgtgattttttgtgatgcagattgtactatcatttgtgctgccgtttgctctaattccactcattaaattcagtagcagctgcacaaatataggaccatacaagaatgcaacatctgtaagcttgctaaaacagtttttactattcaatttgtttatgacatactctatctgtttggttatactagtcattttggacacgatcatagtccatttccattacataactttcatttagtttgtatgtataattatgtcctagagaatttatgatatatatataacatgaaaaatatcttttacgagaaatctaaatgcccttatgtatgttagcggataattgtaaattaagaaaaaagatatttttgtgctagatgtatgtaggatcgtacactacaaattattgtatgatacactcttaccagggcatctaaaagttacagatggaacaataaaaaaccaaaatgttagaaccttatttgcccctaaaagttgatatgcacgtccctcattctctcagttacatgtgggtccaagctcaacatgtgaatgtgccaagggcaaataagcactcatggaaaggaatacagtgcagtgggttggccttgaccaaccaaatttcttcaacctccccactgccacttacacaattcatttcacttttgtgaccagctattgctgtacatatgtaaataacttatacgccttacttaccactggtaactatacaactctaaagtagtttgtgctgggaaaaaacactaattagcagactcttttcctcttttctaaacagttgtaaatagaagctataagcatgatagtccccttttcatgaacatttttcttttgtgcacatacccccatttcctcagtgtccactttgcattgagtttgacacacaatatttccccagcttctcttattgataaattgatgtccctgctgctatttttatgtgccaacatgtaaaccataaaatcattggataaataataattagcatctctcatatatatataatatatttttccacttaataacatgccaatgctttttagaaaaggggtgcaaatacgagctagtgtatagatggcaacagaaagaaaaaataatgttagattctagttccagccaggtatatctttatttgcataaaatggagttggtagacagtggtgattgttggttcttccctgtctgatactctatggttgaaatatatttgcaaatctatgtctttcattcatatcaaaatgatttatgggtaattctttcatagttatactcttagaatgaaacactatatcaactagggaccaaatgtagcaacatataatttaattactttgttatgatagtctaagaactactatatggctatccatgtgtagagttctggtgtatcaagtctaggttcatgtgcatgttggaacatgggcgttacatatatcccattgtaagagtgaatatatgagatttgaaatctcaactagaactgtaggctgatcacgaatgcatgttactatgttagagctttcaatttgtaaaattacctcatagcatggtgtttcagtaaacattggagtatataattatggttcaaattctagagtgagagtaatttcaaggtagtaacgtttcttgttgtgttattatattctgcatccatatttttagacaatggtttacttcaaatgaatcacagttacttgaagaattatttccattgaattactagataatcggaaatgttcaacataatttgcattattgcatagaataacttttacttcctcaataacaccatagttttcattattccctgtgttgtcttaaaatggcatacatttgtcatcaaattgaactcattcttcttaactcttgggaattttactcttttatgtagattatccgaatcgcgtggatactgtcattggtgattattggaatcaatatttatttcttctgtactagctttgtcgcttggcttgttcatagcgaccttccaagggttgttaatgcaataattagcagccttgttttccctttcatggcagcctatattgctgctctgatctacttggctttcagaaaagttaacctttcagatccattccccaccaattcagtttctggtgagattgaagttcaacacatacaaatacaagagaagcaggaagatttaggtgtacatttatgaatagaaaaggtaacaccgtccatgtgattcttctctggacatgcatcaagtatttagcatatactgaaattgggacttcaattcatttgaagatgtatatagctcaaagcctcgaaatcatttagaaacattctagctagcaaccgtatgttcagtacaattaggcatatagcaaaacttttctagtcataggtgttgtcctttcgttaattgctcatcaaataaaattctcttccacgccatagattcaaatgtgtgacgaactttactataggtatatggcaaaatgcatggaacaatggtcagatgccctgttttgcaaatatgttttttaacataatggaattcattctggcctttacttcgtagaagttgcaatcaattattatgtgtttgcaggtcgaataattgcgaattacaaaattatagcttgattataaactacttcctctgtttcatattataagactttctaacattaccaatattcatatatatgttaatgaatttagacatatatgtgtgcctagattcattaacatttatatgaatgtgggcaatggtagaaagtcttataacctgaaacggaggtagtagaaaactaccaagaataccaccttaaagacataattctatatctatagttggttagggtatgcataaccgttgtctctaccaacggattacaagttatacgtatttcttgtcttcctcaaaccagaaaagcagactatccgaaaaccagcaaccaatcctttgtcggttgaatttcactcctatattaccatcgactaaccaatgttgaaccaaagtggaataaaacatcagatagtatctgagccgtagatttctcattcaccagatcttactagcacctttgccatcgaacccgtccgatggggacaacgccactggaatatcccaccatcagagaacctccaatacgatgtcttcaagaagttgtgacataatgaatccatcactattctggacatccaaaacaaggttttcacccggagagtctacccatgacacaaatgagagattgggcatcccaacatcgcctccaggaaggtatgtggtgcccacaggcgtcacccatgtcgctacttacatagaagcatggctgcgacgataatggccaaccgggtcgatacatcggagggaacaccaatgccatccacattgccacgcaacaagatccggatcagcgtagccacacaaccgaagttgtcccaaccactcaaggccacatctgaggtcgccatagctgtactgggcactttcccctatagccgaccgccatagccggcaacatcgaagccgtcatgaccacttgtcatcgcagccaaggccgtcaaagctgcctagacttgaagccacctcagccgcctcccttcatgtcagagctgtcctgctcgtcgtagccaacacaccacatcatctggtgaggaggagagatggggatgaaactgcacgaaaggtgccctgcaccgagaggggggcggaggtggggtttgacatgagagattggagggggagtgggagtgggagttttatacatgtatcctattgtaaaatccttgtacaaagacattaccatgaaaggagataggtcttaaatgttgattatgatctattgaagggcttaaccacttgtcactcttggatcttctactctagcggtgtggtgcatgcatggtagggtggaggttggcccaatgttgagatctttgactatcgcctgagcatagaaatgtaccacctggctccctacctggataccctcctccactagctagaagttgaagtccaagttgcggctaaagtaaccagcgaaaatgtattccatcgcagcctcagtcacaaagcgacactccttattttagtccatggtggccggaatcctctctaaagcctcggtcaccctcccgaacgacatggcatacttctcatccgtatcatcttgcgagaaaccaggttgtgctccaagtgcatcgagagcgacctaggcatgttggaaatatcctcaaaggataccctgagtagaggctcattcctgatgttggcagcctgggatggcagccaggcctcttgcccatcgttggtcagaccaaggacgactgcctccaccaaactttcttggagacgggtttccaaggatgccatgcatctcgcaagaccacaatctcccggtgcaaacccccacgagtgtgtttgcatgtttatcctctcatctccctaacttttgagtttgataattcctatcatggacacatctgaaaattaaactcaacttttaaaatgagcttagatattctagctagagtatataacttgcctgcaaatgtcttgcatactcttttattcctcgcatgataccttgtgcttgtgaacatatatcattaggaacacatgccatctaagtgattggtaaatgagaggtcacctgttaaaatgacccttgctttcttctgattgaaccctttggaattttataaaaaaaagatataattttaccttctcctaattaatgttttattcctaccaaagccatatgtcaatcttcattataaactttatacatatgctgcttatatcattttgagtttggtcaaatggttgagactcttgttagaaaatcaaatgctcatatgagaaggagacaaaatattctcgagcatgataaaaaaaaaagatatataaaatagctaggttctctaaataaagtatagggaggagaatcatacaaaaatgagtcatcattccatttttcccatccttgcacatacatattcctttccacacacatgtgcagaagcttgatcatggttgtatgattagtattcttcttgaatctactttttgactttacaaaatgtttgatgcaaatatgccattcttattctctaccctgagctctacataaagaaatgtaggataacaaaagacaacatcaattccttggtgaggattaaatacaatgagtgttatgagagagtcaattgaggagtaaaggtaaagttatatttttatgagcaagacgaaaaccccaaggtaattcaagtagaggaagtaaagacaaattgaatcaaggttgttctattcttcaaccacccaagatgatacggtagaaacttcaaaagttcacaggtacaagtatggcttggaatactttgtatgtttgcatcattacaggaagtctttgctctactaagttctattagctttacttaggaacgagtaaaggataagtgtgggggtgttgttgacggtcgttaagtgcccagtagtaggggaagaggtggcgggaccagtgaaggcctccaggatagaaatcgacatgtagtggacccgatgggctggcccaaaggcatctagaattggacgcccttgcacatgaaattttcagttagtgatcaaaaagaccatgaaggtcaataggtttttaacaataaaacttaccctgatgatggtgacctgctcacaagctcacaaggggcgcaacctaggtgatagtgtgacggtgtcgacggacatcggtgtcaatagcccatcccaatttacaaaaacatgagaaggggggatgttgtcactgttgtcgacgtgggtgcggtgtatgctgccaagtattttgtcttgcgcaagatactgagccaacgacgaagtgcgtttcctaggaccatgggtccgatcaatccgatgctctggagtgtgtcaacgactggaggtccttccacgaatcttgggtgatagcgtgcaaggtcaacaacttgaagcaccagggcacttcaccaaattaggtgcaaccaattttgatgcaagttctcccacttggagttgattggcgcagagatgtaccagtcaatggtattgtctcggagctggaagtagcaacacccaatcaacgacgagttcggtagccaccataggatgaagaactgttaaaacgtagccatgctctatgccactcccacaaacatctcaaacaagtatatgaatgtcatgaggatgacagtggagtttgatgtcaggtggagaagctggatcttgtagtaaactaggatcgccagcaagaattcaaaaacggggaaacaagccccactagaaggaacaatgagaagatgatgacctctttgggctggggatgcacgtggtagttgttgcggagctggactcggcaagaggggaggggggtgctatgttgcgtaactcctcaaccttgcagccacggcatcaagaggtaggaagatcggccgaattgattcgagacttaggttttagggagcttgtgaatttagggttttgcctatggggaacggaaggaagaagaaatctgtcttaggtatttgttggtaggaatccacaaatccctctgaaaaagtggtaacaatggcacgtggtgcgcaggatgcgacaccttgaccggatagcatgcactcacagtaactcctcgccttgatgtggtcctagggctactgtcagcctgttagccaaggtggtccctacttggccagatcacttcgtttcaaaggaagggcattacattgtgctgacagtgggccagcgctttcctaggaagggcattaacccatagccttgtgagagggtccacgtgcctccttgttgcacaaaccacggaaccacgataaggctgaaacagaggcggaactaagatttagatacggaaagggcctaatacgctacttactttggttaattacctaattagtgaggtgattatatgtgttaaaaaacttttggagggccactagtcgtgtccccttgtctccaccactaggtcgaaacactcgagaaccatggcgggggacaagagctacttggatatgacgacgtgcactacaagataattgagctattgccaccaaattattacaacaaaaaataattcgtagcaatatattatactattgcaatgataatttttcggtggcaaataattattttttattgcaacgatctacaatcgttgttttatttagtacttttgttgcaatagaaaatgagatattgccacaaaaaatcgtactgttgtaaaaaacatgttctatcgctacaatttttaattttgtggcaatttatatagtacatggtacatttcactattttttgttgccacgatcaacaaattcgttgcaataaaaaaattgtcatctcataatttaacttaattttttcattttgacacggattgagacaaattttatatggaaattataggtctcgacgagatctacaattttataggtgataactttttcatttgaaatcttttagatattcaaatctatgattcaaatctcagttagctaggcttaaatggaacaatatgcattttccaacagaattgatgcgtatgtgagttggtaaaggagagtgcgcgtgaaggataggtcttgggttcaaatcctagccaagacacaaaataaaaaaaagtagataaatagataggatgatagactaatatttgaactttgaatttggtacgtaaaactaatgctatatatggagtggtggcaataatttttagtacaacgatgtgaagtgttgcaatatgactttttgccacatccattccgtggcaacatctaaatttattaccacaaaatcaaaatcattgcaataacctattaccacgctgtttattaccacggctagcaacgattttataattgtggcaacatgcatctattgccacaattttagtattgatgccacgattttttttgtggcaacaaatgatttttctagtagtggtggcatgttcgtgggtgtgcgggaccagttggctggctacttgagaactaacattgggctctgtgagagatgagcctctcgaagtttggtctatctatgaacaaccacgtatgctgtgttttgagcatggctagttggatcaggtaggtcaccttcacccctcctcggagctagacgggtgttctacttcaaggagggaaaagaaccttcattccacgtggcttgccataggaaccctcgacatcctgggaagggctatggtggtgctcccaccagtctaaaaatggggtcgtgtcctatgggtcccacgtctccacagatgtggtgcaccggctactgagcctatccatcgcattaattatggattctatcaagcttttgcattgccatgttgtggcatgattatcatatctccaatgttaggtttttactatcgctttagaaatcacaatgactatgcaagtgggcataatgtgacgtctcatagatagttgcttcagccgctacataggcacatggcttgaaagacataaatgatgctcatgattgtaaacagtttaaaatatcttttagcagagagtacaaaagagaggtggtagggtataaaggcgtagctagaactctgtagaaaaagttgactctcatatctcatcaaaatctatgtattgctcgagagcttgtttacttgatgaaatagtaagaccgcatgactagaactattatccagtagaaggcccgaacatctataattatgtgttccctgaacagctgcgagcacaccaagatgccctagagcatctaccgggtcatggttccccacatctaccggggctcatccctccgacaccatccttccacctaaacacttcaatagcataataagaagagctttagcaggtgactccatcggatcaaggaagtgttcacggtcactcgacttgttaaatttaagaatgactacatgaatttagtgttcacggtcactcgacttgttaaatttaagaatgactacatgaatttagtttcatttggtgcatgcgttctacaaattcattatatcattgcagctgaacttttggagcaatatcttggattttgatggataccctcgttgctctgccaatgggtgatggtttgccttaacaccaaagaagaaatccataatcaaatttctcacgtttgtggttgaaatggaaaatatcaacttcaatagcgataggcccatttgctttggaagcatgcgcacgctgctctagcaaagagtgatgatttatattattagattctgcaggatttgcttttctatttatttgagcactatgagaaagaaatcaattggcatagtctaataaccatgcagttttttgaaatcaaattaaagggcaaagctggattccatttcttaatagaaatgaaacaaatatcttaaccctgcagtgtacaatttgctccaagtctacatcaacacattttacttatttacgccctgcttgggacagccccaaacatctaagttttgtttctgggttttcctgtctctagaaattcttgaagttagtgctactgaaggattaagattattattggaagaagctagctgttgcatgtgcacttggaagagagaggagaggaagaagaaagatgggtaagctgggaagggtaacggcgttattgtcgaaatgctatgttattgacggaacactaaatagaggaacgaaataagttttcaatactattgaagttcaaaatttttcatgttgcatatctgaactcgtgaatgtccagtgctatagaatcagccgtccgttttatataaagcgttacctcttaacgctcaataggaacatagtagatctttttatggaaagaattcttacgccgctgtcgacgcttcattccttcccgattagggatggcaatagggcgggggtggaggcgggttggataagaatgcccctggccctggtcttgaagtgaagaatggagcgaaatcaatctctgccccgtcccttctgggtccctgcacccccgagcgagcggtagcttccggcagccggagggagaggagagagagcgtggggaggtgggaacagccagcggcgagctacaaaatggagacatgcggtcggcggaacaccattctggcacctagcggcttgccggcatgccgacgtggtgtgacatatgctcgaaaatgagttgcaagacaaagaagcttaagcgagatggggagggaacgctgacacctgatgctgcgtagtttggggccacaacagtggtggctggatggatggattgagacaaggttagtctagcccttcgttatattggctctaattggcttgtttgtaatgggtcattttcatgtgatttaaattttgtggcctcataggatttcccaatggccacaggtgaaatgctgccctgtccccactcacccgtgggtagaaacctccgcctgtcctggccgcattggggcggatatcctttggggacatggccccaacgtggaaattgtcacccctctattcacaattccctcaccactagggtcgtccctcctccagtgcctctttgacgtcgacgaggcttatcaggcttctatgccctttccttccttcacttcacattctctgatatgctctttcttctttcccggctagacaccccacagtgcattgccttcccatctttagagccacgtactgctggatctaccacctcctatcttaacgagtcgacctctcaccccgacctaaccctgccgactattatatgcttcgttcatagcgctaccacatctaaccagaccaccggctcccagtatataacttgttcatgcatttaattaactttatcgcgggaaactgtttaacagctcgagtgaacgtctacccatttattgcatgtcatttaaatggtatgaaaaaaattgaaaaaaagaagaacaagatagatcaatatgtaatatattaatacacaaacatgcaagttaaaatttaacttctacaaattgtaacaaaaataataaacaaaactcaaattactatatgtatatttacaattaaatttgttatttttgttacaacttgtagaagctgaatttgaacttacatgtttgtagagtgatatactacatattaatctatgttgtcaatttttttgaaaatttttcgtaattaagtagttgacatgcaataaacggatggacatccactcgagctattagaatccatctccactctatcgcgtcaaaagcaaagcacagggatggaaaactagaatgaactcaaaatattgatgaaagtcgatccctcccagatcaaattgagcaggtgccatgcacaaggatcaacctaaccaatcaagcgccaagaagaacagcgaagcacgcggagacaactagcagcgaaagcaagtagagtgctgccacagccggcagagacatgccagccgccacccagaacgtcatcgtcaccgtgagcgccatggcgaacgaccacagcgccacctctgccaccgtgctaaacccgcggcaggcacccccagaggcgtcgtgctgccttctctcgcacgccgccacgccggacatgacgaagaagatgcagaacgactcggcgacgaggagcacgaacgtcctgacgtcgtgcaccagcaggtgcacggtgaagaggaggccgaccatgagaaccaccatccatagggcgcgcaccggcgtggcgacgagcgcccggtgactgcctgctcctggcttcctacacagcccatggagcggctctgccgacgacggcagcggcgacggcggcggtggcgccaactgctcctccaagtcgacgtcttccatgttttccaacccttctgtggcggtggtgcaacgacagtggcaatgttgatcggccatgatcatgcatgtacgtctagtcgtcacaattaggacgtacgggggtgttcatttcgtatatatgataaggttgacgatatatcatatatacacacacatactaatctatctttttgttgtcatcgttagttgctttcaacatattgtaactactccctccatcccctccatcccataatataagaaattttaaccttttgcttgcactgtttgaccactctgttaatgcggttttgaatccgatctatggttttaccaaatttggtcggtaacacactcgtcttattcaaataatttgtgcaaatataaaaaacgaaaaattgtgcttaaagtactttggataataaagtaaatcacaaataaaataaataataattctaaatttttttaataaaacgaatggccaaacagtgcaagaaaaaagtcaaaatacattatattataggattgagggagtagatgactaaagaagagacaataatttaatttgtagataacttccattattttccttccttacatggcgacgtacactatactaacatgcttacattcatgagtgtgcttttatcaacacctactcaaggggacggaaacttgcggtaaatccttcatcgtgctactaaaagcacacttatgtgtacgaaattgtgagcagcaggatttaaaatccttgtagtcaagtggatcgagtcatcgtctatccatgattaagaaacaactccaacattgtacctctagtgatttccagtagataattccactccggccgggtaggataagcagggcatggaatatgtacgtagtacgattgagcaagaacatcaaaagcgtcaaattcactaagacggaaataccaaggtccacagggaatttggactagcagatggtggcaccatttgaagacatttgtggagtagtcaagcactggcggactaaactatgtgctagtgttctccatcatattttgaaaagaagagcaaattaaagaacaagagaaagtacatactctaggcaatgcagaaagtcttggaaagcccctcaaaaaaaaaagaaaaaagaagaagaaagtcttggaaagagactagctagctatagacagctaagttaaggggtctgatcgggaccattggtaatatccttttttctgtacccatgccccgttggttttgaccaagtctaaccacgcaaattgctacatgttgaggtagtcaattggtccgtcatgtgtgccaaatactctctagatgaattgttacagtgcggcacaatgctcaataatgtaggaaacggatattgtggctggatgaggggatcttacactctgatgatcactgatatcactcatatatcagcttttctatcggtcaggtgacgggaaactcttttaattaaacactcggtggatctccatccatttcttatatgtcaattaattgattatgatttttttaaaaaagatgacaagatagattaatatataatatattactccacaaacacgcaaattcaaatttgattttctgaagaaaaatcacaaatttgactatgaatattgtagttagagtatttattatttttgttataacttgtataagttgaatttaaacttgtatgtttgtgatgcgatatattacatattaatctatcttttttttttgaatttttttcataatcattcagttgacatgcaaaaaaacgggtggttatccgcccgggagattagaatccatctccagcaagtgcctgaaatttgtccaaatctagtcatatgatcattggttattgtattgacatccaagggagaagttatgggaaaattcaccatcaattgcgacaacggcagagagtcccggtcttgatggtgggcaccattgaactcaagtgagcattgatggattaccattttgaggttgggtgatgatgggagaaaggtagaaggtggtgaggatatatggccggagtggcagaggaccggctttgggtggtacagatgaactggctgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggctcctgggcagggcaggcggcgcgcgtgcacgacgtacgcgtcgaatggtccgaaaaattggctcctcacccttgcgcagatgcagcctctttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgacttatttatggaataaattaaatcattatatgcccataatctcaacaatccaaaaaccttattataggcactgtgattttactatggctggttttgtcgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatattttatgacattgattgatgatgctactagattttgctatgtgtacttgttgaaaacgaaagacgaggctctagactattttaaaatttataaggcagaggttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaacattgaggtgataaatgaggttaaatcattcttgtctcaaaattttgatatgaaagatttgggagtagctgatgttattttaaacattaagctaattagaggtgagaatgggattacactcttgcagtctcattatgtggagaagatcttgaatcgctttggctacattgatagtaagccttctccaacaccttatgatcctagcttgtcgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggttgcgtgatctattaatggatctgcctgttgttgaaaaaccggtgccggctatccttatgaactgtgacaatcaaacggtaattgtcaaagtgaataattctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctctaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtccatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcctggcctggcctggcctgggcagggcaggcggcgcgcgtgcacgacgtacgcgtcgaatggtccgaaaaattggctcctcacccttgcgcagatgcagcctctttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgacttatttatggaataaattaaatcattatatgcccataatctcaacactggcagtgaggcataggcagtaccattggagccacaagaatggatgagggtggcgggggaaaggatgcagaatttgccagagctattgaaggaagggaaagcagctggaggcggtggagaggggtgaccaatgcacgcgttgggagcgagtactggcagtggtggttcgatgggaggaggaagtggattaagataaggttataaaatgctacacaatatatcttgttgtaatctagccatcaagaagtgactggtggattaggaaaatacattacagataatcatgtgttcgtaggctttgacactacaccaatggtggcccccgccatgagcccatttatccacatattgacatcacttagttttatcccttattcacatagatgtcgtaacattaatgttcaagatacttgctcttcctcaatcattccctatacaaatcgcatgagcatcgatattcgtacaagggtgaatagctaaagtggtccttcaagtttcatgcaaggatcagtttaatccttaatgtttcaatgtacccatattactacttcaagtttttattttaattcaaacttacactacaagaatctatttaatctgtgacgaaatttttgtgatcagagatcatcacggatatgcaactatagatacaaggcccgtaataccgtaacagtttatcaatttcatcataaaccgactcaaaatctgtggcgttatagaaatttcgttgcgatttacaaatataatattaaatacgtaaattttgtgaaaaatactactatcactttatcggatgaagaaatgatcattgatgttgataaatttttcagttgaaatcatttagtatttgaaaatgttgtttgaagtagtcataatttgaaattcaaattcaaattattgaaacagagtcatatagcaaaatgaccaaaacaaaagttgtagatattgataatttatacaattttgttgttgatgactttttcagttgaaatcatttatgatttgaaaatattgtttgaagttgtcaaaatttgaaattgaaattcaaattattgaaacagagtcatatagcaaaatgatcaaaacaaaagatgtacatattgatgatttatacaactttgttgttgatgactttttcagttgaaatcatttagtatttgaaaatgttgtttgaagttgtcataatttgaaattcaaatattatatatggagaaataaccaaaataaaattggtagatctcaataagttatacaactttgtttttgacaaccttttcacataagttcatttaatacgatttttttgtgttacttcacaatggtacaacaaaataaaaagaaaaaaaggttaaacagagatggaatgaaacgaggcctgttacgggccagcccttttgcacctccctcactgataagtccattttgcctccctcctttcaattaatttcaaaatattaaaacttcgaatcgaattttattatactaaatgaacttatatgaaaagtttgtcaaaaaaaaagttgtataacttattgatatctaactattttattttgattatttcttcatgtgagtttgattgacctatataaaatttgaatttcaaattatgacaacttcaaataacattttcaaatattaaatgatttcaactgacaaagtcatcaacaacaaagttgtacaactcatcaatatatacaacttttggtttggtcattttactatatgactctgtttcaataatttaaatttaaaattcaaattatgacaacttcaaacaacattttcaaatactaaagttttcaatacctgaccttgatggtaaccctagcgcgatgtcttgctacaaagtgtggagtcattcagaaaaactcctaatgttccgcctccctcatctgcttagaaaacatgtctcaacaggagctatggagccaacggtatttcacgtggctcaaccttgatggtaactagcaagacatttgctagttaaccacactaccacagtatatattgacttgggctaccatcaaggaggcgccgcaggaggtaggcgtggagccaacggtgaaggagcggctgcagagcatgctggagcgcatcgtgttgcagtcgcaggtgcaacgtggggatggggagctgctcgtccaggtgtagatgccgacgtggtggtggtggggtgcccacaacgaggggggtgggtggtgtcacgcctccaagttaaatcgtccgaagaaattgttttaattaagctagagctaaatccctaattaataaatgcattcaataattggaaatggcattgtgagatttttcttgggttccacatgtcacaattaattaacaggatttttagttaaattttcagagccctataaataattttaaccaattaaaattcattaaccgcaatattttaatcccatgaattcattttccattttccctccttttctttttccttctttttctttcttgggccatcggcctggtccatctcgcccggccacgctcggcctccttctttttgggccggcccgggcccctcccttcctccctagggtcgccgacaggtggggcccacctatcggtcgtccctaacctccagccgcccgcgcctaggccggcaaccgccgcgcccacttcgcgccaccccacgacgcccgcttcctccaccccactccgcgcctccccacgtcgccgcccacctcctccacctcttccgcacgcgtgcaagctcgcatagaggcaggattcatttttgaatcccctctctctcttcctccccaatcccccacgtcgctggcgaaatagggaggtttcccggccacgtccgccccctcccgcacctataaatcgctcccccgagccccctcaaccattttctactctcgccgtgctcgcccgtgcactctgccgctctccccatgccacacccgagctccgccgccgccgcaccgcgccatcgccaccgtcgcgctcaccgagtccacccgtacctcggccaccacttgcttgccgccgaacgacgccggagcttcgattccctcgcctcgccgatgagcccaccatttttgccccttttcggccggcaatgtaagccaccgtggttgtcctctccgccctaa

SEQ ID NO: 14005 - DNA, 13418 bp, Oryza sativa
cacggttgaccggccgccttgtgccgccgacccgtggggcccacctgtctccctccccccccccccgccgctgacgtcggtcctggggcaatattgtgcaataaatcgaataaggatttttctttatttgtaaaagcacatattatcttctaaaattcaaattcataagtaattcatccgagctccgtttaagtccattcaagtcttagtaaattcataaaaatccctagaatctattaaaaatggttttgtttcctgtttcagtagtcttatagcatgttttgcttgggtgctttgtttgtcgcgtagatttcggccgtttcgtcgatccacggtttctcgaagacgttgctgtggtctcataagtacgagagtaaggcaagtcatgtataacaattgatcatattgtacccaatttacaaatatcctgcatttctattaaatgttgtattcttttacaatgtcacgtgtgatgggtcctattactcagccatttattgtttaccttatgccattgataacttgggtatcaaaaatgactagatgttggtttaggaaaatgtttagtcatgcctagctcaactagtacacaaatggagatcacattattacatagactttgtctattagcatagctttagattggtaccaccacaaatggtgttagttaattaaaatacactaaatggtgtgctgtgggtgcatggttttgctggtcgcacccatggcagttaaggaccggttcacgggaaaccctaggagacttacacatatcttttctgcacactttgtcctcactcgtgtgcacccgggaagatgtcctcactcgtgtgcacccgggatgtaacgtcccgccttcccccaggccaggcccgcttacatctgatagctttcagaggtcatagactgccctcacagaccaacacatatcttttctgcacactttgtcctcactcatgtgcacccgggaagatgtcctcactcgtgtgcacccgggaagaatttcccggttggtcacccatcccaaattgctccaggccaagcacgcttaaccctggagttctttggagattggattccggaaaagaagttgcaacttgttgatatgagtattctattaatcctattaagccctaggccgggatgttacaccctcacccccttaagagagatcgacaccccagtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcccgccttcccccaggccgggcccgcttacatctgatagctttgataggtcatagactgccctcacagaccaacacatatcttttctgcacactttgtcctcactcgtgtgcacccgggaagaatttcccggtcggtcacccatcccaaattgctccaggccaagcacgcttaggccaagcacgcttaaccctggagttctttggagattggattccggaaaagaagttgcaacttgttgatatgagtattctattaatcctattaagccctaggccgggatgttacacttaccgtgtttaccacaagcggagtgggtaactgcttgatctgaagtatagctcgaccctttcctaggcatcggtggcgagggtgggcgtgatgtagttgggtcggccgggatatccggttgtccagctgccggattcaccgcggtgcacgaggggattgctcactgccttttgaggggtgggggtgaaaccttagcgtggtgtggatggttaggggagggttatgcggagggtcttgcacgatttccccctttgtagtatcatggtgatacttcggggcatggtgacatgtgtggaatcgtgtcttgtgggtacagttgtacacctctgacaagagtaaaactattcgaatagtcgtgcccgcggttatgggcgatcaaccagattcaccatgattagtctcacccctagattagcttaatgaactggtgtagttcaggtggttggttgggcctattgcaacgtggtgtagcgtaggacagtgattggttaatattgcttaatctactgcaattgttttactgttttcaactattgcttttaaatgctagctttatgcaaatgaacctttagcctcctttggttatatcctgcatcatacctccttttccggtatgacttgctaagtacagtgggtagtactcagtcttgctctcttttctcccacaccagagttgaagttcttccaagttggagctatcttagagaggttggtttcatcgctgccatcaaggattgcatgtggagtggagtcgccccactgctgaagtcaagcgtccaagtctagctcgttttatcttttccgctgcatttgtaatcttttgtatttttgtaagacgtagatctgtatgtcaacaattgtcgtttgtgtaccctggctggtcctggacagggatttaatacatattcagcttagaaattctggttcgtgaatttctgggtgtgacaggtggggaggagaagggcagtggggagggaatccggggtggccatgtgcagctcgtggcatatatggcgaggagaggacgtgatggattgggtgggaggctgaaaggtgatggagagatatgggaaaaaaagaaaaggggaagatgaaggaagaagaagaatatgatgcgtgggtcccacgtgcagatggaaaagaaaatagaaaacatgacgataggggcacggctctaattttgtaaaattttgatgatgtaattatgaatagataaattgtaatgacatttatctaaaatacaataattacaatggcaatggatcaaattaatcctttatataaccttctcgtttcattcccacaatccgaaacggcgccagaaatactgctcctacctttcctaccgtgcatgagccgtccccattccctagtccccacctataataccctgtgttctagagtatggttggacgaattcgatggcgaattcgattgaagggagaagaatgtaatgccctggattttgaattaatatatttcggggaatatttgaacaaacacgtaaaagttcaatttttaaaccgttgtttgaataggcgatcagaaaccatggatgcgcagagctcgtcgagtaatgcaaaatagatataagtttatagtaatcggagtccgaacgaaatagcggggtttgaaacgaagtgcgccgttagatctctttttagtctcttttataaaaaaaagagaaaaaaaaaaggaaaaaaaagagagcgctacagcagcagccctagccgccacacgcctgcgttcttgccgccgccgctatctttgcgccgccaccacggccatagccgggggtcgcagccgtcgccatccatcgcaaccggtggttcctttccgttttgcttcttcccggtgagttcctgcggctgctcctccttctatcgtttccctgttgttgccgatctgatggttggcgctgctgccgtgatccaaagctggctgctgctggtgttgctgctaggtctgccgttgtgtggtcagggaggagaaggttcaggggcacatgaagaggaggggaatagaagaaaaggggaaagataagcaaaaattggggattttctgggattccgcaaatttacctcaaatttgtttttctcctttgtaagggtaactcctcttgatccatggtagctcaaattttcacgtgggaatcgatcggtttgccggtcgggtgtttttagatgttgtttatgggctgacaatagtattttcgcatctggtattaaaccgtcgggattcaggttagttgttctaaataaagtttgtagtcaatgtcgatatgtttttaacgccactggtttcgctcgattccgataaacggtttaggagaaacagaaaaaacagtgcggctgcccggtctgaaaatagggacagtaattagtttttcttaatctgagaccaatagagggtgaatctgattttgtgcccaatatgaaagatgtagacaattttgcctagatgtccgaagttgtattatttgctagattccgttagacggtttgcgagttacacataaaacagtaagggaactactatagattatttaatacaaatcgataaaaagtttatatgttctaggttattgattttagtagatatcccttgtaactatcattagttggatatagtggtttatgcgtagttttgctccacaggtgtggagggttccaacgttggaggagttgagtcggagtatcgaaggacttaaggcaagtacaagacggacttatttgatggatgaacttagttgtttttttttgggttttacttgcataattattattcaattgcttgatattattgatcgtatggctctgatgttatgctacttattcatgtttcaatccatattcaaattcacgatgttattcgtgttttattatttcggatgtttctgtttacattattcaagaaccatgtgtaggcatgggagtgcaatttgtatctttattcatgatccttgagaagcgttgatcacgcttgctaggcttaccggtaatgctaagaggatgttcatacctgcccgggagggaagtactatcttttgacttctttgttttagaataaagtaaatccaacattttatattggtttcatattgcaataaatctgtgtatgttttactagttctatattgtacttgctgagtattctttactcttgtgtttaaattggtttttaggtacctaataatattgatcggcatgggatgggagtagcacccttggtctacacattattattgcacactattcaaatttagttttggactgtgattatgcttagcataagttttgcacagaacttgtaaaggtcatttaaagttctggtccttattttcacacggaatttatggagctaggatggtttgggattgtgtgggttatgttgtctttgagttatcttatatttgcctgccgaaatttctaaaaaacttgtgagttagtggttttgagtgtatttttgtgtggcactctaggtacgtggttacctggggtgttacaccaccacctacgcggtcgaccgccgcgccgtcgccgccgccattccgcccacgcctaccgagctgccgccgcctcacgtacgccaacaacgttgtcggccctatccccgtcaggcacgcacacgcaacgccgcccccttcttgtatactactcccttacactatgggacagagagagtatttgtcgattttgtttttctttttaaattttatttattttagcccatagctccgtcaaagacacggagaaaagaacaaacacgagagagaaggggggaaaagcagcaacaacaagaggaggaggcgccgcagccgagaccccagttccgattgatctccggttcccagatcggccaggtttgtccccacccccccccccccccccaattcgcctcctgaatccttcttcccccgcccggtttcatcctgatcggtgcccgtttcatgctgttccgtgcgcggattagggttcttgtgctaggatctttggggggtgggctggtgttgcttgatgggtttgttctttcgtgtgtgtgatctgccgtggaaggaaagaggaacagattcttctcctgaagaaacctttaccatttctgtctgtgggattggcccatgggagagggggggtgtagaatagttattctaggggatatatatttgtatgtataaatacatatatgtattacacacatataaattaaagcacttaacaatttatgtgcatatattaccaaaatatatatttacactaaactaaatgtgtacatatataaatatatacatatatttacaattccttcggaccctaaatataatgtttctatcatatgctcgctagctacgacttcgacgccggtgttatctcagaagaagaaggaccgacggtatgaattgtcgatccgtcgtagtagaattcaccctcgggatcaaggatttgttcgttgatgaatcccatcagttgttcttgaacagccgtgataaaatccacttcatcttcttccatttgaacccctagctcttcgtgcaatgcccaacacttatagctaggcatgaaccccgactcaaacaagtggaaatgaaaacttcttaatgcagaatactccttctggtttttgcacttattgcatggacaacagataaaacccttatgcttgttagcatcggccactctcaaaaaataatgcacgccatcaataaactctttcgaccgtcctgtgctgaaatatatcttacttgtatgggagctatggagttcaattatatctgctctagtcaatgtgagaaatacaaaacctgtcgtattaaacatttttgaatgactcctaatagaagataaatgtgtatggagttcgacaggttttctagtaaaagattcatatgctagcaccggacagatatatccatgaacccatgtcgaccaatggggttccaccacgcgcctatatataattgaggtcttctttccctttgcctcaactccacgcgaagggaaaaagtcttcctcctcacgaatcccacctcaatctccatttgcgccgatccctcgagaggcagctccgatggcgcccaaggcagagaagaagccggtggagaagaagcccaaggcggagaagcggctgtcggagtcgaaggcgtcgtccaaggagggcggcgccggcgacaagaaggggaggaagaaggcgaagaagagcgtcgagatctacatcttcaaggtcctgaagcaggtgcacccggacatcggcatctcctccaaggccatgtcgatcatgaactccttcatcaacgacatcttcgagaagctcgcgcaggaggccgcccacctcgcccgctacaacaagaagcccatcgccacctcccgcgagatctagacctccgtccgcctcgtcctccccggcgagctcgccaagcacgccgtctccgagggcaccaaggccgtcaccaagttcaccagcaactagccttatctctctagggtttcgccgccatatgcttctctccttccctttcccctctcgtttgctaggtggcagtagttgcaagcttgtgtttgctttgtaaattgtgcttgatcataatggacagcttggatttgatgtaatagacgtggagtgttatttactgtcggtggctgattcgcatctcgtgtttttttctctcttatgcgattgcaatttggggatctagggtttgaggcggggggctctgtacttctggagatgatgctgcgaggtgggcggctggctggcttggcctctcggatggttggagccaagcctttcagcacggagatatttgtgagcagtaagtaattaatttttcgccgcctacgtaatcttgtggtttgctgcaaaatgtttggatctgtgtgagcctgtgatgtgatgtcctgctgcttcacagtttcgcttgtcatgatctgtccgtcagaacttcatgagtgatgatctggtgtgattctggggggtgtggtggatgaaatgagcactaaatggtgtgtcctttagcccttctttttttctgaatatgatatggtggatgaaatgagcactaaatggtgtgtcctttagcccttctttttttctgaatatgatagatatggcatgccagaagttgttgaggcttggtgctttcagaatatgattccttttgattgcaacaaaggatcgatcagaggatgctttctagcgagttagggaattacagcctatagaaacatagctagctattgttatagagctcatagtgtttgatagatgcttatttattctcttggtgatagcggtacttagaagtccctaatctgttgagcttgtgagatgctcacctgttcacattggaccatgagtagaacacataaattgcctgtagatattctgctatctatgcaagctaaagccatgtaagttatgttcttagtggattgtccactcattctatcatgttttgatgttgattgcttgtacagcttaaacattcattcactcattttgggattttgtagggctatcattttacacaacagaggaagaacttaaaaatgtcttctcaccatttggcgctgttgaggaaggtaccagtcagtagtcacatgattttcagcacagggcaatttaaatccttgttgttgctcttaattggcattcaagtttcactctgctttatctaccttatcaagcgtagctcgattggtgagagacaaccaaactggaaggccaaagggatttggttttgttaaatattcttctcaagcagacgcagagaaagctgttaaggcaatggatggacgggtatttgctctgctcatcccctatcttgcctatgacccgcaatttacctttctgatgttagttttgattcttctttatctgagaagagttctgaaaatctgtatatagtactttctacctggttttcaattggaattgaaggtacatgcacaccacacacacatttctagcttaattacttgaagcctagagtggtttattgtgattcatgataacacctaccctcgtagattgagtgggcctcatttgtgatgttatctctgatctacttcagatactaaggggataaaaaaaatccactgatacaaacaactaaattagatgaggcacttacctggacaactgaatgaaaaggacaagttgactgcagaactgatctctccgctgattagactctttacaaacaactacattagctgaggcacttacctggagtactgaatgaaaaggacaatttgcctgcagaactgatgtacctaatttcaagatataatgtgttgcatgtttgtaatcttggcataactgcatggtgtggaacagaactaatttttgtagttctatgagattgagacactaagtagagatttatagtattttacgttcaacccagattgagaacttggctagtttactgtaaaaatcatgtgaagcaaactttttgctgcctttttctgtaaaaccatgtggaccaaactgtggggtttatttccttctgtgaggaacattgtgttgcttatatagttctttttattctgttaatcccaaagaaaatatcttctagattggccataaactttgagattagatatcatcttgctagcatgttggccctccaccattttgtcactgtagaatgttgtttttattttgggattgtgacgtgtgagtattcattcagatctttcttcatgtggaaatgattcgtattcagcatagatttatactaaaccagccttcttatttcccctgattggtctgttttattgtaagactaaactttcaataaatcttttctttggcagatcatacgtggaagactaatttttgtggaaattgcaaaagaataaaactgcatagggcatagtctatcaccatcgttgctgaactggagcagttttcctgccttaaagcgtactcgtacatgactacatggctaatctggcttagttccaacaagacctatgagcacttctcccggcctgaatgcgtacttttgtgacttctgttgagccaagtattggtttgcgaacaacattgtttgttttttaaagacaaagaaagctttcaaacaggaaaattgttgttggaaggttaagttgaatttatgaacccgagctggaaggttatatatgcgtagaatgctggatgacccatatacccgcccctgctccactagctagtgcttccaccgttttcttctgtgtcatctataaagcgatattgtttgaatttgatctgaaaagtattaaagccgttatgtatatccgatgaactggttttggatggctttgtgccctacgtcagagtaacgtgatcattgacatgcggacctgtgaacacattacctaagaggttatagttccatgggcatggctaaagttggattatctcactttagttcaattaaatcaattagaatgcgctgattaacctaggataggtaaagggttcctttctatgtaggaattttgcagtaattagtttaattccttgtataaaattcctccagtccaaatatggggacgattccaattgtgctatgatttttttaaaaaatattttaataaaataaaaagaccaacaaaaattaaaaaaatcttgtgctactgggttgccttggcctgaggatgtaccggaagtttattgttttacaggagcagacaaccatttcttcaaaattaaattgtactagcagatataacattataatccatcattagttcactacatgaaaaattaagcgtgctctgtgagatatggaaataggtacaaaggttatatagttgatcaaaattaaatacccttgacggaatgagtgtaacattgtggtggaactaattcaaattcaacaaatgtactcaaatttacaactaattattcttttaacgatagatgatgtactcatgatgactgttcatagagttaggatgtgtatgtgcgtattcgtagagtgagtttgcatattttaagcgcctatgttgtactatgttttctaaaaaataaatgtccttgcttaaaaaggagggtacacaaacaagaccctattacaaagatggatctttcaaatatattagtatttcattcgtttcaaaatataacaacttaggtgtacgtttatccttaaatataataactttttttcaaccaatcacaaccttccacctcttagtatcctcacctattttctattctcaacaaatcacaatcatcacatttaattttacccgtgttcaatacaaaaatggaggtagtaacataaatacagagaaggtctattcataaggacgtggatcttgacccaaaataagtccatagcggaattgaggaccaagtttatttgcctgttggcccaaaaatatacagctcaagacacaattgaggggccaagtagctccaaacttccatggatttagcccgcccaatgccataggaaatcccaagacaaattttcatttcgtacccggtttcccggcattccccctccactaattcaaaccaaagcgccagattgcctcccaaaatgcaaattccaaccaatcacttcaacatccagcaaaatcacagatgctgagatacccatacttaggcattcggtgattttcattccaaacaccaaatttttgaggcggcactaagcccaacacaccaccaacaaatttgggtgattttaagttacccgcccaacccaagcaaccaaattcgaacgatcttataagatcggatctgacaattgagaaaattcagatctccacagccaaagcataaggagcaagaatggaaacatctctgaagaaaaatttaacatatcttagatttatcttcttgaacagacacaaggttcaacgacaccactatagattagatcaacagcatcagcagactactaacagacacacatcccgtccaatctactccagctaaacaagcaaagcgaggcgccgacgtctaggccttcttgggggacttgccggccgccttcttgggcgacttggcctccttgccggcggcggcggccttctccgccgtcttcttgggcagcagcaccgggttgatgttgggcagcacgcctccgtgcgcgatggtcacgccggccagcagcttgccgagctcctcgtcgttcctgatcgccagcagcacgtggcgcgggatgatcctgttcttcttgttgtccctggccgcgttcccggcgagctccagcacctaagcaatcgaacagagagggcaccaccagatcagcacacagatcgaaacctgcactgcagatgaagttgacgacaaagtgggggcgtgggcgtgggcgagcgttattacctcgtcggcgaggtactcgagaacggcggcgaggtagacgggggcgccggtcccgatgcgctgcgcgtagcggcccttcttgaggtagcggccgatacggccgacggggaactggagcccggccttgacggagcgcgacaccgccttcttcctcggcccaccggccttcctcccggcggctcccttcttcagcttcccacccgctccggctccggcggcgtccatggctagtctagctaagctggttcctgctgcgctcgaaggcgtggaggattgtttttctttttttttccttttcttgggtcgtcgaatgcgagtgcgcgatggagacgaggccggtggggtggcgtatttaaacggttgggggaaggggagggtggtgggcccgtcgatccgtgggaggggagatgtacggtcggatcgttggggggatgaactgatctctctgctgattagactctttacaaacaactgcattagctggagtacttaggccttaggccctgtttagtcccataatttttttccaaaaaacatcgcatcgaatcattgaacacatatatggagcattaaatatagataaaatgaaaaactaattgcatggttagaggagaaattgcgagacgaatcttttgagcctaattagtccataattagccataagtgttacagtaaccctcatgtactaatgacggattaattaggctcaaaagattcgtctcgcggttttcaggcaagttatgaaattagttttttcattcgtgtccaaaaaccccttcagacatccggtcgaacgttcgatgtaacacctaaaaaattttatttcgcgaactaaacaaggcctgaatgaaaaggacaatttgcctgcagaactgatgtacctaatttcaagatacaatgtgttgcattgcatgtttgtaatcttggcataactgcatggtgtggaacagaactaattttgattttttttattttgaatttttttattaaaatatttataaaactaattttgtgtttgaaaattttacaaaactagtcgcccgccgcccttggagagggcgatttttgtggcgtggcacacggccgttagctaagtccttacggccggttatagggggcctgccattttgcaggcggcccccttgccgtccttacggagcgcggttttacactgttcgggagccgccggcctagtttttttgcaggcgccccccttgccgcccttagggagggcgatttttcccctcccgagtataaaacctcttccccctctgagaattttcattatattcactcaaaatccaaaaaaaaaagagaatgagggaggggtgagggggaggagaaggggagcggcgaagccctgctggtttgctgacttcatcacaggtaatacattcatttgaaatgtgtttccattttgttgttgcattttagtttttt

SEQ ID NO: 14006 - DNA, 669 bp, Oryza sativa
caatttgtaactgaggatgtacatataaactcagattctttgctttacttgtggatggagtcaaagatgcagtggtgagaggaagctggaggcaggtagcgagcaaagaactgatgcttaagcaatgtgtggtctgatactctgatgtgttgttcggtaaaaaaatagaatgtaaacagtcaattatacctcactatgtttcttttcagataataacagtatcatataaactccagtgtaaagttgacattgcccaaaatgcaggtaagattttttttttaaaaaaaaaagtacagagagaacacttccttttcagctatcaggcagttgttgatggaagtgcagatttcgtggggtctgcttctgattctgatcttgctcactcacaacaagctttctttccatctctgcatgtaagacatcgattcagagatcaaattccactaggtgttcatggaactgcacgccactggttcaaaaagacacagaaatccagaaaaaagatctcaccaaacatgcacgaagcaccgaagcagaggtgaccagctatacatctcgggctctcggctctcccgtttcatgggccggaaagcgattcgacttgcgtgcggcccattttacttgggccggatcatggcccatctttgttaggtgaggcccatgatattg

SEQ ID NO: 14007 - DNA, 19063 bp, Oryza sativa
  unsure (1)..(19063): unsure at all n locations
aaggcaaccttagatttggtcctgatggtgttgatctgtcagattttgtaatgacatcgaagggcatcgataggcttgccgagagatcatttcagtcaatttataattggttgatgcgaggatttagaatagactcagaagtctacacaatgtcagtatcggttgtagtgagtcgtgcaacggaaggttatttttaggaactcatcccgatgcatagcactgttgcttggaaacggtatctggagatggcttttgaaaggtcatggccctggttatttttgtgtcggtgcatgaaaatgatagaaatattgcaatggaaactgaagatgtcgagggtccaagccatgagggggattttgttgaaccatcaggggaagatgagggaatgacacaggggtggagcaggccatgggcgtggcggatgagggggagagaaacaatacaatcgttgatgaaatggagagggaagattcggataacgagcaagcggagggtgatgcatcatccgacgaggaaggtgatgtaatgcccactgattggacaaacgaggacttctcgggacttgttatctcagaggagcatcatgtaccctgcgaatacaaggataacaaggtaattgagggtgctacatatgctcataaggaggatatgaaggaggcagtgaagcattgggcgatctcattgatgagagagtttaggcagtgaaacattggtgcggtctcattgacgaatgtcaggtacaaattgcaagcttagactggaggaacaatccattatggttacctaaatggtcagagtgtccaaagtgtggttgtagagatcgctgccaggtggctacctcgtttgcagaacaaacaattggtaggagatactttgtctgccccaatgtagacgacgatttcgttgtacgtataacaaattccaaatttaactagcatctgcttattattactatcatatctgactaactatgtttatttcttagggcaatccaaggaggtgcacattcactttatggatcgacaatgtcaatccaacatatgatggccaaaagataactgagtctgaaacataggtagaataccaacgggagaaggagcatcaaaatgcaatacatgttgaacagcgcagaaggggtcggtagataagctcaggctcgatttgtcaggaccgacaaatttgtatcttttatccatgctatcttgtcattataatgtttcattattatggtgtgttgttatatgcgtcacgaattacaaattaatgggctctatcgttccgatttccaaagtttctttgacgccacgatacgttgtatccttataatttataaatatctgcttatatttttataactttcaccttcaattgtgtacatgattcaacatacgtaagaattatacgtaacttacaatttataggtaacaaaccccctcattgccctccaatctatatgaaaaattaaattattgaaattttataaaaatgtacgtactttgttcgtttcaaaactatactttacctaattttaagtgctacaaaattaggtctatgtaaaacacctattttgtaaaattttaagtgcaaaatagttagatttatgtaatgaataatttgaaactattcctcctatttcgaaacgatgatttacgtagtttataaagtaacaattaattattttgatgtaaaaataccccttgttgggctccaaactgcgaaaacaacgtaccattcaattgtaataatgtttttcttgtttcacagttttttaagtgatgatttactaaattttctaaataaacagagctaaacacctggggctgcccttgtcccctagcacagtgaaaaatcgccctccctaagggcagcaagggggccgcctgcaaaattccaggccgtcctcgccggcctttagcaggcggccccccgaacagtgtaaaaccgccctccctaagggcggcaagggggccgccctcgtcgccctgttgcaggcggcccccgaacagtgtaaaaccgccctccctaaggacggcaagggggccgcctgcaaaatggcaggccccctatagctagccgttaggaatgagctaactgtcgtgcgccacgtcacaaaaatggccctttgggagggccccaagggcagcgggcgactagttttgtaaaattttcaaacacaaaattagttttgtaaatattttaataaaaaatttaaaaataaaaaaaattcactaatttttgtagttctatgagatcgagacactaaggccccatttgaatcctctgtaaagagagcatatagttttggatattcatgacacgcttttcaaattactaaagggtgtgtttcgtgcgaaaactttctatatgaaagttgttctaaaatattatattaatccatttttcaagtttgtaataagtataactcaaataatcacacgttattaccatctcgttttgcgtgaaacacttaatcttcatcttcatcttcagaagattcaaacaccatctaagtagggatttatattattttatgttcaacccagatcgagaacttggctagtttactgtaaaaatcatgtgaagcaaactttttgctgcctttttctgtaaaaccatgtggacctagagatggcaatggggacccgatcaccgatcccccgtggtgaattcacacattagaggatggggatggttgatatctaccctccatggggaatctaatgttttacaaaattgtaataagctcacctaggataaaccactatggtatctgttattaggtttgaatgtgacatggtatgagaaattggattgaatttggtgggctcaaatttaatgggcctgtttagtgggctttgatctaatagttggttaacaaaatgggccagttctaaaaaaataatgggccactatgaaataattaatggaccaatgtaaaaatttaatggcctgtaaaaaaaataatgggccattaaaaaaataataggtcgtttaaaaatatttgctgacgttatctaccacgtcatcagtgacacgtcatcacacgtgttaatgaccacgtcacctgccatgttggccgccacgtggcaaccatctgtgacgtttaattttgtcacaaaagttgggcatgggctgaactacatgagcccaaaagcgttttatgacagttaaaaatgtcatagattgtgctgatccgtgacgatttcggagaaaacgtcggcagatttaatctgtgacgctcaatagatgacgataagtagaatcgtcacagcaaatttatgtgagatttttcagtgatnaatgcgaatttttttcatcatagattaaatagattattgtagtgttatccttgaacacacataaccaacaactttcctgataaatgacacttatgccccccattcacatatatatgaaaaaaattgtatgcaatgaattctttttatagataaaataaattatgtacttccaagtgtatacaatagccattaggcttaattttcatgtgcacatgttgaaataatgggaagtacatatgtaatgttgtttgttcattttggttttttttttctagtctatagctgtatacaattaagggcaaaagggacattttctaacataattgttgactaaaaatagccatatggcatattaagtgggcccaaggatgattttaggccaaaacaaatatttagaggaactatgtggacaaaatgaaacctgaaggaccaaattgagccttcggtgaaacttgagggattaaattagctattcacccttcctacaatgcatttccttttaggttgtatcagattgtgtagagcaagcccatgcctatggataaaaggctttatgggacttcataaccagtacgttctcttgtctggattaaaaaaagcctgactattttcgatctatgtcttattggcgaagtgacggtcataaaaagaaatatcttcttgtcaaatgggacatattgtgcgggcctattgactagagggtttagggattcatgatctggatattaaaaacataacctactaaaacagtagctattcaggggggtggttcaaaacggttagggcccaaatttaaaaatatagcngttgttttgagtaatgcgcataattaactatggacataggtatttatgttcacaacccgcttgcgagttcaatgaaaagcaggggactcacattttttggttaccctagtgaaggtggcaaggcatgtcctttcagttcgaatcctttgtaattaaggatggcccttatatttggttacaggacgataaatggttggaacatatctataaatgaaaatagtatcagtgtccctacaaataatgctaggcataaataggcgactgttgcagatgtcatatcgaatggatattccattttttttcttgaagaagggatctaattagatcaaattagtagcatggactaacttattaccgtattaccgatattcatctaattcatgagcaagatgagtttcgatagaacttgacttcttatagacagttcattgtgaagtatcattcccttgcactactccataatgacatcccaggtataaatagacgcatctggaaactaaaagtgcctctgaaggtaaagattttccttcggtatctttgttgtggagttgtgttaactaagaacaatatatctaaacgtaattggcaaggcaatcaaattttttgttttcgtcacattaaggaggcaattaaacacgtcatatggtttctacaaaaaagttattccttcgcctatgcaggtcatcacaggatatggttattgtggcgtgtctacgcttggagcatgtgataagggtgtgttttacctagggacatgggtgacgatctagttctagaattgatggtccttaatgcttcttgtacttgttttcttcgaaattggttggtgtatgttttggttatgtgcatcctagttgtgcaaaggctaggagtgttctcaaaactgttgtatgatcttgttgtagttgactgggttgtataaagggccaattgcatatttgccactggtttgaaccggtattgtgaatttaccattatagaagatgtaattgcatatttgccatcaaaaacggttagaacctatcatatttgccactggattgacagattagactaacaccgttagaaggttggttttcagaaaaattaggacaaggatacccctaccccgaaattgcaagattgacatcatatttgccataaaaagcttacatattggtttgtcctccaaaaatgatgtggccaaatgagattcaactctaaccataattgtcaagaagccggaccattgattcctacaacataagaagaaaattgatgaatgttctagtagatcggtggagtatctaccgttccatggtgctcctgctgtttccttgcagctcctggcgcgtgttgctgctgctgctggtcgccgtcggcagctgctactcccttgccgccgccgcccctgcagcctgatgctgctgccacccccttgccgccgctgttccccagccaccgccgccactgccccagccgcatgatgctgttgctacccctaccgctgccatccccagccaccgccgctactgccccacggctgagctcctccattgtcatctcctattccagtgtgacccattttttggttgatttgctcttgatgaggggaaagtgacgaggggatttgggattagagagagaggagctgattcttcacggtggagtgaagagcactgatcgaaagagatgggcagtgaggattaacactggctaagggcaaaacggtcttatcatgtttttttcttttttatgaattatcttcatctgcttatttgcactaaatcaaacgatagtggcaaactgcatcaacctaaaccaaaaccagtggcaaatttacagttcgtgtttttaatggctattttgagttagagggtgaaagtagtggtatatttgcaatttctccttgtataaaagcttttattattaaaaaaaaatagctgcttccaagaaatttttataggttggagggaattggactctggtgggtgctcaggagtggcaaaactgaggtagcctgcaaacactctcccacatcctttccaagcatggaatctatggcaagaggtggggaatggtactgttaattttatgtttcaataattaaaatttaatgttaaatgagtgttacaagaatgttttaattgggatttgactattttttatatttttaacttttgatcttacaacccttttttatgtttcaatagttgaaacctcaatatttactacagggttgtcccatcgaattcgggggccttgtgcaaattattgacaaaatactaaacatagttgatgaaataaaacaataacaatttatgagttttatcttcttttcttgctttgttcttacacttttcatagcctaagtcataatttatactagagttaattgcacaatgggccacttatgtttaccaaggttgcatcttggactagggagaagaaaatattttcactttggactagataagtttgtaaaatgagtcactttgtaccacttccctctccagctctctcatcactttcttctctaccatataggaaacttggtgagctcatgaaggcagcagcatgcggctcctcaaatcctcagtgcatcatatcagcatgagcaggaatgcaggattcaactactaccaatcaatgatctgctagctaggtgctcgcttcttacgttgattttgggaactgggaaaatgggagatcctcgagcttcacgtcaggtagagggcatggctcagaggagatgctccttggcgatgagcagtaggcgctcgctatagcctccacaaattgggggcattcaccggtccagttcaccaaagcatcaactatgcttgctccaatgctccacgatacgcagggcatggcagaatgtgtaggtcaagcagagcgcatacggcaccaacggaaatcgagctcgagcagcaatacatggacagcggcatactagtggaggcctgcattcttgaacattttttttgtgcgtatatccttctcatctccttcatccgttgagtccgctctcatctcggcttcctcatcaaccacaagtagctggccgtgattagggaggagaggagaggaagaacactatttgatgctgacgtatgggccactgattaaaaatgccaagtttggtaataaaacctagtcaaaggtgaaaagatctgctgattgctgctccaatttgcaacttgggtaataaaacctgccataaagtgcaattcactctttatactaacaattcgcagatgtaaacggcaaaatttggcaattattgttagttaaggccgagtcaaagatggaattcacgccatgattttagttgatttggttggcaagtttatctgggtttttgtaaattacttccgtgataaggaaggtttttaagtttctatttttatagatagatttctgggctgatggagtcgtgttagaatcagacttagaagatttatcttttaggttaaccgatcagagtcgtgtttgagtcggagttgtaatagtattttccttgcttagaggtacagtcctgagtcgatccgattgtagtggagtcggactttctatagcctattggtataaatatgtacacccagggtctttgtaaaacaacagttcaatatacaaatttcgatgcatcaccaaccctagttttactttcgacgagttcttgtttcgagtttaggctgcatcggtttcaatctctggcaagaaagtaagtttttgtcaactttgcttgtaacagcggaattagtactttctcagttaagtccggcatactagttaaggttcgactctttgtttgatcgtttttgcaatcatagtcagggtttttatatcaaacactatcaaaagtatcgatcgacccgtttaaatatactaaacttgttattaatctagaaccatcttggttgagtccaatcttctaggttataacatattaactatatttactcaaactgataggtattcaatatagttttatcggagttttagctgataagttatttgcttatcataatttaatctactgtatcggctaatacatagattttgtcagaataggtcaagctgctgccttcattactttccctacaatgtcttagttaggtccgatctatctagattgtgattaataaatttagattgctaatgattacgatttaaactatcatagccaatattagtttatctactttgcgagtaataataagtttcaattaaatatttaagtaaattgacctacatctggaaattatatatttgataaatctaggttttattattcttcgatcttgatgcaaaattccgttgttcacaataaccgcccttccaatagttccgattgtcattggcacactataaaaggagttcatacacacttcaacttgcacaacaaaatagagtgcaactcacttttagacattactttagtatgttggctgttggagtacctccgagaattttatggaggagtgccggactgtcggcattcttcaaattgaattccggagaaagtcggcattcttcaaatggagttctggagaaagccggtactgttggccttcttctctcaattgtatttcagcggatgcttccttctataaggtaagtattcgagtttctttatgttctttagttagtttatttaagtgagatatattctcatcgatgttggttcatcgcttagtgtgaaactatgttctagtactaggactttagataaagaagggaagttattgcgcaaggttagagtagtaattaataacataggtgtggtgtctaggttagaaattttctttgtttgttgtgtgctccacgaaaagtgaggtagaatgcaagtggtgacagccttgtccatcccttgtatccctcaatgtttgggtacatcatagagctcaagaccggactcagcctggcagaccaggggaggaccggtgcccgaagcattcgatagagttttacctttaatttaagtagctaattaaaagatagaggaattatctctacccaatctatcatcagttgttgtccttggattgaattttgttcgataccattggaatactctaaggggaagtactatagtggtatccgtgaatttgcggatttatctgtgaacataagaaataccaacataaataagccaagaaatccaaaacagaaactacaattcaatacattaataagtcctagttagcatcatggttcgatcaacaccgctatcagctagtgtgaccaagtcattaggacaactaagactatagatataacccgggatgttacacaaaaccaaccgactagtagaggtgggcagaaaaagaccgaaccgaaaagaccgagaccgagaccgagaaattcggtcatcaattcggtcctcggtagtgatagaccgaattttgttcgatcaattcggttagtctcctcggttaaccgaatcaaaaagaccgaattatccaaaaaaaaaagtctaaatgcaatctacaatccactatgtttaataggattaaactcttattttcacatccctacttcttctatgcatgcaacctaataagagtttttactcataagtgcttacgaatttttttgtgatttttttgttgaaaatttctattatttctttgcatatatgaaaatgttgttgaatttcgatcaagaccgagaccgagaccgaaaagaccttgaccgaatttgtcggtcctaacattttttgtgctgaaattcggtctttacttttcaaagaccgaaaagactgaaagaccgaagaccgagaccgaaattttcatttagaccgaatgaccacccctaccgactaggggtagaccctgttagaatcaagggttaattggatctatgccattacaaatatgttgatttaaaaaaaataccattactattcaagaaatctgttgtgtgccaataaattgttctaaaatttgaagttaattctgtaaaccagagacttaatattgggatcgaaaaagtgaaagaatcttatagacaacctatcattcttgtagaatatatagctttccaattaaaaaaatagagtttcattccgaaaggcaatgaaaaaaggcattgaattaactaaaaaaatggatataaagggagtaaaagtaaaaattgcaggccgtctcgcgggaaaagaaattgcgcgtgccgaatgcatcaaaaaaggtagacttcccctccaaacaattcgtgctaaaattgattattgctgctattcaattcgaactatctatggagtattaggagttaaaatttggatattcgtagacgaagaataaccaaccctgtcttcccattatgttcagtaatagaataaaaaatgacaagagcctcattttccctaaaatccctaaaaaaagaagaaattatatctctttctataagatttaatgaaaattaagaaatcttttaataaaattgctatgcgtgtggggggagaaagcacatgggccgacaagctaaggggaaagcgttcatgccctatgtgtcatgcttaaggaacccttgacttgaagggtttgtttagatatgggataagaagagtaagatcgggataggaaaatgggtaaaggtttacaatgaaatgaggatggataatggatggctaggaaaatcatttgtctaacccatttgccaaaaaggcccaaagtagacagaatggtcaaggctgaaatggctgccccactgtgagaccctcacagttttcaaggcccattgaaaaacaataaatcactatctttattgcttatttatcttttatttcacaataaacaataacaatcaggtagaatgttgccatttgtgcagccaaaactcatccaaatatatatatccatggtaaacccacgaacaaaagctaatagttcttcccattgttagactatagagaatgtaatttagttggtggcttaatcattttccatgcagtttagtgagcagtagtgagattgaacacctgccaaacaaagaaaaaccaaagtgcaattagaacatggaagggaattcaaatatatccaacatattcactccacagagagcctgcatacctactaaagattaaacaatataagaaacattcataccttgtgcggtttttgcaatttctgaatattactattctgtcctaaaatacaacaacttttagctatgaatccatattcatagctagaaatatggtacagagggagtattacaaacggattactatcctagctaccattaaagaaaaacaaattccaagtactagcgttgcgtgtaaacttgtttgagtgaaatacctgtaaaattctgctacaagctgaaatccatttacacagaatcatgacatgaatgaaagaaggggagaacacataagctcactgactaggaaagagagagttcactgggtacgccccatttatctgcattgtttaaattaaaaagaaaaggtaaaatgttagcattacacgcctaaagataaaacatgaagaaaatctacttcctttgtttcgttgttgtgtttcacagtataagacattttaggttttgaatagattcatatttcatatatctatctaatttatattggatgttaataaatctaaacgagatgagagcccaacgcgttttataatgcgaaatagagtaataaacagagccacgcgtagttccaacaaatgatcctcaaattaaggtaaataagtcttcaaatgaactaattgtcatcatgttctaaacagtactagtaaaataacctttactggtaaattcagttgcacatgaagggcagtaactaaatactccattcgtcccattttaaacacaaccatatgaagggcagtaactaaatactccattcgtcccattttaaacacaaccatgagtttctatgttcaactttgattgttcgtcatatttatttttttttgaaaacattaaaaaacataagtcacgcataaaatactattcatattttctcttctaataacaataaaaatactaatcataaaaaaaattaaataaaacgaatgatcaaagttagacacataaactcatggctatgcttaaaacggacgtaggtagtaagtataatttcatgttgccagtacatggtaaccatatggtaattcaaacttgctttgctatcttatgaatgaattaataaaagatcaaattaatttaaacccatgctgtcttatgaatgatatagtcgaaaaacattatgaggctgcaaaaaattgtaaatgcttttatagttttatgattctcgacggggttgtttagatctcacgtgctgttaattatagttcacttaatcttgttttagataaattattatttgattattgtaccaatcttctggataggaaagcaaatttgctctaaactggaaatcgcgtttttatcacaaagacaccagagtttctacaaaagctggtttcattatgctatgcgcgcacttaaaccacccagccaaaaagtgagatctaaaataacacgatactccttccgtacaacttttaacgcttaattacaataatatcaatattacgtatgttatattagtagattcgtattttaaaatatttttatgtgatattatttttacagttattaataatataatatgaaataaattaataatcaaaatatgtcattgaataccgtgtattaaaaaatacaggctttataatttaggacagagagagtaataagctagaactggttttgttttttggaaaaattgaattaaacttattttactaaaacctgcttttatttcactcattcaaaccatcacgagttaaatctatttcaggcttgacccgtgcgcttatcgtgtttcacaaaacatatcgaatccgtggcaacctgttcttgttcaaaatccctatagaattcttccacaaattctttgttcaaaataggcatgtttgaaagaaactagctgtttgtgtccttttgacgttactaaccatgacagttgatgttaagccctctccagttagttatgttttgtcaatcaaatccggtaatcacccaaattagctcaccaagtgtttgtttaaattatacaggaacatatcctttacacacaaacttcccatgcacactccgtacacaccaactagcaaatgtcacgaaaaattctacaaaaaattgtatacatatttcgaatagtattacaattacatgtgaaattttatcttcaaattcattatattttagccataataaaaaagacaaaattctgacagacttttacccttaaaactgtcagattttttacttttttgttacggctaaaatataatgaatttaaatataagacttttagatatgtgtaatactaataggagtaaatgttcaattttgtgtagaattttttatggcatttgctagttagggtctgtttgttatagtttcaactcctaaatttagcttcagaagttgggtctggagtggagttgtggagctacctatatccagctccataactctagttcattttgtgagagagctccacccagctctactatcagttttggtggagctgaaactgtttggctaaactccagctccaggaggggtggagctaaagctagagttgtgccaaacaggcccttagtgtgcacgggaagcttatgcgcataggatatgttcccaagttaaactggcataaaagaagacatttctagtagtgataagttcatttaaccccctcaacttttcactctatataaaatacacccttagactttaaaatcaggtatcgagcacacgacccccaccagcaattttggcaacggtttgggaacagtggggcgcactagtaaaaaaaaactaaaagtagtgaggcccacgtgaatggacatctcttttttctctatctccgtatttgttgcaaaaatccatagttgctcgtgcgtttcacccaacagacactatcttgtgcaaacgataacctctaattactctatttaaacaatctggagctcaattaggcatgtcgtttgattcaagagtatctgtatacaattctcgagcaagcaaatagtcagaacaaatatgaaaatgttagaaaataggaatgaatacattttttctattatgttaaaatacaaaagcaagaatagaaaatttctagaaaagcattggtacagaagggagcgtaaagaggcaaacacaatttaccacaaatgcctcctcggaaaaaatacaattaagcgaatctctcgtttctgtgagaacatcactaagagcaagtttgtttaatattagagctaactaagtagtattaaagctaacatatactttctccgtttcacaatgtaagtcattctaacatttcctacattcatattgagtttcacaatgtaagtcattttagcattttccacattcatattgatattaatgaatctagatagctataaagttgtctctaataaagttgtctctaattttcctctttctctcacttatgtaactaatgcatttagcttgtagcatatctcgagacctaacacttcatttttcttgttctctcttattcacatataagcttatagttagacttgctctaaatgaagcaacaaggcaacaggtgcataaaaggttgcatcacccaaatttgatgacagattagaacattctatgcagatgcacttatctgtacaatatcaggcttagacgatattgaaggggggagttgctattctgctagcactcctttcacactaacatgcgatcctccactaagtttcagcttgatttgatcacaagttcaatttacatacacctgtgaccactaatgattgtgaccagaaaaactgaagatcacactagctgcttcccaaatgacagtaaagtataatataatacaagattgtgtaaatacataaagcaaatataatttaaatcgtgcccctccagcacccctaagaaacgcgctgatcaaacaaaaaaccagaaaacaaaacaaaagacatctaagaattgaacatggagttaacagcgacatgtactgtacaggttttggagaaatgataatttaccagcttagctgctttaacagcatgaatctgcctcttcttcttctcacgtttacattcaccacaccagcccgaaaagtccttctgatatttcttcatctccctgaacacagagctgtgcacaggaactattaattttagctgcaagttagcttgctagtagccagtagccacaagaaagataatcttttcagtagccagtagccagtagccagtaaccagtaacaagttctctttgcggatgtcaagagaaagaataacctttgggattgcatttgaatgacataaatataaagataaatttagcaaaaccacatatattttgacataactacagattcaacacgaagtatcacagatctacatatttagcaccaaacttgttacaaattaagatatgcaatagagcatcttaaatctgtaatcatgaccattatctcaaaatatttgtaattttgcactaatgctttgttgtctcaaacttctagttccattaatgtttcgttgatttactaaccttaagctatccgagtggtaagcactaggctctttcagtatgatggacagacagtggaatctcatacatcagaagaaaatgtatgtctatcttgtttacagaaaaatcaaatttgaactcaaccttatggagttccatatatatgttcagtttttggatttgtcaatggaagcaaaatctttctaaaatccctccctaaattgcacagaaagtagcatacgtacagatacatagctagggagatgatacattgttaaagagaagtttttcatggaacaacttatgttgacctcttaaacctttcctatgtttgcatcttgttttgttcctgaaattttactattgcgcctggctgcatcttattcaaacaacataacattgctccacctttctccattcaaactaccccatatgtcttatctaatcttagtcctaataaaaaacatccgtgtgcaattttattcaaatcactgctaaagaacaagtacggttctaataaaacaaaaaggaacagaaataaaatattgatacttcaccaaagcataccataagttggaattttgatctaatgatacaatacaacagctcatatagtcgtatgctcgtatgtctattatggtttaccaaatttccatcacttcatcattaaccacaaaacagatttgcgtgcgaatctgaacctttttagcatcatcattatatgatagtgcacaggtgatacaatctaaagaaatcaacattacactatctattatagagttacgtacactacaaatctaataattacctctaccataaaaaaaatgtcatgttggacaccaacatgatcttcataatacaacttctacaactaagacatctgtaaagcccaacaaaatatatacatatggtttgcctgcatcctttttaaataattaaaatgatattgatgtttaaaattttcaaagtttgaattgagagatgtccgaaacatgtttttgcaaccagatggagtattaagttaaaagtttcatgaggaagttatgctaggtgaagaacattatctttagtattatttggtgaaaaatactaaaataaaataaaatcatcagtggttgttatgttctgtcagtaaaagtaaggggcaactgacctttctggataagtatcctttttaatgtttaagagctagttgagcactcaatagaaataagagctgctaaaacagataatgcagaaagagctccccactaccaagtaagctctttctacttgttcgcctggatgaaaactccctagttttgtttggctaccttttttattggctagtgtggttttatatctcaggctagactcgcttgagctgtcttatcagtaatcaatctacaaattgatttccaggaactattgtcaacatttgactatgaggaatgtcttcgttgagactacaaccatgttggaaatagctaatcccttcaaaacaataggactccgtaacttttgcaagctgtaacagcaaaatcttaaatcagtaaagattccactaactaccttgattccacagcactcatgagaggcctttgatcaggtgtattttgtagtttcaggtttcttacccttgacatgaactacgcaataccaacacaactttccgtgaaacaagcaccaataaaacatgataagttaaggaaaaaaatgcatacatatatatggtcataatatttcactgaactaaacctcaaatgtccgcataaacggtagctataatacatgcccagtatgtgctttaaacaagcaagacaaaaggtcactgaaatctttgacaatcaaaattgtatgggaagatctgtaagacttgtataccttctgcaccacaaaagaagattgattctgagcccagatgatgtcggtcgggcaccatgcctatgacgaccacgatggagcacagctcgtccaggaacatgagagtaatcgaacatttcctgcaacatgagtaatgaaattgaaaagggtaaaaaaatatatatcttcaattatgtattgtgtaacttccgtgaacaaattaaccagaatatgttgcaagtaaatgacaagtttcatgcaaaaaaaaaatctgaacaaaataagtttcaacaccacataaatgcactcacagaagagaagaaaagaggtgggtttgaaatttaaaaatagatattaaatgcaactaaaacataaaagttcatctacctcatgctgtgtctctgaattcacatgattctcacaacggatgccacgaaagtataactcaccaccagagaattgcttgccaaggcaaacattcaatgtaacctcagaatcgtcaacgtggaaacctataatgttgagaaacggtttagaacagaaaagaaatgtttgaacaaaaactgagaatgaaaaatggcaaaagtatcattaggaactaaggcaaatcgatatacttaaaaaaaagtgcaactaagaaaattaatgaaattatggaactctgttaattacaaaagaacatttctttatggaactctaatgcggcttaagcattacaaggttgcgcacccattccttgtgtgtggccttgtaggtattgttttagaacagtgacaaatataccatatcaaaatttcacgcgaatagaatgaagttttctgacatgcttttaatgtttcatatttaactacctggataaaagaagtaaataaaagcgtgaaaccatcttaacatccagaaattctagtaatgtgtgcgatgtgcgatgcaggaacaacctgggaaggtggattggctctgaaaagaatttaagactaataggcaaggaccttaaagtttctggtaacatgatactagccactcctttctgaagcaaattatgcctctggcctcatttataacaagaagtcgagaacaccccaaacaattaactgatgatcatttcagtggcctaacatgactacaatgtcaattagttgtaaaataaacggtacaacatgtaggcaccaaaaagcagaattactaaatctcatctgctgcccagatttcaagttctcaactgctgttcgtaaggtagtttaaagcaaggtttggaaagatgtaagttatccactgaaatttcgggcactaagttagttgaacttaagaactttcttagtcccttgaatccttactgccccccccccctcctcaaaaaaaaaaactgagaaagaaaacggttttatcatgccattctatcagccccggtctttgttctacttcattaagagacagcatagcattcatttttcatcatgatagctaatctttcctgtcgatgaacacccctaggtgatagtagtacaaatatatctaagcgcatagtgcacaataagatactccctctgtccaaaatatagtagacagagagagaagaga

SEQ ID NO: 14008 - DNA, 13740 bp, Oryza sativa
cagtgaaagttggtcatattgatttatcatctagtcattgaaactagtttcaacatattgccattttaagtaggaaaggccaaaccattggctcaaaaaatgatatgtgattgatttctcaacagggaggatctaccatgcatatagtatccatagttacatggaatagctgaatgcagacatgatcaatcaagaacaattcttttacttcatatgattttacaggctattaagtataaaccaatattatatatttataatggtaacttaccgagttcaacatccctgtctttcccatactcaacaacaaaagcatggtgtgtatctaatgttcctccaccaacctcaggatataatactgaagattaacacagcataaaatcaatataggaaatatattttgaaaatgctagtgattctgcctctatttaacaaggatagcagtcgataagataacctgtagacattggagctatgaactgttccatgaattggttcagcataacttccaggccaaaatcatcaaggacagcaccatacttgttcattgtatttggcctcattatcttaaatttcattgtgtggacccatttttcgaagttctctacctacaaggtgtaaaacattgttttatcattgtaagtttgtaacaaaacatgatatagcaatatcaaaattgtatgttatatgctaccatacctcctgtaatagcatctcacaaaaattaggctgtaacatagcaaatgaataaacaccaggaactggctcagtcataatgcttctaaagctttcttctgtattggtcctaatagcttcaaggaatgttggtaaaaagaacgatgaagggcgcattttgtatagctctttatgaagtggctgtcaggaaaataaaaaaaatataagttattattactagcacaaaaaacaaatagatttagtttcaatttctcaataagattgatgacttccagtccatacactacaactgtagtgtacacatgaatgaactgtaacaaacacatggtgccatttagtttcattgatatttccacttgcttgagctctagctgttagtgaaatcaaggaacccacatattgttgactgaaacccacgtcagctcacaattcatttaattctcctgtctggggattcattaccgctcatgccatagaaatttattttgccatatcgacatagaaagaagtatattttttaataaaaaagaagtatacttcatttaataaaagaagtatatttttttatattttgccatgtaaacatagaaatttaattccaaattcgtttgacataataagataaatattccataagcagctttctaagatcatgcacacaaggcaaccaacacaggaaatgctgattggataaccaaatctcggaaggctctccataactaaattattcatggtacctgtagtgctctgtcacagtcatgcatacttgattcaaacagttgtaaatattgaattactagcgcatactggatgcctggattgtaattcttttatctatgatcttccagtatcctaccaccctacactcttcacggacctcttgtccaaccaattgtgcccttttgtaccaggaaccagctgcactcttcaagaacaaagattttgctcatgcaatcacctgggaaatcacatatggctggtcgtacaggaccaatacaattgttccataaacatctcatatcacaccctgcttaacgctcaaaagaaataacaaatcatacaatatatgatataattcctgaattcctggactgcatatttctatgtgcaaatatagttatgcacaagaaaaaacatgcatattcccccatttcaaaatatttagagataattcgaataatgtcagctatgctgaaacgctaaccttataatggttgagtattctctgtctgtattctctgtgcctttgaacctgcaataaaagaacacttcatatgacaatctcaacagaactaatcttacagctgcagaaaatgggaaggttgaaactctggaaatgcaaaaaataattcgaggtgacccttctttgttcactcatactacttaaggaaaaattaaaccactacatgtgttttcttttgacatgttccagctcaaactccctcgtcgttgcaaaactaaggtatagcatctcatgacgaattaaatttaatacatgaaattaatatgcaattacaaatatctgaagcagccacaaatattttgacctgatctctgtggtatgcagtaacagcttctttgaacatcataaacttatactaaaaagtcctaccactaggcataacatcaaagtttattgtaaacaataaaatatatattgatgttaagcattgcttaatttttgcatccgtttcccgtgataccaatccattctagtcttgcaaatgcaagtaatatcagcagaatttaaatggctatcttttctttctgcaactttgctcctattacctcaaaatttgcataaattatatgcttcataccaaatacactttatattttaacaaatatgattgcacttgtggtaaacaaacttgaatggaggatacacattagtgcaataactagcaaaatatgatagactcataggtgcgaaccaagacaaacacaatccaagaaggcaaatctggttgccttggtgttaacaaggatgacaaccaagtgatggtttgtgttgtgagctatcctggtatgggttcagccacgttgactcaccttgtcaattctacggattagcaataatatttatggggtgcaaaagatcatggagggatggtgacacagggatactggttcaggcccttagggagaggtaataccttagtccacttatgtggattagatctgtgtaggggttcgcaatacgacattaggagtagcgtgtagtgatcacctgctttagggttcccggttccctttatatagacacagggaactggctattgagaggtatccggatcccaccttatccgggtacgtaccatctatttacacgggataagattcacatccttatcttcaatcccattcttcgattacaagttagccggaacaacacaagaagctccataacatagcatgctttcgtttctacagcaatatcaaggaacaactaaccaatgaagtacacctcatctacaggggcggacccatgggatgctacgtggacactggcatacccaacaaatttgcaaaaaggaaaaaggatgtagtaaaccaaagcccaagaagcctaggtgcagtcacccaccggaagaccatgcgtgtgcttgcgtcaatgcgggagtgcacatgcaacaaagcctttcaacatcttgagggtttccgttggaggcgcgtgtgaagtggaactgccagtgagttagagtctagcaaagccaatagcactcccttgcagaatggcccctgaacagctgagccccaaccccctgagcatggagtactggcgacgatgcctgacagggctgcaactcatggcctgcaagcgtagcatccctgggtagcacgcaaccagcaactgaaggtggcaacaggcaacaccagatgaccaggtggtctttcaccttttcacttcctctgaatatatgatcatctttctcgggatgtaatcaagcatttatatgccatgaaaaaaagcccgaaatgactaaacgtttgtttgtgttatgtaagactatttgacctatttgtacttcacttttcatgaataaggaccctaattgtatttatgtgcatgaagactttgatttggctcctgaaaactccagggtccactgctcagctagatggaatccttgtcaagtcagccagatttgcccatgtggtcattttggccttgtttggcaccaaatcttaaaagtttatatactgccagtcgaatttactctttttttttctcaatcaccaaaactaaaatcaaatttcgaattccaagacaaccaagatatatcatgcaatttgccatgctacaaggaaaaagaactcttaagctacagataaacaatatgattttttagaatcctttatagaatgaagttcaattagtacagtactgcatagatccaaattgcagttcaagatagattagttcggatcgatggcgtcataatataagtattgaacaagactaattttaggatgtcctagaaacagccaatccataatgttgtatcaatcaagcagatcaagcaagagataggcttccaccaaacatttttcataagcacaggttgatcaaggaaagtgccatggcataactagcagataaaggcaaacagaaggatattatgacacctttaaggtggaccaagtgacgattaggtaaggaaaagcctagtgattaacccatagagacaattatttagaaaggaagtgattatcacaatattttgtctctaacccaaattgtgtatgtatttagggtgagtttggttctctactctaccaaaccattggtaatgccaaacctttgggcaagctttggcactaccaaatttttggtagggtaaagttgtatcaattatattgatttggcaagattttttttttcgggggagggggggatccaatccaaatagctagcaagagtttgaagctaccaaataaagggtagggcaatatttcgcatcaaaccaaacttgcccatggttaattagtcccttatgttcatctaatataagttacaaaattgcatgcattcttaaataggatcttccatcatcacatgcatccagttatacctagaaagggtgtactagattggggcattggcacatattaacagcaggtatgccaaatccagatcaaatttttcacagcaattgtctggtattgtctgggctggctacagcttgtcttatgcaaaatgaacagacaaatcttttggttattggatttagtccagcatttgtggctgcacctcgtacccttctccagccacaacacctgcctgccagaagttgctggcacaagaaccacattattccacctaatgggcatacaactcagcagttactttcttcaccatcgcccattctgaatctctaatttcagagtccgtagtaaaaaaaaaaaaacaaaacaaaattctatcgacaaaagggccacagcaaacacttaaaaaaacacgcaaggcccatatatatttctatctaacaagatccacaacctcaccttgttgcgctcaccatggggccaatagtgcccgaggacctctcgcatgagctgcagcttgatttcccggttggcatcaaggacactgggtgggaggtgcctctcaagtgcactgtatacagctggtgcgtactcgccgcggacgtcgctgtagtcctgcggcttgtgctccatgttggggttcaaccgcagccgccgatctgcgcacgccggcgccccggagggccggccggccggccgcaacggcggcggggccacgccgttgccattacccatcgcggcctgggcctcgtcccgtcgctccgcggggccgtctagagccatggggcacgcgcggcggatcacagcatcgggaggactagggtttgggtgggcgaattgggtgtggtgtggggttctagggtttgggggcgaggtacttttaggtcctcacgtactccccgagggcaggaagaggaaatgagtcaaatgacactggattggggacagaattgcggtgagccgccactgacgctgtggagggggaaggacggacagccagctagggtttacataattttgtgacggctatgctattatctgactacttgtgcccagtttagttggagaaaagaaaatttttagatatcttatcggatatttaattggatatcggaagagggttttggacatgaatgaaaaaactaatttcataactcacctggaaaccgcgagacaatcttttgagcctaattaagcttcattagcacatatgggttactgtagcacttatggttaatcagggactaattaggctcaaaagatttgtctcgcgattttcatgcaaactatgtaattagtttttgttttatctatatttaatgctctatgcatgtgtctaaagatttgatgtgacatttttaagaaaataaaattgggaactaaaccaatccttatccaaacacggaaaagattgaaagtaactctaatcaattatatctctaacagtgtaaaacatggattatcattgtttctatggatattaaaataatattttatctacaagattatgtagagggtgtagagcagggctcgaaatccataatttgttagtaattaaagggaaaaatccaaatcctctataatctttgaaataaccatagcttcttgcacccggaagttcattgtttatgatcttggactctataaaaagcttacctagaggggtacccaacccagttaaaaccaatgtctaaaaccactcaaaggattggttaagtttgggttttctctcaatgtagcacttggatatgaaactttgagcactgagacataaacaaacacatcgacattgcatcccacttaataatacgccaatcctatactcaaacgcaaatagaaagaaaactataccaacaggaataccttcatgatttctttctttctttgtcttgagggatgttaacaccaaaaccatttcaccttgtattctttaaaagattgatgatgtttacctgtagctttaaatggcctcgcacaatacatcacgacaaagccttcacttgtcctttacctccagattcggtccttggtgccaagccattgcttgcccttcaccaccacatggcctatgacgaccaatcatttcttgcccttcaatatctttccatggatagctacttcataccccacctcttcaatatcttcacagtaattctcatcaattgatctttgcttgcatatttcaacttttttcatcctttgaccaagcaaactattcatcttgatcattaggtgtcatgatgtgacttgagcattagcaccttttccatttctaaggacctatatcttttatttaactcaatgaaattgttagttacaatgatcctgttaatgatctctaatacttgaccaaccaaccgcatataaagaatatgaataaaatgatgagtattaatgttgaccgtcattaagtaccgatttcgatcgtcaattatctcgacaaagaaagagaactaacatttcttgcattgtcacttggttcaactacttttactcatacatcccctgaccatggctagtctgaccgcaggccccatgctggtcagaccgggccaggctcggtttgaccgggcctcctttgagtcggttggatgcccctagcttggcgatctagagctgccagagccgaggccaatctgaccggccgacctatggtggtcaaaccgtgctagttgtgcctatgcaataaatgaaccgtaacggcttctagccgttacaccaattggcggtctgaccgaccaccctatggtggtctgaccggcaggcaacaggggttggggatttcgaccccaatggccagtttttgtggatgtgggtataaatactcccccatcagtagcaaggggactctcatggcacttgcttaatttgcatacactctcttgagcttgtgttcatccatttggtgtgtttgagagttgattgagccaagacaagtgcattgcttcattgtagagctagcgtggcacttgatcatcttcaagctaggttgttacttgttactcttagaggttgccctctcatagacgacttgtggaggtattgcctggtgacctctccaaggagattgtacagaaggcctagtgccggtttgtgcgtgatttggagttcaccaccttcggagtgaaggaagaactaccctagtgattgaggcttgatagtccacttctcgtgggccggctccaaccttgcccaccccttggcgaagggggcttgtggtggcttcgtggttttgagcggtgaagttgggtttgcctcaacggggattagaaaccagcgagtttccgaacctcaagtaaaatttcctttgtctcttgtctcattcacttattgcatttacttttgtgcaatttacattcatagagacatacttgagcccttatcaccccaggattgcaaaacataacctagttgctttgttagacttatccttcaccaagcctagcaacttaggttagttttaattaggtgctatttatttttaatatcgcatattcaccccccctctagttgacatctcaatcatacactagtggaagtggttagtagtaaactcctaccactaagtctcgatagtatatttgatctcttttatgcataagttgacggttaaagtttgcacttaacgaccgtcaacaacacccccacacttatcctttactcgtccctgagtaaagctcatgaatatattatagtaatgactttctgcttaatgatataacatactaaatattccaagacaaacttttgtctgtgaaccttgatgcgtctatcatgtcatcttgagtgattgaagaatggaatggtcctcgaatcaagtcacatttactccttctggtgaattacctttgggttttctttgatgctcgttacaatataacttttactatacttctcaattaatttctctcaaatcactcatcaaggcattgatgttgcattttctcatcctatatttctaataaggcttatgtggagatcaggatagggaataagaaaagacatacttacatcagatatattgtaaagtcaaatagaggatgtaagaagataactaatcataaaaccatgaccaagcttggtcacctatatttatgggtggaaatgggagagtggaaaaaatgaaaatgggatggtgactcattttttttatgatcctcctgcttgcacttttattccagagaacatcactatactttttttttcatcatgcttgagaaaatttgcttcattctcttttgagcagagttttttttagctcatgtctcatttggcatggatcattagaggagagaccatacaatgtttttagtctttatttggtggatgccgacttctggtgtagaagtttagcatatgaaagtgaatggaatgtgttgctaatcctacagtgcggagaaaaagcaaaatttttggtggctaagtgcacaagactttggtcatgagaatatgaaaataatctaacaagggtcacaaccatttagcaaaactcaaaatgatagcaagcagcatatgtataaggtttcgtcattaagattgacatatggctttggtaggaaaggaacaacattgaggagtatgcaaagttattttattttcctttataaattccaagggttcaacatcaagtgcaagtttcatatcattaggccatctctcattaatcaataacttagataacacgtggtcccatgagtatgtaagtcatagaaggtgtgtgcagggaatagaaggtatgcaagtcatttttacaagcaattcggagactctagttgatcatgtcaatactcattttaattgttgagttaattttagataaggcaaaattaatccaactcaaggaattaaggatatgaaggataaacgtgcaaaccaacgctcatatgtgagtgtgaagacgtgcagccttgtgcaatggttgcttcgtctcatcttgtgaatgtgcaagcgtcacggtgtagcacagacatgggtaatcttgtatgtgaatgcgtcatgtgagcacaagatcaccccacacttgttttcgtacctagggtgcttcaaaagacaaaaagacaaaagaaaaatgtaaaagcaaaatggaactcactcagtgaaacccgatgagtcttttattttggcatttcatccaggaggcaaaggcggccttgcagcaagctccagttgcccaaatccagaagatcggaaggcatagtaattttgtaacgcatggtcttgctctactcagcctatgcctgaaacaaagtgttgtttggctctcaggctcccaagtgtgtttctgaacgcctgtcctgagattgtaatccagtcgtcgtttaattaatatatttctttcccccgagaaaaacataaggagtaagaaaatgtttatgaaatacttactgtttggtacagctactgagagacacttatggaatgctttagaaaagtgaaatcacatatattggaagaagaaagataattttgtataaaggtactctggagatatgtaaggctaaatttgtgaataatgtttgtcttgagacccccaacatgtacatgtgtatggcgagcacaatatctccaacacagagaaactgctagagcagtacaccatatacatatatacccatctgtaatagacataatcaataagcttgattttttttcctttaaaacttcaagacgtttgatatactatatgactttttcttccatgtagttctacctctcacaatctcctcatacttgtcatttgcctttagttgcagaagatgagtgtacttcgttggccactgctggagcgcaccagctaagctatggtggccattgatgatctcttgcgaaagtgaaggtcccatcacaatgctaacattttctcccggcataatcgtgtcttcatcaggttggcaaattgattgcacaacatctgagctcccacattccttcctgtattccagaatgatgctactaagctggtgctgctgcaggaattggtcaggcagagtctgcacgccataaaaagacatttagaatatgtcgatctttatgttatgcctaataaaacaagtgggaatcgatagaaattgggaatggatcaatggcatgtactacaccgttctttttcaccaatggcatgtttgaaaccatctaaattttgcttttataaatttatatcatctctattaaactagctcactttactccctaaagatctttctatttttttactatttgtctctttatagaagtgatatttcaagtaaagttttgaagtatgatgataggagtattccttttgccgcaacctattcttgaaaaaaaatatttatcactatttgcatagatttgaagcacctacgtctaatttaaataacaagattgaaacggcatccaaactataataaaaaatatattatgttgtcatacatggttctacaaattttgaacttaaaccgtgttttataaaaggagaaacaagtaaagataaatatttttttaaagagaatgaagatcaaccggaccaaatgggagagaaaccaacgtactacctccattcgtttcttacttacaccataaaatatgtaccgtaccttgtaatattattttaccgatggcatgtttgaaaccaactaaattttgcttttataaaattttatcatttctaaactactccatctgtttcatattataagacactttgatttttttgtcttattcaaacttctctaactttctaactttgatcaagtttataaaaaacatagcagctttttcaataccaaatatacataccatcaaaatatattcaatattaggtttaatgaaactaatttagtgttacaagagttgctatatttctctataaacttggttaaacttatagaagtttgacttaaaaaagttaaagagttttataatataaaacatagagagtagctcattttactccctaacatatttctactacctccattccaaaattacaacaattctagaggtcaaatacaacttaagagaaatataaaatgatctatgacccttattaaatgataggtgaatgaaagtgaaagcacggatgagggtaagctggaaaaatatttaaataagagttagttgatgtgattactagtacataggaatgcatttattttgggataaatttaaatcatgtaagtgcacttattttgggatggggcggaggagtttttttttgaatattttatctctttataccagtagatattttaagtaaagttttgtgggatgatcataggattattccctttgcctccaccatttttcttgaaatgtttttatgactgtttgcatctaattttaaacacagggggctgaatttaaataataagtttgacacgtcatccaaactataataaaattttcaacattcttttaaaaaggtaatgttatggtatcatacatggttttccaaatttgaaacatgtttttataaaggagaaacaaataaagaaatattttgaaggagaaaactgagcgaactttaagattcgatagtatagaatagctaagctggttagtggcacggaaaccaaagcagtgattaatttagtattaactttaataaagttaaaaaaatgggtttatttgacttatgtataaagttcttataagcactgttaaaagagatcaagaagcttaggaaacatgctcacaataaatgaggaagtagcctagcaaatacttactctaacacattttaagcgcaactgtgagtttccatgtccaatgtttgaccgtccgttatatttgaaaaaaattatgaactttttttaaaagtaagtctactattcatgtcctatgaaaagtttaaataaaacggccggtcaaacatatatgcatatgtacataggaacagataacccatgcagcattttctagataacttaaccaccttgtaaacactgtgacagttcttaaaaaaatgtacactctgtgacactgacacgttattatacaactaagttatctcaacaaacttaaccgctataaaatgatgaatattacctcaagcatccaccttacatatttgacgttgttgacatgatggttcatatccaaatcgctgcgcttcggctacaaatataatgtgcatatataagaataagatattgtgatcctatcctgcgttaaattaattgcttcatatgagattgtgacaaactgaagaaaattgcagagcctctggagcctaggaatatagaaaggcaaatcaattaaattaataaagaaatattttttatcgagaaaattaataaaggaacttagtttgtgcagtagaaccaatataattaaccttcaagtcggaatcgacatatgtggcattggtgtcgagcttgatgatcttgtcggtggccacctcgtcaatcgcgtgcctgtcgatgaaccacggcgagatttcgtccctgacctccttcggcatcttcgacagcctcctggtgaccttattcatcatcacccatgtactgcacaaacgacgctagggataagaaaagcagttgactaactgagttactactagtaaagtataacaaaacaaaatgagttaattaatacccagggcatggtttcccttactgcggggttaccgcttaccaccgaggtgcgaaaaccgcctgtatatcaaccaagttcaaagaaaataccaataaatatttaaattttcggtaaattttgctcggtaaccctgttaatgctgttaatgccctatgttcgatgcttcgtggttgttgctatacaggcggggaaaattactgaaaattactttgcatgagcttaccgaaaatatgtttttaggcaaagtaatttaaccctgttaatgccctatgtttctagaaattgaaaaataaataaatagcaaaatcaaatgttaaaatggagaagaacaggtggtatgacgttggagagaccatgagtgcaagaattcacttcacaggttcaaaccctggtacttgagtactccctcccaaaaaa

SEQ ID NO: 14009 - DNA, 5575 bp, Oryza sativa
atatgattgcggggtgtgtgctcataatgctctacgagcgcatatctaccatgtaattgaataaccatatgtcaaattataagtagttgaaagtaaaacaaaattcaaagcaaaagttgagataaaaagtttatattttaatcctacaaattataattctaagagcttgtatgtaaatacaaagcatattattttagtaaagtcacgtgtaataatatccttcttaagctgatggtttttaccaccagctaactttactacatggcagctataacttatcaaataaatcttcaatccctaggttaaataataaagtaaactcagtataaaatgattacactctcaagccatgcatctagcgaaagcgtggctcacctaaaatcaagggcatctaaaaaaatcaggaaagggttttttataatggaataaatcctatcttttacgtccagtaagctatagccaattattataaaatccactcaataaagagcaaaaaaaattccaggaaacagtgcacaaactaatgatcaccaatagaaaaatcagaaaagggtaaaaacacaaaacactttggactttaatacttgttggtttttactttgaagtgctgagctttgatcaacactaatttaaacaatcaaattttgtagcatccaagttgtattattacatttttaatatatttaaatgtatctgttatgatgttatgtaaaaaataacgctaaaagtttatctactcacgatcaaccggtcaaatcaacaagtattcgtaagtcaatctaattgaatggtataaaaatcaatgaaaaagttgaggaatattttaagtcgaaacaatgttattggctaactgaaaaaatgaaaacacattaaaatattcacattaccctaaacagactactattagaaatggcgcgccaactggcacccatattttctagtataactaattattaagactggcggatgatctctagaagacatacctggttgctcggacgaagatggcgccggagctgcggccgcggacgagccagtcgcgccgcatgccgttcttccccgacgagcctacccacgtgtcgatctccagcacctctcccctgcaaccaacctctgtctgatgagcataaattttcttgccccggcctctctgaacgaacaggacgccatggacgaacacaaatactaatataatataccagatggggtagtggtcgacttggacgtgcatcctggagacgacccagatgaggttgttcgtgatcatggcgtgcgtggcgccgaagccgtcgccgaggaggcccgacatccacacgtggttgagcgccgtctcctggaggaggttgagcaccgtctcgagcgtcgccgtcctgtccggcccgacctcgtacgaccgcaccaccaccgtctgccggtaccgcacgcccccctccacgatcaccgcctgccggaacgggtccaccgtctgcttctcactcgggatgttctgccgctggctcctcctgccctcggcctcctcctccgtcggcggctgtgacagcaccggcggcctcatcagcccggccagcgacctgttgattttcgtctccagcgcagccccgacctggagcggcacgcggtgagccgcgccgttcaccctcacccggccgccgccgctaccatctttctcgtaggccgagcacctcacgagcaatttcgagtagtacaataatgtagtgttcgccatgcagatgcagtgatatatcgttcaaaacttttgcttgctttcggcgattaacggagaagaattagtagcagtttagattaattatatgctcaatggcgcgccgtacgttcttataggactaacacgattgcgcgcacgagcacgagggcggatccgccaacagagcctcgtttgtcactcgttccaacggacaaggaacaaagaaagcaaacatccttggactcaatcgcttgccatcgctacaaacaatgcaaacgaaaatagcctaacttggaccttacggagagcgaaattggaagccaaaatctggacaagagaggtgggctcctcttagtaataaataataatagtaataatgttacattctgatgccgcagtcatgcatcgactttgtgccttgttcttgtcatgacgagcactgacagcatagattctttggaattggaagacacttttattggagtaaacaaagcagacaattcattacttctaccaatcgaacattctctatatgctggtacaggcaagatgaatatccatttgtgactatagtcgtcggtaaacggtaacattaataacaaaacagaaactacatgacatgctgcatatggagcttaagcattcttatgccttccactattcaaactaggtagttttgggccaaaaaataaaggtaactgcgctgagttgtttatacggaactagttatcgtgcacgtgcaagacacgttttcgcaatatatatacatatgaaaatagaacaataaataaggtattttctatgcactgcactccatacaaattatacagataaaaatagagtttcatagaccatggtaggatgacaatttgtataggtctataaaaaaaacagcacagtgtatttctagagtgccaatataagatgcagtgcactgctggagaagcaaaccttgtgtttcttgctccaagactttggatctaattccagataattcatttagcataggaaaaattccagagaaattatatttgaattgacatctttaataatagcacagtggctaccgtcatacaatctgatctttttatacataatttaaaatacttttatatgattcctgaaatgtgaacaccaaaatagattataaggcagtgctttgttgtacttgaagcctaaactacaacaaattgatctctcccttcacttgcagccatatctctatacatttgtgcacgcctgagtgcaatgaaaatggatttagtggtgatggtgatttttcttctattaagacaactattggtctccccaatcatcaaagcccaagttgtcatgatgttacagagttatagaatgcgagtgatgaattgaattaataacgatcagacagttgctaagattccagtgcatgtcactgggtaggccaaggggatttggtgtgtatcacctgttcatgcaaatggatttggtgtagagcttccaacgatattgtccactgcaataggccaaggggcacagatcaatggccatcacaggttatctcgggctctatcaggtgttcatatcaagggcacaactcatgtgcatgatcaaattatcatgtagactacgaaaataaatgcctcaccagctatagaatctatcaaaatgcttgtttacctgcaagaaagtttactaaattatttaaaagtttgaagtgaatcttacttccatattctactacatagaaacaaattgcaaggaagaaattcatattacaatcttctcattttggtttctgcctccattaacagaaattcaaaagctctatatgaatgccctataggacaacaggacactacacataaatatgtcatcagtttctcatattcttatttgtagaactgcattatagagactcagagaggaatacaatagcccatggttagcataaatctcatggaggtagacctcaaagagatcaaaatagcagaactttagtgactcatatgagcaagtaacttcaagatttcattaatcaagtactgtacaaatctttaaattgaatggtattgctaattgacacggataatgtatgtgctggtgacaactcaattagattttggcgatgtttcccatattttcagctattgacagaataaagtagatatgtgaatatctgaaaatatgcaattctgttacatatatttggttattgtacatatgttttcagcaattaagatgtgacattttggtactgatacatatattttcagcaaatattttccaggaaagctgatcaccgaaattagttgtaacaataaatgaatgtcagtcaattctgaatatgtgaaagcaaatggcttggaagatgccaagggctaaaacctgaatggtttagtcagaacctgtctaggatacagccctagcaacatccagagattgaaaagctaataatagtttgttgtagtactaatgcgtacatttcatttgatcgagttagtgtgaacacctaccagagtgcgaactggaatcaacaaataccgtttccattgtcttgggaagagttcacattacacaaatatgatgcccctcgagaccactaagaatttcgatactacaatatggtgaatacaacggcaaccagagattactatagtgataacattttgactaaatggtacactcgaattagtatagataaaaagaacattcattttggtttatacaattctaattattaaaaaagccacggaaaggtgctcataggccacacaaggatcatagaaatagtgtcaatccagtgtcaaaaggaacacatgaaatttagtataaatcattaactgtatcagaaaataaaaacgatcagaattcttggtctttcatggtagtattacaagtaccaatgagtaagtagcagtaaattgaatcattttatcaagcagtaggggagcatgggcagaaatcaatgtacctgctgttgtcttcctcgacgctgccccatgctccgccgccgtcttccttcttccaatactcctcattctaattccatgtaaatgcaatgctaaaatatagagaaaatcccctgtgtgcccatgaaaactcacctaatcccttctatacccccgaattttatccaaaactcacctaatcccttctatacccccgaattttatccaatcccctgtgtacccctgaaatttcgctgtgatcccttccatgcccctcccgttaggtttccttcattttcacgttatgtgtggttccaaatgtctaaaatccccttgtagatgtaggagtggcagctagattgaaaaaattgaaaaaatgttaactgaacaatatgtgtattttatgagactaaataatgagcgtataacaaatttattgtggcactgaaaaaaatgcaatataatgaactttttgtttggaaaaataatagatcaggaaaagctgactgtctgtacagtcatcagttttctctatagaagaaattggttcctctgtacaagaaattgattatggtaaaataagagcatcaatagcatcatatataataatagagatattcatacagaacacacaatatcatgcacagaacataatctttccatcatccatacataacagttcatatcatgcgcacccacaatttcatttccatacccaatagtgcaggaaccaaaccaactttccatttcaaacaaaatggtgcaaccaacaaaccaaattagctacgcaatatatcatgagcataatggcataaggtccataacagtgcatcattacatcatgaggaagcaatccttacaatagcaaaatatgtcaactatgactagaccactttgcagggcatcacaacaacaaaatccatcagcctccacaagagaa

SEQ ID NO: 14010 - DNA, 1861 bp, Oryza sativa
  unsure (1)..(1861): unsure at all n locations
cgttctcttctttggtggccctctatgaacaagagaaaatatatgtcataaggcttgttagaaatagaatggaaatttgtgagacaaatatacacaagtgtttaggttattaaatcgaaccaccgcattactttctaatcttatccattaattataatgtttagtactacaaggatggaatgtcatgaaatatatttatcaacttacacagctgcctaaattgcaaccaccaactaaaatgaataaaagacttgcaatgatatgtacctttcagcaagcattgctgctacttcctctggatcaccctctttgcaattgtgccaatgatggccataactcttgcaaattgggcatttgtgcctcctactccttttgcttcctttctcagtccatcctttgtacctcatagttcttggtctcccagctgatttcttcagaatgggtggtgccaagaaaaacccatgatcagcttttggccattgtgccttgtcaggtaatgaagggatcaatttctcatatgctgccctgaatcgatgcacactaaagcaatcatccacataatctgcaagccttcctctaattgatgtgatgaatgctatagcatggatacaaggcttccctgagatctggaattccctacatgtacatgttttgtgctccaaattcacaacatgtctaaacccactacctcccttgacctcaatttctgcctcaaagtctccattccttgtgaccaccatgtctaaatctctacttttttcattcaattccttgacaatatgaggtagaatgcagccttcgaatttctttcctattctttgcctcttatcccatttcaccaacaaccaccgccgaatcctctccaagaagtcatataaatgtagtgctttccaatctttcaccaagttgttgaagctttctgcaaggttatttgtcacataatcaaccttgcaaattgtacagaactgactcctactccatagccttttgtgatacttcttaaggtatgctactgcttctggtttaacttcttgtatggctgccatatgtttctcatagaagtatgggctccatgcatatgacaatatacttaaagaatgcatgctgatttaaattaaaaacataccatcatagtgacaccatcagcaaccacggatgcatgaatcctccatntgcagcctttagcagcacaacttgcagtaaattgccctggttcacttcggatgatgttatattcnaactccttttttattgcatgttgtgctattgccaatctanattcattaatgtttggatatacgctgcctacgatcattggtgggtcatttttgtcataagttgcaataggaatatgttcaggcattccatctgatgccattgactcatcctcggattcattgacaccatcatcctcatatgcatcctcagattcatcctcagatgtagcccaagattcatcctcggatacttcattgacagccccttcatctctagtttcatcagcatgaccaacaacagcctcctcctcatctaagtatatgccttcctcatcaacaccaacatgctcaaccataagaaatgagtttactaagtatgtgtcggatggcacaatgacataaaaagaaaaagtgctgctgctaggttggctgaaatccacttgagatggggttgccaaagaaggagtatcgggaacacatgcgcttgctttaacaagagtgtggtctaactcatcaatactttcattaataccatgtatgcgaataatcattggaatcaccttgatatcaacaaacttttcaaacattgtaagcatatcatggtcagttgtgacatgatgagtaattttatgaaccatatccac

SEQ ID NO: 14011 - DNA, 1106 bp, Oryza sativa
agtacataagttgaattcaatgttagactgctgcacgtgcttgtgtcggcaaatgagagattgttggcacatatagtaccagatattgatacaatagcgacatttacaagtagtgcaatgaacagagctaatgcattctcaagcaagaagaatgtagaagcatcctgcaagaaagtgaattcaaattatattacgaagaaataatgactgtttgaacagaaatataaagagctagaaaaagggaaaaaaaaacctccttttgaggattgtcatagactttctatagaatactgaaatactgaaattattaggtagagttcattgtacttaaaaatagagtttttcatgttatatatgcttattcattcatggttgaaattcctcaataataacatgaaagtaaacgaaaacttttgttcaaatatgctatgtctcatacgaaaatgaataatctagaggtactggtatagaattatagcccatatactaaggggcactggacagacaaaatcaacatcagtttagagaaaaaagtaaaaagaagtagcctattccagaggttaaaaattaattttaattttaacataaaaaatatccttttaccttgcgtcctttggaagtatatggcatttttctccgtagcaccaaagaagaatgtaggaagagattatgcctaatgttataaaagaacagagcacggtagtgaaatataccttttgctttacatctgacggggtagccacaataataccttttaaagagtgtgaaagacctttcaaaggttttttttttatataacagatatataacttttaaattagtaaaacctgaattataatcgttaactgattgaaaaaaaaatgaaaatatgaggtacaactaaaaaggagtggcaatgaaaaagaaaattcatttgaattttcagagacaaaagtataatcatagttctaagataatcattaaaatcatttaatgtgggagtgatacttacggaacaacaagagaaccaaacatagcaaccgcatctgaagtagaataatcccctttgggccttgggataaaaagcccctcaattaccccaccagcaggaggattaactttgccaa

SEQ ID NO: 14012 - DNA, 17201 bp, Oryza sativa
catctaaacctctttcaaatccaatctaccatatttttatgtcgagttaatgtcatgttatccttatttttatttaagaatagtaggtatatatgtagttatatgcatttatctgtcaaaaataataagctattatgatttatgagttatgtacatatatttgtccaaaacattaaatttccgtcaaattccgattactcatccgtactccgattaatcgtttagcggtaccctctccgtccgacatccgtattccgtcatccacaacactgagtgggacgggcggccggcgaccgaagcggttgacaggcgggtcgaagcggggcagccggccggcaaggttagctagggggcgggtaggccggcggcggcaatggcttcatctccgccaccgagctcgcgcgctccatggccaacacctcccctggcacgcacggccgcagtcggcgacccctccccgggcgtggtcggagacacctccccccgcgtgcccgtgctgctcctatcctctccggccgccgcccgtgtacgcacaccgctcctctcctcccgtcggccggcgcccgcgcacacgcgccgctcctctcctcccgccggccggctcccgcgcgctgctcctttctcgtcggccaccccgcccgtcgccgcttcggtcgccggcgaaagtgagggaaaagtaaggtaagagaggccctgccagtacctgtcagtggcagaagggagaaattttttttaaaaaatccatgtcatcgtccacatggcatgccacgtaggcaagaccacagtcaaacgatgctttggactaggatgatacattaaaccaagtttagagatctcgatgctcgttttgcaagttcgtggacctaagtgaaacctcgttacaagtttaaggaccgctagtgtaatttactcttttttattttataagcagagaaaaattcttaccccatatccttgtaacccgagaattaggaaagtgcatgccccacatgctaggacaccggcccagaaagggatgtggagtagcatgttgtaggctaaagcagttcctaaaactgcacaaagaccacagaaagcaccatgaaccttgaagaatttaaatacagaagataaaactgtaaagttctgtaagatttataaaggagaactgtagtgtatagtgcagatcttgtaagcctatgtcaagaaatagattataaaaaatgtgatcaagatagataagttaactggcacacaagaaaataactcccaccagttacataaacatgttatcttggacattgacatggtctccatagtgcaacattagatggtaatttctaatacaatatatttattataaaccagcaatataatactataaggaactttccacaacaaatctatttagaaagaaatatgacaatttaaagttttgaaagtttgacttagcacatgtccaaattgatttatgtgaccagtgggagtatttgattaagaaataaagcaagataaacacatggaaaccctataccgtgagagtaacattctcataaaccacactattggtgtttctatcttcaaaatataattagagttatatgcaataatcatcaatattttagataatggaatattttattatcccggccactgcacccagagatggacaaagccatgatcacttatttacaagttttccatgccaagaagaataaaccaaacataaagcaacatgctacagatgttgatgaaacacaaaatttcagttcgcttacaacctattgctcaaccaccagccgtagttattgaatagctctattaaatttataattcaataaaacaaactctgcacaaggaagttcattcaaaatattaacctaatttatggattacccccatggtttatacatggacaacaaatatgctgtaaaagaggatactatttttccaagtaacaagtaaaaatagtatttcaacttttatagaaagcaaagacaaacaacaaatactgatacatacctcctggtatagtggcagcaataacaccaagctctgctagtaaccataggcagtacttgacatactttggatattcacccatgcacaactcagcgaggtgccttcctacaatatatttatatggtaagtttcatagaacatgtatttttgtcaccagcttgataatatgggtagttagtttcacctgtaatgatacccaaatttgctgccaatgattgtacagtcaacacaaatatgaacccaaataggagtacccatagcaactgaaaattttaaaaatgaatgaaggagaagtgagatggcaaatctacaatcaattgacaaaaatgtataacataatattccacagaaattttgagagctttataccgaatatctgtggctggatccagctaccaaatcagtctgcactgttccaattttcaaagtgaagtagttcaatatattagtactagaaaaagaaaacggtggtatatgagcatgtcctgcctaggaattctagtggtatccatccatgttccttgatcctattgttgaatttaccaaagccatttatgacttaaaaatgtctttttctcaccatgcatggatggatggacacaaactggtgagcagagacaggcatagttctagtccaaggaagattgaaggacaaaggggacttacagttactaggatcaaggtatgcgatggagataacaaatccaggaccaacatgtgcaagaaatctcttccaagtgggtgcctgctctcacagatataaattactaaatggactcaaaaagttctgaaaaaaaaagttgcatgttgcagtatttacaacttaaatattttttccctggtggaataaagttcaattgtcttgtaatagatggttttacactgttttaaacattagtttttccctaaccagttaatcttttatgtaggtaatgcatatatcagagaactacaagtgaaatatttttctaaaatttggaagacatctaattttaaaaattcaagaattgtttgatccttgagctagattgccacattagagccatgttaatcaaagcaactctaaatttgggccaaagttgaaaactgaatgaaatacaagttcaagggtatatacttcatggttttgaagtttacgatcgataattgtttaactctatgaaagatcatgataataaaatggtttttttcttttctttcttttttctcgaaaacgtaggagaattgtgtttcatttcattaaggggaagaaaaaacaaagtagaaaatatttacaaagtaggaggacccgagccctcccaccgagacccacgcacccaagaccacaccgaggagcgctaactgcctaggttagccatcccactgaggagcttttgaagtgccaaagctcctgcggaacaccaaagattactcttgttttctaccacttgcaagaccgagacaccctcgcaatttttgttgaacccatgttatagtaggggtgaactgtacttttgcggcactaaatagagaaaagaacatgtcactgacaaatgacggtataaaaggaaagaaaagccattgtctgatattatattgtgaaattcatgttcgtcgatggtattttgtagaacacaacatttgttgatagcatattgtagaataagtcataatacaaagtcagctacaccaacgtgaaaggaatgacactaaaatctcaactcggcaatacgcgagtgagttgaattggcttactcctaaatttttttttggggaatacggcttactcctaaattgaagcccaagagaaacatgcctaaccgatgtcggttgataatcattattgcaagaaaacatccttgccaactactcgaagaataatcaaaccatggcaaaactaagtaatataccacaaaaagggtctattattttgtaaccagacgaagagatgatacgatctacggtcgagccaacagatttcctatacaaaatattctagcaaagccaaaagtcctcattgttatcagaaattttgattagtgcctgtttctatccccgtttgaggaaaagtctgtgctaattttacaaagcagagtacatagagatcatcaaccgtacatattcatttcagaaatcaatcaaacggatattcctcagatgtctgaattggctgaggcaatcgtgctacacatggtttgcttcctacttgtgcggacagcaggagagaagaagaaattgacagcaggcagcctagcagaggaggaagaaaggaagaagaacaaactaacctggacatcgccgtgcagaccgccgtgttgccgcgacggcgaagcccctgcggctgcggcgacctcaatctcaatctcgtccccgccaccgccgctgccgccaccgacggccgcgaccctcccgctaccgttcaccctcccgtgctgctgctgctgctgctcgtgctccctcccgatcttcgccccctcctccattgctctgtctcagtagcgcaactagtggtggtggtggttgaccattaacctgaacctggcgaggccagcaccagctccggttgccgcaagaaaagcagcagctgcctgcatgcaatacgggtcaactccgcgatccctctgcatatctgtacttctcccaacgtacactcggtgtattcgagatgcgacgcaagcatcgaggacgaaagtcgtcggcttgggggcaggaacagcactcacctaacccattccctctctcaaaaccccctccaacccaaacaaatgcccattgtttaatgcccgccgatggcctctcgcttccgacgtacagctccccttgtacggcatgatgcggaattgcggattactggtgcaatcgacggtacggatcgaggtggtgcgtcaattggacatttggattgcggaggaggctgacagcgaccggatccgcggggtccattgggggcgccggtgggtgcgcggtgtgcgtctctcacagctggacaaggccgcgacagccggccgggcgacgtacggcaggcagtccggatcagcttcttgctctgctgtggatagaatatagatagggatcgcgacaaccagttgaggacaaattgtaaacgccaaaaatttacaaatgccgtcgatgtcttcggtctctctagaaactcgacaagaaagcggcgacgctggccgcaggctccgcaagaaggcggtgtcggcgccgacgaacctcacgaggaggcgatgaagatttggggattttgggacgatgggtgcgctgattggttaggagcgatgacggaggggatcggggtgatgcggctatgaggcgtagacggatggatcgatgaacccgtggacatcgtcccggacggtgcatgaagggtgaggtcctgtagtactgtagcaggctttctgggctgagaatcgtcgaagctgagaatcgtcgattcactgttggtagtgggtcacaaaaactaaagatttaatatgatctcggtgccctatattgataatagttgaaaacaatctgaatcattatctgaagcgttcagatttttttttctaccaccatcccacttaactgtagtagaaatatttaggggcataattgttaaaaaaagttacggaggggtaaaatcatcctttaaagttgactaaacttagcacttcccctcaatcagccgtcgcatccgccaccgatgccgagcatccggtgtctagtgtctcctccccaccaacgcctccaccaccaaaaaattgcttatcgtacccattcatgttaggacgcttgatcaaggcgcatgcccgatctccacttcgtgtaaccaaaccggttaagtcatgtataacttatctggactccacgccatttcacgcaccggatattcgaagtgtttacaaaaaacaaaacagaatttactgcagcaaaacaaaactgcaaaaaggagaccacatctacgtaagggtaaggaaccaattttgacaaaccatctgacaccgtacgttgtgcacgcgcaccgcctcgctaggacaggccaggcgagcgagtgcgcgcgtgtgttccccttgttctctccacctcacatgcctcaagtagctagaagagtatccttccttataaggagatcttcctctcctagaatgagcaaggtggtactaaactccccatgcatgccatcctatgaggtgggcttttctgattttccaatgaattaatcttcgaatgggctaaggcccatctattaattccaacaaccccccaccaaatctaaaaaacccactgaaatttgcctttttcaatgtattgtttatataccagcggttcgatggagaccaattaaggttgaatatccacctaaaactccaagctacacttactcacaacttgaacaatggattacgccttgaagcaaggcttatacaagcaagtttcactcagagtcttatctggtactagaccgtcagtcatagtacaaaaaaccggaccggaccggcggttgaaccaggaataaaccagagccgaccaccttgacggctcagttctgctaaaagaccgcccctgcaatcgaacaagtaaaaaaccgtgaaccggccggtttttgcttgaaccggtgaaccggtggcaggttttaaagtatcgaaccggtttttatttttcctatggcagtatgacatgattaatttattatgttaccataccacatttatttttttatgttgtgaccatgtaataatagatatattggtttatttatgcatattttcaccaatttgtgatggttctatattaaaaataatgaaaatcaaatataatagtaataaataaaaccagtgattcaaccggtgaccggtgaaccgacagcccaagcgggttgtcctccggtccattttttgttactatgatgtcagaagaataccccttgggtggagcgtataagtcatattctctggtctcttagtaagcttactagaagattcacccaaaatctccatcgactgcgaccaacagtcaatctcacaaaggtgcattctttcaagaaagctctgcaggatagcatcttcgttaattaaagccaacaaaactcatcacgacatagccaacctgtcttgcagctcatgagagtacatgcatcttcacttagttaactaatagtctgtttacaaaacctccatgaaatagcaccactacctagtgttaaaacatatccactaggtgccaagtttctcttctcggcaaccttgtgaggcttgcaaggttgctttgattgcacacaataatgacacttagaacctttgacaatggagaacttagaaatttatcacataccgaaaagccgagacatcaagccaaatttaatatgacatgaacgtaagtgccgaacattagcctcatcatccacactgccacaaatatggttcacagacttattgcagaaatcagaaagggaaaatcggaacaggcctccgcactcatagccttttccaataaaatatccaagtttagacacgactactttattagactcaaataccaacttaaatccgtctctacatagacgggagccactaacgacattcctgtcgatagtaggaacatgttgtacgtttttcagctgcacgatctttcccgaagtaaacttcggatctaccatgctaacaccatgaacaaaagcatgtgacccattccccattaggacggcagaatcccgtgcgacctgataagaagaaaacaatgagatgtcagtaaaaacatgtacattagcccttgtatgaacccaccagttagtagactaattaactaaaaaatagtaggtaaaataccataccggcttccatctccagtgttgccaatggtcacattggcagactttgaagtctgccctgcaggtggcatcatccccttgcgttgtggacacgtcttggccagatgaccagacaagctacacacaaagcatgttctctcatcctggtttggattgctattgttattcatctgctgcttgaagttggtggtctgtgaggtttgtatttctttttattcttgttttgggccttgtgcacaacattgacactagactgcccatcatcgcccttagacgcggctatttttttcccaagctttctcctcaacatcaagagatgctatcaacccctcaacggagtattcttgtctcttgtgtttgagtgcagtaccaaaacttctccaagatggaggtagtttcgcaataatttacccggccacaaatttgtcaggtaagacacacttaaggagttcaagttccttaaccatggtctatatttcatgagcctgctcaactacataacggttgtcaaccatcctatagtcataaaactgctccatgacgtacagatcactgctagcatcagtagcaccgaatttgttattcaatgcattatcccacaactccttagcgtcggtcatgtgcatatataccccgaccagacgacactaagaacgctaagaatgcatcctacaaagagagtagtggcctcctcgaattctttctgcttttgagtagtgagaactcattcaggtttgccattactaacccagaagcatttcatagccatcagccacaaagtgccccttgatcagccctctcttaaagtacacaccggtgaatttgtccgacctagtacatcggcaaaaccagctatagtaaaaccacggttcctataataaagtttttggattgttgaatatataagcacataatgatttaatttattctataaataaatcatgacattgtagatgtaaactagcataatcgcatcatacgatctacacgtgtaaactagacggtaaaccatgaatagattgaatatgcgaaacatgctaaatgcgtatcgagggttttggaaaatcggttgcccagcaagaaggactcacggtaccatgcgttgatgacggcgcgcagcacgtgaacgaagaggaaaacgagccgttgtggacgaacaggaagcagtcgtgcgaagcgcttcccaaaatccttattgtcaccttctcccagtgcaagacgtcgaaggctatagttccgaagacctgctctcctgatcgccggtgcatgtcggcgagtgggatggagtagtctacgagcaacggcgcgatgcagaggaggaggcaaaccctagattgattttgcgtgcgttgcatggaggcggggactcaacttatatagagatatcatgtcacttgatcagggcgcctgcacgctctccactccgcgtaactgaaccggataagtcgcacgtaacttatctagactccacgccgtttcaagcaccggattattcggagtgtttcccaaaaaaaaacaaaaaacaatttcatgcatcaaaataaaactgcaaaagaagaccacatctgcgcaagagtaaggaaccaattttgacgaactattcgacgtgtagtcgtgcatgcacctcgcctcgtgtattcctcttgttacctccacctcacatgcctcacgtggctaggagagcatcctcccataaggtggcttttgtgattttccaaagaattaatttttgaataggctaaggcccatctattaattccaacagcctcatgatgtgttgttttgtgcaccttctatcctcaccggtagtatggctctatcattgatggtgacatcttcttacatagatctgtcaatcgaggtcagtttgagcatgtagcagccttgcaggcaattgagcttattaacctgtgttttaactgaaattttatcttttcaggttgtatgggaagataccagggcaaaagtaaatctgcatcccatcttgtagttctatggcttttctgggagaggttaaataacatgtacttgtaatagtacggtttgtgttaagtatttgccagtttattggtccgttgccttctgctcatcgctgttaagtatttactggatattgcatgtattcgaattggataaaaccgcgttattttctcccagaagaacttgcgagctgcaaatctacaactaaagcagatatagagataggcctgttatagaggcgggcccaaggtattcaaaataggaaaaaatccaatttgactcccttaaatatacgtcgaatcttattcatatccttaaaccacaaaaccaaatatgatgacttcttaaactattaaaaccgtctaaaacgactccctcggctgttttaagagtggttttcgctgacgtggtgtacatgtggccgcctagtcatcaaataaattaaaaaaagttaagctggcccacatgtcatcccctccctttaataacctctctctctccctcctttcttcttctcggccccttccgcctcggcactggcgacggcggcgtccggcggcaagtgtacggtgtcgagggcccgacagcgagggcgtcgcttgcggctgctgggcccgacgacgagggcgttgactgcacagtgagatcgacgagatcctcgacctagcggaggcccagcctttccccacggcgtttctggccgctgcccgcctcgacagtgccctccgtgtcgccatgtcgcgcatgacctgcacctcgccgtcgacaagctcacggtcggtgcttccgccaacgccctgtggacacgccttagattgtctccaacagagaaggcaaaacgcaaaacagcctccaacagacaaagcaaacagaggaggcattttgcatatgaggagagagggaacgcaaaattgccgtctctctccaagacgcaatcgtccacacgatgtggcggtgagctcgaagatccgcatcggggcgcggcggccagcggacgatgacatcgaggcgagcccgcggccggggtttccaggcatgtctacgacggggcgaggaggccgacgacgaatccttgtcggggcgcggcggcgcagcgtggtgagcccgcgggcggtgcttgcacgacggatccacgtcggcgaggcagcaaggtatccacgtcagcgaggtggcgaggcgaggaggatctgtgttgacgcggcaacgaggcgaggcgaatccgcgtcggtgcgaggcgcggcggatgcccgtcgagtgcccctggcgatttggtcggcttcttggacggcgacttcttggaagacctccgctgctccacagcgtcgaagtcccgcgggaagaactcgatggagccgaggcggcggcggtagagcagccaggccgccgccgctccctaccgccgtccccaccaccgtccaccgctcccgaccgccgccgccgccgctccccaccaccgctccgagcaaggtgaaaaaagagacccgggagggagaaagagagataagggggagagagagagggagagagggaggaggaagaagggaaggagagggaggatgacatgtggggcccacatgtcggtgggtcccacttttttttttttgtgtgtgtggatgatatgttggtcctacaaatttttgtttttttgtttttactctaattccacatgagctacatgtcgacgacacgtgggacgaagaccgggtcaacaccgtcacataggcgccacatcagccaaaaccgcttgcaaaaccacctagggagtcaaattgcatcagtttcaatagttcggggagccatcttatccggttttctggttaaggggtacgaattagattcggccaatatttaagggagtcaaagtggactttttccttcgaaatatgaagggataaaaaaatacaatatcaagcctaataaatgatatgtatgtatagtttcgcatagttctaaactatataatatataatggctataagtatattttcataaatttatagaactggtcatgaaatgaattgtatgtattttaacatatagccgaatgggctgagttgtggcccaaactcagtgtgggctgagaggaaaggggaggggagtggggtatttttttcatttttagattttttttaatatttacagaaataatctatcggccaaaaaaaattgcaaaaatagaccctgccgtccagaggtgggcggcaagctgacgtggcagacggcgggtcgaccgcgccgtctgccgccatcggccaaaattgtaattagccccttgccgcccatacagagggcggcaaggggctaattgcaattttggccgcccataaagaggttgcgctcgtactttgtgcatttgggccccttgccgccccagtagagggcggcaagggacccagatgcaaaaagtaccgccaaacgatttttctatgttatgttaataataaataaagaattatttattggtaaaacttgttaatattgttataaaaatgtattgaagttggttgtttcgcaatttcatatgttaagtaaggtattattttgtaacttattcgacgtattagtactcggataattaatataggcctatcgcagtctcggtcgtagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaacactgtattgctctgatagttcaagctgcacaacacggctaggtggagttagaacccttatggtgtctatccattctctgtattgacatcttcttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggctttatggaacgaagaacctgacaacgatcaccacacctacatcttggacgggcttcccatggagggagtgccgtagttagcacccgccagtcgctctgttgttcacgacattgtcgttcataagccgttttctctgtaagtattgctcagtactttcggatgcgaaataccagcgaccttcttgtaaacaagtggttaggtcgagaacgggattatctgtatcgacccactcgatgtatgcgcaagccgtagtgcgggtttgccgaatagagtagtgttacgaagaataaaacgattgcccgtacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagttcgaatcctcaacaccccggcgtctagccattgacgaaagccggtaggatttgtaatgaagcaagtagggaagagagtactgaatgtgactgagttctgaaagattgtgaggcctcactcgttaaggcgacttatataggcgcaaaaaatgagtgatatccctgacatgtgaacgtggaggggcatggttggtacgcctgattggggctgaaagttacatgcctgatcggcgccgaaagttacattggttgtatgcggcaaatggcaggcaaatactcgtatcgcacgcgaataaaggaggctacatcggcgtggcagaaagtagtcgtgcatgcgccgaaaggtatcgtgcacatataacaacaacgtattcattacacaagcatacagtactggaaagtgaagcaaataaacaaagagaagaatgctctactggccctaccccgcgccgcgaccacgcttggtcctccgggcctgtgctcgcacgtggtcctaggagtaggtgaaacgatccggtggcacagcacgggtagcacgagtgtctggcggcggagtggcctgcgcctggtcctgcgtctgcaccggcggtgcgcctcccagctgtgaggggccgatgacgtcctccgtcgagcctgaagcgaagtcaaagtcagtgatgtcgaagagcaaggtggaaggcaccaagtggtccgacgaggtcccagcatggtccagtggtggaccctgactcgacgtgccggctacctgtgacgaagtcccggtgtactgccagaactgcactgagtgcgaggtcgacgcagctgcctgagacgctgaccatgcagcctgggagaagtgggcggcctgcgtcatagcgaattgggcgaaacctacacatcgactaagacgctgaccatcgcatttgctgcaacacttcaccctgccagcctccgactcatccatattgttgtggatgcgacgagtcttcctccttacagccttgcctcggagcttcgatgggtcaggaatattgagtacttcatcgttagtctatgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaaaagcaatgacatgtgccgtcagctttgagaacacattcctgcttcactctcttgcggtagatacccctgcatgccttatcttgacatagtatctcaaacctgtgttgttgggtaccttgcactagagctcgatgtttcatggcctttttacgcaactcctctagctttttctgcatgaaagttccaaacaaaatgctgttgttcggcatagagggaagaactgcctggaaccgatccctaaaatacctgcatgtcccatgtaaaatgaacttcactatgccaactagtggcagtccacggacaccgcgcatcacccagttgtaaacttctaccaaatttgttgtcattattccatatctagcaccacctgtgtcatacgccttggcccatttctcttttggttcatgcagaatccactgagaaaatttctgaatctccaatctagttcttctaaccaatgttggactatccgttgggagaggtccaagagcttgaggagggtcagtaacggcagtcaatggagccactgcacgctgatcactgcatttggctgtcaactcatctaatctattccaaagctcattgaatttttttctcctggttctgattgcatagcctcttaaacatgttcatgagctccttattcttgaattgcttgaagaaattagctcccatatgacacatgtaccacctactctgtacatcttcccacacaccagggtatcctcattccatactcccaaactgcaactcttctatcgctcgcagaatgctagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaatcgaggggaatttcttcactgcgtaagagctcccagggtttctttcctcgataacaccaagcaggcgtggcaaattgtcatacgaggcttcgtaagttccaaatctcatctctattattttctgtttggccctccaggccttggcatagctaacagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatacgcgtgcactctcagggacaaccatcttttttccttaacacaccgaacttcatattgcgccgggttggacttggcaacccaaaactctctatgaagtgacattgcaaaatgttttaccggctccttcatatcttctgctctactataaatcgctccctgaaaacctcattttctttgtactcccatctcacactatcctctttagagacaaccagccaagaaaattcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccatagctagaggccacccgcgttacaatgcattttccacataccatctccatacttgagaattttgaactggcattagttcccaataaaaaccctcagttgcccgacttactataacattgattgttatgtcacttgtctgtggatcaactctcaagcctctcattaaccatccttttatagaaggtacactcctctcaacaggtctatcaattcccctttctgatacaataaaatctgacagatctaccccagttggcctgtaacggacgtttcctgggccatggtaaacttggaatatttgtttgttcgacatatctgtcaacgaaataactagatcatattactctttcatgcaataaacatctacaacgtaatatcttcttgtgtatgccaatgcaacggtaaagtattgattccaaactagcagatctacgtagttaccgatatctacaatacgcacttctagattagtaaaactaaaaccctaaaaatataatgcatttattcaaacaaaattttaaaaaatacacactatttaactcaatagtcacatataggatctatgaatattacctgaaatcggcgtctgaatccggcagggcttcgccccttcttctcttctcctcccctttcttctttttcttttcactggatttgaggggggaggaatgagggctgg

SEQ ID NO: 14013 - DNA, 27640 bp, Oryza sativa
  unsure (1)..(27640): unsure at all n locations
ccggccagagggcggcaaggggctgcctgcaaaatggccggccccgactggcttttttttattggggccccttccgccccaacagagggcagcaagggttttcctgcaaaaaaacctccctccgtcaccgcccgtctctcccccgtttgccacgtcagcttgccgccccagaggtgggcgacagggtctatttttgtaatttttttggtcgatagattatttctgtaaatatttaaaaaaaatctaaaaatgaaaaaaattcggggagtgggaaatttaggcctaatgcagaagggacgatgaaataggacccaagatgagtaatttaaggcttcttctttatttttttaatacatatgcgaagcatagagtatatatacttttttttcaaaaaaatcttgagtatacatcttaatacccttgaatcactactgggcccgcccattggtgcagtcgaagcaacgactgcaattttagcagctgcagtgattgtcaaactgaagattgaattcgatgttgttctaaagaatgggcgtgtaaatatgagcactccacgtacagttaaaaatatattgcatgtaaatatattccgggagaaacgaccattttcacgtgcaggacaatcacagtcagccacagggcatgttcagaactatttcattttgcaagccgaaacgtggaaatgaacaagcatatcgcttacagatcataccatttatcttacaattatcattaagagttatgagatcactaattcaatgagaaaacaattaaaagaggatctgaattaattttcctacttcagtaaactataaaatccttaattttccaactttacaatttcattaagcatggccagcacaaatctctatggttgatgagatcttatgatattgggatttcgatccaaactatgaagtgccataataaggctgagttcttttcccaacttttccaactcacctctcttgttttccacacgcacacttttcaaaccgctaaacagtgcgattattataaaaaaattctatacgaaagttgcttaaaaaatcatattaatctatttttctaaaaaaaagctaatacttaggtcttgtttggttcatgggactaatccattagtccatctattttagtcccaaagaatccaaacatgggtgactaaaagggactaaaagtgcatattgagactaaaatccattagtcctcttagagcatccccaggagctagacatatttcatcctccaaatacccatatggatagtcatctaaaaaagattcctcattcatatcccttcccactccaacagatcatccatatcccaccctcctatattttaatatcttccaactaaacttacttttacttttgtatttttaagggacatattttgaactactaaattttaacggtgttatttatcgcgataatatttcaaaatgagtatatttaacggatatatttttaatagataattttttaatttatatatttgaattgagtgaagcattttttggatatattcgcagcaacatcaataaaatgaacacaacaaaaatatatcaacatttgtactctattcctatttccttttctctactcaggcagcacagtcatgaacatactgctactactctttctgtagaggaagcatgtggctagcaggcgcggtggcgggtgagctggcgaggggcggcggcgggtgtgtggccgagggttggcagcggccgggcgggcgaagggcagctggcgaggggcggccgcgggcgtgcggcggagggtcggcggcggtgggtgtgtggctgagggtcggcggcggccaggcggatgggcgaggggcggcggcggacaaccggacgagggcgcggatgggcggggaggaggcagacggcgggaggagaagctcgagggcactgctgcgggtgttcgacggtgggaggagaacctgggcgcgggtggctgacgacgggagctcgtgctatcgcgaaacctccagatctggtacgcctattcctccccaccttcactgctctatggctccagcagccagtgtaccacggcgtcgcctgctcgttccggaggagggcaggagctcgcgacggatacggtggatgggatatggcgtgaggagagagaaacgccaaatctctctaatatggagcacacgctatttttagatgactagatggaagatctgctggagcatcaatttccttaggacggagtacgggatggagttgctgctggtcatgctcttagagttatttataggaactaaagtggcaacctctcttctctctcccttggtctatgtacctttagttcctggatccaaacagtaggggactaaagtttttagtcaagagagtaattttagtctagagactaaatgatctaaacatgaccttaattaatcatatgctaatggactgctccgttttatgtgcgcagaagatttgtttccaaccagtaggaacgaacacagcctaaggtatcatcagtctgttacacatatttttaggagcaacccaacctgtttatcatcagtaatttgccacaatgtgctgtaaaaagtgggactgtttaagcagagttccagcatgtgggctgaaggtatgtgtctgaaactgcacataaaattcatatataaggggataatgaaaatgtcacataagattcataaactcaaaggttgctaataatttaaaacaagatctcgataaatcatactcccttcatcctaaaatataagcatttttagtatagcgacaagtcaaacgtttttaactttgactattaatagcaaaaaaaaataaaaacatcaatcatataaaattgatgttactagatttatcattaaacaaactatcataatatgcaaccctttttatttaaaacatcttacttttatagatattgttgatcaaagtagtatctcggagactgttcagaatccaaaaatgcttatatcttgggacggagggagtagcataactgtacaagcgaaaatattcagcacaactgtaaaatcctaagttcactggttgagttcaatattttcgatgccaattttttttttgacaaagggcatatagccgtgctttactgaaagtttagggccccttttgaatcataggattgaaaaaatagaggaataggaaaaacacaggattttgataggaatgcaaatgtaaaacagagaattgcaaaacacaggaaaaacacagaaatgaccgtttgattggactgccggaaaaacgcaggaatcagatgagagagatagactcaaggaagttttccaagaggttagagtggatgttaaatttcctatgattttcctctagaatcgtagaaataggaaagtttcctacgtttttccttttttcattcatacgaatcaaaggcataaatagtgtaggatttcaatttctttgtttttccactatttttcctccaatccaaaggggccttaaggtttgagatacagcagttcacaactgggtttgccagctaaacaaacaaagcccagaaacacaaaaaggccttatcctgcaaagagaagtactacaaaaccaaaaaaggggcagaaacggcaagcacccgacagctacagaagctaaagcacaagattctcacacaacttcagcttcccacgttcatgttttggtttaacaaattgtttagtgtgccccaatatcaatacgatctaaaattacacaattatcgaacttcaatacaaagagaagtggcatacaattaacaaaacaatatgcagatttacactagcactaatacttttcacacgcaaaaccggttgaaggtgaagccacaatttttacctgaacttcacggaatcggcgacagcgcaataagacatcatcgaatcagggttcagcaacggcggggatgaccctggtgggggcaagatggggcaggcatgacgaggacaaacagcgcgggacactgtgccgacaaagcctccggatacgattttgctaaacgttagatggccataaggctcaaggctcggcacggccatctggcccgacccaaacatggcatggcatgactggtgacgggttcgtgccggcccagcccgacagttgagccatgcctgtgcagatgacttggcacggtggcgggccggcccagcatggcacacggtccaatgagtagcaagaaaaatagtagagggacccaaaataaacttagttgccatataaacttatcgcctaaagagaagagggatgcaaaataaacttataccaaccatataagacttggaaaaagtacaccgaaggtccctgaacttgtcatcgaggtaaaaaacgtcctcaaaccgcaaaaccaaatattcggcgttccttaactaatcaaaaccggtcacaataggtccttcggtggttttgaacccagttttatccgacgtagtggttgagtcagcgtgggatccacgtgggcgccacatgtcaggatgccacctcatttctctctttcccctcttctctcgcaggccgattagcaacgggcggggctgagcggcgcccgacagaggtggcgtgcgagcgcgcggcggctggcggagcagagcgacagcgggcgagtgcgtgacggagggcgaagccgccgtacttccccactgcagctgccgtcatcgggaggaggagccgccctcgaccacgcgaggacgcagccgagactaatcgacaagacaatgatggacgctccgccgagcaagcgcacttgcatcaccgccggcagcagcggcggcaacgacgatgaggccgatgccgatcggctaagctagctaccactgtcggcggcggcgaaaacaagatggcggtgcagtgggacaagctcgagtccatcgcctacccgctgctgctcacccaccgcaccaggacactcgagaggttctggatgtccgtcaacgtcgcccgcgggatggacatgggatgccctccgccacgtcgtccggtgggtgcactgcggtgtccagtgcttctccgcgccggtggaggtggaggtggtggcctagctcactgctttgtcggcgcccggcggctcgtcgacctagacctccccgctgcctccaccggtgactgctactactaccgcctccggaggctgcacctcaccggcgtctcgctcggaggccgcttcgtcgagcaagtccggttgcgacttccggtctggaggacctgcggctcagccattgcgccacgagcttcgccgatatcgcgtcgcggacgttgacgaggctggtcatccacggcaatgccggccgcggcagcggaagcagtggggagctagcgtcacggctccccgactctcctccctgtgcctcctctctcactggcctccaccgtgcctccgtcgtaggcctcggagccaccgtgctttcctgctgcagccgccgcccgccaccgcccgcggccatcgcagctccgccctcctcctctcccgcgatagagaagactgagagagaggaagggagtgaagagaggaaagagagatgaggtggcatcctgacatgtggggcccacgtgggtcccacactgactcagccgccacgtcgaacaaaaccagggtcaaaacagtcgaaggacctattgtgactagttttgattagttaagtgatgccggatatctggttttgcagtttgaggacatttttgtaactctatgataagttcagggaccttcggtgtactttttcctataagacatagcccaaagagatgagggaggcgaaatagacttattctatggagaagcataatgggctatcatgctttcgggctaacccggcacgacccgagtcttattgggccgtgcctaggccgttggttcagcttgtgggcgggcacggcccggcccgacgtgtaggtcgagccgtgccggcccgattgacctcgattcgggcccagtcgtgtttgggctgtgctaggccggatggcccatttggccatctataccaacggaactgcgattcgagcaggtctcacacgtagagtcggtgccactccttcagatcaatgcattagatcgcttctcagctgttgaatgaaatgcagcatagttagatgaatatagagctctacccatctcacatacaggcaccgggtgaggcttgtaccacgggaggccattctattttgtactataagtacagcactaatacaaggcaatcatctttgtgtgctattctctctttgcttgcactctttcaggatagaaagactggaaaggcatgtgaaccgtttgaaccggtagaaccgggcgattttgagtgaaccggctattaaaccacctggttgaaccgacaaggctggaccactctcaaaatgggccacatcaaggcccaattacttaactagcccaccttaccatggttcttttggcaaaaataagaggaaaaagttgctccatgaggactcaagttgagtcactcaacccctggtctccatgttcaaagcgagctgcgctagccaactaaccatccaagcaactatattttacaacacatatatagggagcatatattttgtgaatcgtggttaaacggtctgaccaacggaccggtgaaccaagggatcgaccgggtcaccagtcggtctggtttttcatactatggcaagtacccgtgcgcgtaggtgctctcaatagagaatataaatagaagagagagttcactctgctatctatcccggagatgcgaggttaaccagcacgagagaaacttaatggctcttctgtaacggctctccgccaggtacgttaaaaaaacgtaacacctagaaggagagcaccagtctcgtcttggcgcgcgtgtggcaatcccaccaccacctcaaccgcccaacgggtgctcttaattagcaacctatttaagtcgaggtccctccacattgctttccaatatgatattaatcccttaacactaattatgaattcatgaaatttactagaattaaattggacctagtccatttaattataatgtttcgtgaattatgtggtgaattagaaaaatgccaaccatgtcatttgacctgtccaatttctagatttatatggttactatgtagagatgcttttatctggaataataaggctcctttaatttctgatcagttctttgaagatgctcttatctggaataacaggagatatcaaaagtcaggaggataaagtgaagatgctgcttgctggcaactctggattaccaggaatcggctaatataaaccgtggaagaaggctcggctgctgggtgcttccacgtcagaatgaaacagtatgggatttactgttttcttccctttcagttgcaattggtttagaggaggggaagtgtttacacctaaatttggcacctagaagtaaaataggaaatattgccaaagtttagaagtatgtcggtttcctccgagtaggctggtctaaccgccgtgtgttggcaggtcagaccgccggttgagggccggtcagaccggcggcatgtggccggtctgaccagcaggtccgagtctgagtgtgtttcaccgggtctcgaagtttccttgctcgggaaggaatgtttcaggtttcctttggattctatcccgagttggacgtggatgagggtttgtagagggcaagaccaacccctatataagggacatgccggttcaattgtaactaatcaatctacaatcaatcaattgaatcgtttttcatattgcttttagttttctcttagtttgtccatctctgttgatttgcgccgtaaatcatccgccgccgctgtgagagtgcgacacttctttgtaggtttgtcctgaaaaccttccgttttacccacgagacgggtagttatctaggaatcggctccgctagccggtttagttatcaaaacctatcttggtatagcttttgctagatcgaagtgattggcgactctagaatcaccgcaaggcgtttaggtgttgtgatcgtgcttgtcaacttgtcatagaaagttgccaacaggaagcttacgtgataagaaatacgatctgctaattctagaattctacgcaacttttcatccgaggcatcgctactcactccgcttttctggtctctcttcacgcggcgctccgatcctcctgtcctctcaccgccgccaccacctgctttggcttggtcagtgatgatgatggggagctccggcgccggatcaagcaccgtctgtgagcgatccctgtattgatccctgtattaattcttttatgttctagggttgtgcggtctaacccggttcttggtccgacctccttctgctgcgcttcttcgcccgatctggtttcgcctgttgttgatgcaaggtacgaattggtttggattgattcagtgatgtttcggcgtggattgctgataccgattcctattgctattaattttggcaggaatattgatttgatcaagcgtggtactttcttagcgctcgatattcatgatctagggatggcaattgtgcccgtttacccgtttgtagaaaccccattaagattgggtatgttcttgggtattttgttgggtcaaatgctatacccgatgggtaaacaggcatgtgcataggcaaatactactcattacccactttgtccgtttacccgctaactaatctgtcatgtggggtcatgagttaatattatcctcatcaatttataacacatccttgcgttactatgatcttatagtagggtcatgagaattctctatagccatcggggaggatgccagagaccatccccaaatccaatctctccttactcccttcctattcgctcgatgagaaaatggatcatatgccactatatatgtggggtttcgtgaaatgcaactcaataaaatataatgaataaaataccacttagtatgttgcctaccagataaaatgccactttgagttctaaccattttatgaccaaaatacccctgactatagagaagggggagcgccagggagggccggccgggtagcaatggaggcctcactgggttgatattagtgatataccctataggcaatcatagagatgattgtatcatcgactttgttccttgaaatagataactcattattggttaatgaatatgtgattctttcatgagactctttatgttatgtgttgctatttctaaaggatcctgatcaaatatcatatgtggaacaaatatgtttagatgatcagcaaatgtattaattgatgatcatgtctcatggatcatggtatagagataccaaattaataatgtggacacatgttagtgaacatgttgttggatagacccaacatgagacactgcaagagccatatgtgttgtgtcatcagtgatctcatttagtgttgatgttgaatccttagacctgagattatcatggttcccaacatgtgtagtagcttacttagggactgctaaacgctactctgtaattgggtagttataaaagtagttatcggatatgctatgaaacatgtagtggaatatgaataatcaagatgggatttgcccctcctatggagagatatctctgggcctctcgatgttgtagattatggaagtgcatggccatgccaaaggtgattgaggagtcaatcacaagttatataatctatcaacaggttcgagtgaatgattgagctattagaggatggcacatatctagccttgagcttaatcgatatcgtgaggcaaaggagttcatacaagtatacactagagattcagccaatatgatctttatgtatgtccggtgggtcaatacgttctgctaggggccgctgttgtcgcgtggaccgaaaaggagttttcgggttacagccgaatatacatgaacctacagagtcgcacgcttaatgggccagaataaggggattggatgtagatccaatataagcttaattcggatagggatccgaataggagtcctacgggccttggaggcccgagtgatggatcctatatattcgtgaggggtgtgaccggcggaggcattgcatcacgtgagaaaccctagccgtcacttccctccccgagcaaaaccctagccacgcgcgggtgctagcacatctgcgtatggcgttccggccctgtacgtgtggataccggtagaggcgctgctggtttgcggtgctgatcggcatgggagtacggcgaggagaacacacgaggaggagaaggtcgagccggtgcgatcgactacttcctctacatcgacgcgcgctacttcgcaagaattccttcgacttcttagcgcatttttccgctgtacagcgcgttgagtggtaatgatctatgatctaatactttcatggttactggtttatgcgatagaacattttgatttatgctatcgtagcctacgcatatcccaacagttgaaccatcgcttgtgtggggaagccacgtatggccgccatggctagcccatgcacatgtcgggccaaactcaacatggtcagcgttgattcggttacaacacttccaaagagaagggcccctacgtactgtccggaaagatcaagcatctcgatcacggatctacctgtcgcctaccacctcaacctcaaacagaaggtgatcaccattgctgccttagccccaaagagaccgccttcgttgcggaaaccagcggtcatcgtccccgtatttgacaatagggtcagtagatccatgtcatcgctgccactacagccgttgtcatttagggcctcatcgtttggattttttcgtaataagccaaaacggcttattagagaataagaatgaatttgtagctaaaacttttatatatatgttctcggtgacttaaaagccaatgctgaaaaagaaactacgttgaaaatatcttaaaatcaatgtcaaaattaagtttgaaaattcaaattttggctttttctttggttgaatagaccatccgatggaagcttacatcttgctgggacttatggaatgagaaggctctactgccaccacggtccttgcaaccgcacagtctgctccagtggtggcgaagcagggaaaggactggaaggaagcggtggtagtgcaacatcgtcgacacccgagtcactcgacaagagcgacacgaggacaagatatctggtacaggggttcacaatcccaataccggatcaaaaatcactcatgggcgatatctttagattttgtggaaaccattgataaatcgacaaaatccggataaatcttgtcaaaaatttaaacttctgtttgattctttttaacttaactaaaaacggagcggtttgtttttccgacctggttcaggaagttcggaattcggattgtaaaccctaatttggtataactctgttaaagtgtaaaatagatatgattcaattatttagaagctctgaaaggaaggggattattttgtttcgaaacacaatacgggtccaggtaccaatataaacacgtgcacactcacccttaaaaatgcacatacacatcctacctctatgagtatcttcaagattgagctagcatatcacatatcttcatattcacaaagtcaccattgggtctcgcagtcggtggtatgtcgtgtaccagtgaaagaatacttagtcgtaaatgcgaatgctcatgttaagacatgtacctaaatggatagattttaccaaaaaaaatgaactagctgagctacgttcactttgtgaaaagaagaggattataattagagatgaaaactattggaaacggaatcattttttattatttttaatgaaacagtcggaaatggtcagagaaattctctatatttaagaatttcactgtttagtattaacttcagtgtgatggtgacaaaaattaggaaaaactaaattttaaaaaggtaataatcgataaagatatttctattatattaattatttaattttatggaagggagtagctatatttatggactcatattttttttaaaaaaaagtcagcatacatttacattgtaagtctctaaattacctatgtaattttagtgtgtttacaatgtaaataccaaaattacaagtaaatatcaaaatatcggtatcgatccggtcagaaaatttcctaccgttttcatctttaattataattcatctaagatcagacttcttcctttgttacacattcttatatgattcttataatagtgttgctttccactttgcctatcaactacagcttgttgctccactaagccgttgactatagcaggacttgtaaaggtgtacaaaagatatacacagtggcagacacaaaatattctgaaccttggcgagtcgtcgagcccggccgattgctcaggatctctgggcccctaggtctgccgctgaatgcaccctatctgaactcttgtcaatagatacaccaatatcatgaagaggtcctaggaacgtggaacagtaacaattggtgggaagaatatcagatggaatccaccaatttagtgaaaccatgacactaatactacactaaatatgcctacaacttaaaacaatttaccaaatgcaagattgatagtacactgtattatgtaaaatttcaagatcaatcttaatttcgctgggaagttatgaaattgacaaataacgaagcgagcacggtcgaaacaatttaattcggttgcttacgatttgatatcactagttatgaatttcatatatttcaaagaattgcgtagtattaaaattagcagattacctacacaacacatggtatgttctataactttctgaaaattcttcacagtttgtacagtggttttcacaatttgattgggctggtggttccgcggtacttgacggtccctgctgagtgcccagtgcacacggtaccatcgagctggctagccacgatgagctgccgattcactattgctctcactcacgaatttcgattctgtcagcgaaatataattacactcagattaacagatagccagagagggtcattaaaaaagctagtaacttttcacattatgtgcatggtggttattcacatgaaagggaaaaaaaaagactagaagtgctttctcttctttctttttttttcttttttcttaatctgatctgaaagcaaaatttagacccgatccagaatcccttggtcctcctcatttgccatggccttgtcccctttcttgtactccccatagacgtaggacgagaaggcccagaggcagagcagcatggccaccgccttctccggcccgaactcgtcgccgaacaccaccacgccgccggccacgttcaccgccaacagcgccgtcatgcagatgccgccgtgcagggacgtcgtcaggaacaccgttccggcggtgccaagaaagcacagctgccagctaagcaccgccgccccgaccaccgcgtagtaggccgccggcgacagatcccacgtggcctccacgccgtcccacggccacttgccccccgcggacgacaccatgccggccgcgccgacggccgtcgccaccgcctccataatcacctgcgcctccaccaccatccggaagcccgtcaccccgccgtgccggtacacgagctcggccgccggcaggtagagcgcgaagagcaacgccgcgccgagggtcgccgcgacgccgacgaggtagtccgggctggtggcgtccgcgccgccgccgccgccgcccgcgccgtggcggagcgcgaggagcagggacgagagcgtgaggagcacgacggcgttgaagttggcgaaggagagcggcacgcggacgagcgccgcggcgagcgccagcgtgaaagccagctgcatggagaggagtagcgccgtggtggacaccggcaggtacgaggtgccgcacgagtagagcaggttgttgagccccatcaccagcccgagcaggacgcagtacatcaccaggcgcggcgtgaacccggcgaacggccgtgacgccggccgccgcgcgcacatcagcggcagcaggagcgccgggaatcccgccgactggacgagcgtggccagccaccggtcggcgccgccgtgcgcgaagtagaaccgagagagcaggctggacgagagcgacccgacaaacaacgccgcgtagttcgccgccagcagcagcgcgccccgcgccgccctgctcttgagcacagggaactccacggccgccggcggggagcagagtaagaggcggtcgtcatggtgggcgtgggcgaggaggggagtggtgggagagtggagcttggcggctgtgtccatcaagagtggaaggtaagggagggggagagggacaggatgggggtttgcagtttgctgccttccttgatgtttatggtcgtctgcaaaggcagagaggcatatttcaagggattttgcaaggtattttctgtgtaaattgagcaccgttatattaaacccaagttggtggcacacgacatggactcgtcgatgatggatcgtactacgggtactccagtggagtgcaattatttgctctcaaaaggatgccgcccttcgctatcactgatgtgtcccttcttctttttttccccttttcttttggggtcctacatggcaacatcctccgtatagattaataagcttgtgtctgaatttcccttgaatagttatgtattagtactagtctccaacgatcaatcatcagctctgtatgtattactagtaggagtatctctgtactctctgaagaacgaacgatggagtatgtagtgtgtacaagtattatttctttcccctctgtttttggatgattgctggggaataatatctcgcttgtctcacatgtgagacacaagggggagagaaattcctgtgtctgtgtgtcaggtgcccggaaaactcgctagaaacgtctgtgctatgcacccagcagagcactgaaacagcacattttttctggcatccggagcgttgtcgttaccagggagtgttgggggcgatttttcttttcttcacagctatgacgacatcgcgtgatgaactggtgacagacaagcttttgttattggggggatattctgtgctgccaggtctgttctttcgtgcaaacatcttctgaaagaagtcccctatagtgcagtgcaaaattacgcagaacatccgtgtgcatcaaagtataatttagcatcaaagtatgcataatttatacagtatgcttccaaacacaagctacagaaggcttaaacaaacacatgtacacgtcgcaatatagtactataatataatagagaaaacaggacgagaaacagcaggcgtacgttggacagggagaagctttggtggaaggtttcggtgggcatgaaatcaatcggtcagatgggatctactccctccgtccttaaaaaaaaaaaatcctaaatttccgtgtccaattgtaattgtccgtctaatatgaaatttttttataattcgtatttttattgttgttagataataaaacatgattaatattttatgcgtgacttgtttttttaattttttttataatttttttaaataagacggacggtcaaacgttggacacggaaatcagggtttgtcttttttttttttttttttttgacggagggagtatatctgtatctatgtatgcagaagaagaagaagaagtgaagaagaagatgcatggtccatctgccggcggaggggcgcgacaacaaagtgatcgaaaaggcagcgacctacctatgcagatcgtaaaacatgatcggacatgggcccagccgttgcagcttttcaagagccgattgcccacagaccgtgggacaaaaacctgcccacttgatggctttccgcatctcgcttctctcggagtagctagtgggcgcagcagcagcgcgtggtggtgggtaggcgatgaatgtgaagttcagtggtgtaccagtacagccgcgcctgggtcgtccctatcaacaaatagaaggggatttaggctctgaaattaatttaggctctattctgtgctactttctttttttattccagcaaatcaatttattacgcctaagaaaatgtattacgtccatctgcgaaaatattcccaccaaattttctaatagtatattttaatcaataatgctacaattaattaactaatacataaatatatggtaaattttgctataggacattacgatttcgtgattttagccgtaagacactgtacaaactcccttttgggagaagacactctctaaacatggttatttgccagcgaacaccgtgccgattaaaatagtatattcgtgctgacgaggcgaaagctgaaagggggctcaaatatttacacagagtgaccaaattgcccctcatttctctccatcttcttctcttcttcctccctccccagcatcaacgcaacagaggagccggcatcgaggtggcggcctagaggaggcgagggtggcagatccacgggcaaagcctcttgctgcaccgtcgacgcaccacctcaagccatgggcgcattagcagcatccgctgccgctaactccggcccatgcactgcatggctctgatgctccgcgtccatccctgcatggcgccctagctcctcccagcactcctccgcgccaccgcttctccggatcgaggacaacaccaccttctccgtcatcctcctcaattctgattccgattctggccagcgtcctctcctgcaactgtgccattggccgactcattcctagcttcctcgtggaccccatcgtccaccccatcggcttcctgctcggcatgccggttttctccaccccgactcgtccgcaccgcttcaccacgccggtcgatgccgcccttgcctcctccaggccaccttggatccacctccaatgccggctcccctgaaagaggatataaggagctaactgcggaagtggaggagtagtggtggagccacgttaaaactgtagggtcagctgaccccacatgtttttgcaacatacaccttgatcatgtgaaaaatagtgaaaaagtacataaaacaaagaaaatttgtatggattgaccccacatagttgcatatttatgcattttgaccccacagggttgagaacttggctccaccaatgtggaggaggcgaggaaggagggctggccagggagccagggcgcgtcgctgcttgcgcatgctgaagggagtcgggccaccatgctactgcgacggaggtagaagggggggggaggagggaggaccgaccccttagcgtgagcccgggaacaggatcgtgctgccccgccgcccgcgcgtgctaaggggagcggggccaccacaccaccgcgacggaggtggaggaggcaaggaaggagcgtcgggtggttgccagcagcgagcggaggtggtgttgtggcttgagtgtgagagggagtgagttgtgggggaagaatatgtcaagtgggcccagggctatttttgacctttcacgctatttatctctcctattcaaccagaaattaatattttaatgtttgcagtgtccattagcaaataaccatattttgagagtgcattcccccaaagatcgacttttgacgtgtcctaaagctaaaaccacaaagtcgcagtgtcctgtggcaaaatttgcctaaatatatctagcaactaatagacatgtaatacggatataatacacatatattgtatgcattagtgaaaagtgcaggccatacaataagatttacagtaccgtcataattatggattatattgttaattacacaagcacatgactccactccccaagaaacttggactcttcacttatcgctaagctgccttcgaggttgaagaacagtccatctttatggtagcactcatggtggatgaagtggtagaggtcccgctatatgtttttagtgccttcatcatcaaagctagttcgatattcgattctagacaacagcatgcacgagaatatatagcaatatcaattagatgtgcattctatcattaaacttatactttgagttgagagaattacattaacccggaggaacacgcaagtataatatccacaaaggacacaacctttaggttccttgtgacacttcattatgacatacatatagaaggaattagttatacacgcaggcaaaagaaagtaagtaaataagtgtgtagagtatgtttagtaattatattctcatatgtatgcactagcaacttctccctccttgccagttcttcctcgccttttgctttgtagttgttgtacgcactgtacacataataggataataaagtttgtattaatgaacacaatttaataattattaacacttcatgatagtacacatgcaaggataagaatatcttactattaattgaaagattgttagaaattgtctatatgacttgtgattataatcgagggagtcgaggactgtaacagtcccatgcttcgggtagagcaagaataaatgtaatgatcgctacatagtaatgatgatttagttaatcatagattaaataaagatatatacacagatctaccagacttacttaaaattttatctggctattatgactcttctatcttgaaaatttaggaatgcttgtccaatatagatggccacaataagcaacttggttttgtgcaagccattcttatattcctttatctctttaggtgtcttgttcttaagctattggaattttcttggagagtgatgatatgatgtgtttgacaaatccttgttcggtccaggtaaccgatgggttgtcgtgtcttctcatcatccatgtattgcatcctaaaaaaatgattattaatcattttcgggattatattgtctatttatttctttgtatgaatgtgcatttatactcacaggcaccatgcaaccacaaagttcacgtccatctttttacggcggtacacgacgtgaaggtcagcgaaatcgagccataaaaaacctacaccgctcatgaaagcttggggcgatgttcgaaacgttatggacgtaagcccttttttgctagcatccctgtaccatttatgtaatcttctcatctcctgtggaccttcttcaagcatgtgattggaccagacgactttccattttcaaacttcgccggtacttcatccgttggaatgtattcctctctagcaagttcatcaaccattttctgatcaatcaagcattccttggcatgttttatcccaactcggaaggtggttatcatccacttctccttttgcttattctctgacttgggggttgtggcttcgtagcacactaggcactttggacttattgttgctgttgtcatcatccttgggtgtgtctatgtcctctttggtggggcattggtcttcatacacatcgagttctatttcttcccattccatacccgttgtgtcttctggatcatgttggacataggacacaagttgtacttcggtttctggtctgtccatcaattgatactatggctgatacagctgcttccccttggctatttgcttgttggcctgcaagttgctcacttcaatgtgtccatcacaaggtgccacctcatgttctttgctatctttttcaacctcatgaggggccgatttcttttgtggaggtgttggtggtttcagcggagcatcgatggaggtcccaaagattatatcctttttgtgccatagtattatatattccaccgcatccccaagtacagctaaaccatcacatgtcaggaagtctaaatcgtatgtcttgaacccttcattcacatgttgtggttgcattttcgcataatcatctggaatataatcctcatgatgaatgcggccagggatagccattcattttgcctcgatacaacgggccaagtgcaattatctgaggaactatataaaccatgatgtgctccatcatattaaaatatgatgcaggaaagcacatctcaagtttgcacttggtctcatgtgagaataaacaatttagtgataacacttcaggattgatgagcttctgtgatattgcattaaaaaagtagcacatctttgtgatagcaacctttacatgttctgatttaatggcccttatagcaatggcgagaagcacggtgaatatgacatcaacaaatcttatagtcatgtgaattgtcacaggatatcaacaaatctttcatgaagactagtcgcctgatgtttgatgagaaatctatgggcactttaacaccgtaaaggcacttgcaaaatgccttcttctccttaggttaatgtaaaatgccttcttctcctcagatgttaatgtgaaataggctggagggagatatactttttaattcttctcaccttctatcgggtgtagctcttacttgattcccatatttattagataggtacgtgatagtacactattctttgtcttgtttggtatgtcaaggacaattctgacagtgttatcaaacacatttttttttcatagatgcatgaaatatatggcatagcaaatctccaaatctttccagtaccacatgtactcaaagaaaatcgatgcttcttgaatgtgggacatgatttatcatctggtttcttacgctttgttccctccgaacattttttcagcccttttccgaacacgcattgtattttctttgtaatggcatgtatttccttcctagttttatgttttggtggtggatcattctcttcgataccatcgaattctgacgtcatcttgcggtatttatgatttatgtgtaagaaacgccggtgacgcatgtaaacaagcttgttggaacctagaaggtaactgtagtaggacccatttaagcatatcacacatcatgttttcactttaatctgccccggaactgaaacattgcggggtaattgttaatggtaataaaaatgatgggcctttactgtaaagtattgtcttaaatactcgtcccacacattcatcccagcttcccataaatcttcgatatcttccgtcaatggttcaagaaatacatcaatgtcaataccaggctatcgtgggccttgtataaggacatagagtaaaatgtacttttgcttttgacaaagcccatgtaggaagattttacatggtcagaaacactagccaagtgctatgtgagctgctcatgcctctaaaagatgaatcgtgatatgcaactgttgaattagcctaaaaccagtaatgattataattccatacctcagtaggtgtggaataaatttcttccaaatccctctcaatccatttgtagcccagcccaaccgacggacgggcccacttatactttcatcctcgcttcgtgtaaaagggttaacccgggagtagcatggttggagggacaatgccttataagcttgtttcacccgtgctaaactagcaaggtggtactgttaacagtgaatttgataagcccggagtagtcatcggcttagagtcagcatcggcttcgaagtcctgagattagccgatgagagttgtcaagtcgtcagttgtcggattcttgctatattcggttaaagaaattgatctactaaagaaagcttatccagaagagaccgagttcaaagagaatgcggcatggcaagttatctattaattaggaatagttggttagtttccttttatctttaggaaagtgtgtttagtgtcctataaggactttatcttttccttttatctttaggaaagtttctttcttgtccgacaaggacttttatcaacccatgggtataaatatgtacacccggggtctatgtaatctatcttcacgatcaatataattcggcgcatcgccaccttttaccttttctactttattttatcgtccggcgggacttggcacctgacgcggggctgcattggtgttcgatctccggctaaggggtaagtccaatgttccgtcggcccaggcaattgtatcgtttacgtcggtgtcgttcaaggctgcatcagtacattcgacctcttggattgctctggtttggatgatatatttgcctaccaatttatcaaatgtctctgttaatctagtcttagcatatcaatttagctctatcggctgcttctcgttttagggtttctgccggtatcggctaaatctcgttgctagattagattagcttagacatctaccaccctgaaaactcagtcaacggcttgattgtctagatattatgtttcttttcatacttagtgctgcatcaattaagtttggtctactaagtcgtgcttagaaccgtaatctctagcctgcttcttgattgccaataagggtttcatcggggtttcagccggtgagttatctggacgttgcatcggctcataaggattgcatatacatataaattggatttagtcgatgacaacaaaggtttcactgtttaatctaatcttgtggatttcatgacatcggacctccagccgatgtgtgctttaaccttcggatcgatgcttatttatcatatcattatttgccgattggtttctactcgactatattgttattacatcatcatcagccgattgcctttatattattatctacattggacatatagccgattgcttaaaccctatcgctatcggctggtatcggcatcggttattatcgactatcggctggaactactccatcggcttgtcagccgatcgactgttttgatctactatttgcatatcttgtcagttgcaggatcaaactgactggcacactcgcatctcatcaagatttggacctgcacaggagctaagcagatctcccaggccggtgtgttcgaatttttcgtcaacacaaattggcacgcttggtgggaccacgaattttatatccacatgtatgaagaagaagtcaatgccaagatcatggtcacggtggagaatttaatggaggaacaacaatattggctcggggggcaagcgcatcagttttagcatggtggagcacatcagtatcggctcatgaaactgttcaaaaaaatgttatatagaaaaatgaccaaactaaaagttgtaaattttgataagttatacaactttgttgttgacattttttccatttgaaatcatttactaccctgaagttattttgagtcataaaatgaattattatactgcacttaattattttgctatagttcaacttacaaatataaacatttcatacgaaaaatgaaaaaaaaaaactcatcggtgacgggctttagttaatgcccgatagagattaagtcatctcaatcgggaattagtatatagcccgtcaatgatgagtcatctgtgatgagcctagttgttatctcaaacgggcctcaagttggtgcacgtcacggatgatggtcatctgtgacgggccataacgttaggcccgtttgagatatggaatgttatctcaattgggcctaaactacggcccgtcactgataggtgtcatccgtgacgggcttaagttttatgcccatctaacatgtctgtgcgaccatatctcaatcgggcacttttcggcccgattgagatgactttcttgtgacggcccgctatttctaggcatattagaggccgtcacagatagaaggatttataatagtgcttaattctattgttgtcttgggagctttgacgttatggaaacatcgtaattgttctgtcttcgacggtacttctcccaacatggctgaagcattgctacttgctagagaagagttgtataaatggggtttggcaagggctaagggcattcttgcccttgtgccgaacactgaatagtgtttgcttgtagtaggttgaggttgtcttttggtatcgtgaaggtctattgtgtgtgttgtaagggttcttaccatctcctttattcttcttaatataacgatatgcagctctcctgtttgttcgagaaaaacaattgaatttgacataaacatccaaatctctaacaataccacggtaactaatctttaacagttttgaaggcatgaacccactacaccatgacttagtatgatgaggacatccgcaccatgcatggatataatcacgccaacggcaagcacacaagctgaaccagtgattaaggatcaatcgctcgagctcgtgtccgtcaacttaattaccatgtagggttgcataagaatgatttactgaattgggtagtactactaaatgctagtggtgatgttattgtgattaggaatgacggtagagatgaacaaaagctcaacgaggatgcaagatagaatatttcggttcagtttgctgcaccaccccaaattcaaacgagcatacccgttgatctaaaaatccatgtggggatttgatagaaagatctcggaattctctttccgacggatccaaccaatctgaatcgtaagagtggtttgttcctagaaaccaaaaccaatggtgttgcatcacctccacttgggcagatgggtctggtttgtcgtagggcgacgtgccatgtcatacacactgtcctagatcacttcatgtataaatactaagccacccccttaagttcatttggtgttttgttagatcataatttaggcattgttacttcatcatgtaattgtgtgcagttggctacatcacttggttacttgtctttggaacatcttagtaatgagtacccttaagttatcattttttgttttttatttttttttcttgccagttctcgattgctcataggaatgagtaccttcgtggtttggttgattgttctccatcaaaatcactaaccttttctgaagttggtgtactggacgctgaggcgcaacgttcttgaaatcatgattagtgagcatcgtttcttgcaatcaaatttatcaacatcttagtacaattcatctgccatgaaaatatattcttggcacctactaattactgcatcattctttttttacttgtcaatttggcaatcgacacaatttctaatgcgtatatatatatttgattattacttttactaactatatgtttataaaagatattaaactagtatataaaagtgcatttcatgaaaaatctattaatatctttttttggcactttgaccatactttttcataaattctattaagtttatgagattatgaatgctattttcaacataaatattcatctaccatctttatattctgaaactaagtattaaggaaattgagcgtcaatgtttcaaaaaattaacatgaaaaagtcaaaagatttttatttgctagtctgacatttagcatttttgtcgtacaaactaattatcgttttgcagcaacgcaggtagtatttgtgtaggaaatgattaattacaagaataattatgattacatgattcatgtaatataagtcaaataaatatatagtttctgagaagaaaatgaagagaaataacttaaattattatgaggcaggaatgatggagattccaggaaagtgattcgatatgctgcagaagctagtactaagatcgccgacaatgatcagctgatggatcagttagctctttttttttttcgcgtactgtgtagtgcttctccacattcttaattacctaattaggtttagctgctctcgggaatgtcgacatgaccaaaaaagaagtcggtacggcgcaacctaacagactagtgtgatgtatcagagcgaatattaaagtgcttagtatttagtttaggggcttaatctgacctcacgttgtacgcgattgccagtctatagttctatactgccagtgagccatcagctgagagcgtatgacttcacatatttgtttatgtttcttcttattttaaaaaatatcgtatgacagcaacatagatacacctggtggtagctactgcaagactagctagctagtacaagaaaaaaatagggtaattttaccatttctgaggaggtacatagcgatattattattttctagtataaaatttagtacatatagagtatctaaagatataaaaaattttagtgtaaaatttagataacttaaagatactttcttctcaataaccgtaaaattcctcaaaaaataattaagcaagctacaatagtcggacaatgagtatttgcatggttcacacggtctatatgtttttattttccttctgtagcatacaccacacgcacacttaataattttgcctcgtaatggtttcaccttctctcgatgggctgggcaggtcggcttaaacatgccccatgggcctcctgttgccggtcgttaaacccaactcgaccgtcaattgttttcaataaaataaagaaaagacaacatatgctattgttcttactttttaactcacatattttcacaagttttgttggtttaacatgtttcgcaattttaagtcataataagatcatcctcggacaaggagatcatcaggaacttgggcccaaagttaactttggtccctaaacgttcccatccaaagcccctagaaacacctgatgaaaatgcaagtattaaacaaggcagttgcattagcatcggaaagaatctccacaatgttcaaaattttgtatgaggaacaacgaataatatcaaagtttgtatgagaaacaagcactactaaagccatgttgatgtaagtcacgtcttgcttgttgcagacatggcttcgtaagccttcatacaatcagatatgaagaggtaagtattggattgtgcattttttttatttgtttggggaagtatatacgatgcgcattttttatttgtttggattgtgcaagagcttattttggtgtacttgcaagaacatgatggacatcaggacatagaggcttcacttaacatggcagcacttacatttacaagtggattgtctacaccttacaacaatttacgaatgatatacaaacagcaggtactagtgatgccaaaacaatcatgacttaagccaatatgcgtttcttttgtttatatcgattttatattttttccaaaccgtatggttccaaccctggaggatgtttgcgctgcaatcagatgttcgttttccagtatactttgctccttgttcaacacaaagattatatatgctttcctacagagaagtaaaaaagatgtaacatcacatctttcaagtcttcctgggacttgactaactcttcgagctaagatgctacaggattcatttgccattctgttactaatcctcaagaaaaaaaaaaagaacatgtaccgtacaggaaaaatttgaagattgaatccaacaaaacttagtcaatgtggttagactgactgtgtcggaatcctttcctcaaatactctgtccctagccttttcagcctgcaagcaaataaccaacagaaagataagaatgtaaaacgttcagaacatagtataaaaaacaaaatcaattttttatatatatcaggtatatgacttcaagaggacttcgttttgtagactgaaacgtggaaaattggttcatagaccattgcaatataccaagacaaggaaacattgataatgtccctcgatgtagtttttagctaagtaggaccctttgtgcattttggtacattaaactcttttgaaatagatttacacaagtaaagttaacacactttgggtatttcttnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14014 - DNA, 791 bp, Oryza sativa
atctattcctgcagccccgatcgcaggttttctcgaagattcgagaagctccgtgaagaccttgagctaggaaagtcacctttgatcatcttgcacctataatttaaatctaagtatttcttttgcgcaaatattgcatgaataggtttaacacaagtatttcggccgcggcttgcgagatagcctgccggccccaatcctaattgctgcaattaccctccttgaattattgaacacttagacctcctttgtcgactgttgtgcttcgatgcatgggccttcgggctcgagcatcggaacacttcccttcaaatttaaaatatccaacgatgggtaaaacttggggttttacaaaagaattggaaaacccgacacctgggtcggtgcttgcaaactaaatgaatttccaaaaccgcggaccggaggacgttccaggagtacggtttcccgctcttgcacttaaggaccgtttccttggaatttcatccaaacataagataagtacaaccacatgggtggaataggacacccctagctgagtaattagctaatcgggggagccatgatgccaagagacatgtggattcaacggggtggtgccggggagaacccccgggcttcctggcacagtatggtctgggacctaacctattgtcggtctgggacccctctcgttggcatatggagaacctgtgtcggcttttgaaatgccttgtcgtgaaagccccaagtcaccaaacgtgtctgatcacaccggctaggtgaccaaggctagtaatatatgtgggtaa

SEQ ID NO: 14015 - DNA, 576 bp, Oryza sativa
tggagattggattccggaaaagaagttgcaacttgttgatatgagtattctattaatcctattaagccctaggccgggatgttacacttaccgtgtttaccacaagcggagtgggtaactgcttgatctgaagtatagctcgaccctttcctaggcatcggtggcgagggtgggcgtgatgtagttgggtcggccgggatatccggttgtccagctgccggattcaccgcggtgcacgaggggattgctcactgccttttgaggggtgggggtgaaaccttagcgtggtgtggatggttaggggagggttatgcggagggtcttgcacgatttccccctttgtagtatcatggtgatacttcggggcatggtgacatgtgtggaatcgtgtcttgtgggtacagttgtacacctctgacaagagtaaaactattcgaatagtcgtgcccgcggttatgggcgatcaaccagattcaccatgattagtctcacccctagattagcttaatgaactggtgtagttcaggtggttggttgggcctattgcaacgtggtgtagcgtaggacagtgattgg

SEQ ID NO: 14016 - DNA, 668 bp, Oryza sativa
agggggttctgacttctgacagtattttagtattgtgaagctaaatagcaatactgaacgtgtagcaatacatgcagtaatcttactgtatacatgtttcacaactaaaaggaaacaccaggccacaaaattatataaacggaaacctaaactagtaaagtgtaccattttactagttcttcctcattctctatctttgatatgtttgtgatgcagaatattttgggaaaatcaagttcaactgtgtatggtgtggccttattagtttctggacagagctgcatggtggctacgagttatgctggccaatacatcatgcaggtacatttacctaattactggagtagattagattagggcctcaaggataaacctagtagtacataccttcagaagatgtatcatctcaatattaccaaataatatttcgagctaattgcatgcctactgaatttgaaatgtaactttgcttagaaaaattgaaatgtaacttctgtgttaaaatatttagttacaactggtaatagatagaaatctggccaagctctagtttcatatcagtatccaaatggggattttctgtatttttttcctccctaaatttcttcatgcaagctttaccaaatgttgctacagggcttctccggaatgagaaagtgcatcatata

SEQ ID NO: 14017 - DNA, 667 bp, Oryza sativa
agagggttgcagggatcaaacaagtgcagctcgccgacgagatttggtgtttgtcctgttgctgtaaacgtccaatgttttaggttggccatggcgatcaaagtcctgatgacaccgaatactgatctggaatggaaatgcagagctgtgatcattcagatttcagagtttcgcatctctgatgatcgtcatctgaatggaaccagtccctgtttcttggactaaacttctcacataatccagttgcgccaaacattcagctggatgattggctttcaggttccgattgttcacactgtcactacgattggaagtactcgtagtataataatcaacaaacaataacagtatattatggtcttacagtttcagataataaactccggttgtcagtcagtcgccatttcaacgagactgaaccagaaggttcatactgaaccaaacatttctcaataatctgaactgtatttctgtaacatttgtcagccaggcaggattagtttttccttgagccgtgagaccctgacaccagtggctatgtcgaattctcgatcgattggcaaggctagtactctactgctacttgacaaatgaattcagtcaaaagagagagttgcttcgagactttcaaccagaagcactgtatcaagttaggctgctaatgcat

SEQ ID NO: 14018 - DNA, 955 bp, Oryza sativa
agctgcagtcccacctgggaaaaaaaagaaaaaaaaacataaggatatttttgcaaagagaaatgcagtacacaaattggacttgatttgttgaatgttgaaagaaaagaaaatatactcataacgggtggtatccatgctcatcacaagttgaaataagcctcacaggatgcctcaacaacaccaacagccttcatggctctgctacagcttcttgcctgccaaaattacacaaagcatcaagcaacaaaagaatgtagccaaatattcaaactacctgttcatacctataattatgaacaacttacaaggtaatcaacatcttggagttcctcaaaaatgcggaggcctgaagccatatttaaattaacaacacattaaattatcaaatgagaatcccaattacataagagaaacagggtaaatgacataatataagtacttgccattttggcatctgacaaggcgcaatgtcttctagagaaaacatgatcaggacttccctgatttgatattcccaaatcattttcacgggtccaatcatataacgattctggaggacctacaaatgacaacaatagaacaatttcccagtttgaactttgaactagaaaaaaaaatgatgcaaggaagaagacaagtcatgcacaacaccatctcacagaccatttccaatcgtcgttcttcgcattaatgatcgttgattgtcctcttcttcttcctcctcttcatggctgtacctgacagaacataataaggggacatgtcagtttgataaaaaaataataatcacaacaggctatacttgaacaaatgaaacaaagttacacataagcatcagtcgatgtgactaatatgtataacaaacctgaaaacttcaaatatattttttataatggagctacaaaaagctcaaatgtttgatgtctagcaaaacaattaaggcagtttatat

SEQ ID NO: 14019 - DNA, 16733 bp, Oryza sativa
  unsure (1)..(16733): unsure at all n locations
cctgcagcccagattatcgatacatatgttctcagcagaaatagataccaatacatgctttgttgttggtgaagcgctcaacagtcaacatggaagtttaacagcagaaagtagaaaagataatgtaggggtacaatagaagaaactaagataagaaaaaaagactagaagagtactgataagatatgcatgtaataggcaaaagaaacatgttagtcatccacttacagactttcatgatcagagaaagaagatttccttccattttctaagctcactttttgttgcgatgagctgtgggctagattaccatcagacgccaccactccttgttgctgcattaattcaaaagaatcaatgtgtggtaaagagtatctaattaagaaatagtagtgaaaggatgtgggaaaaagttcttcatcgatccaaaatcagcattacacactagtctgaaaataggtgtctaagtgccaaaagtaagtgtgttgtgtgtttgtttgcatgtgcttggtgcttccatgaaggagcaacgatgaagtcaattaactaaaacagagatgtaggtaagaatcaaagtacgccgggtgaacctgatcaatgaccatctcaattttttccttccaaattaaagcctcctggatattgaatgcagccatctggtacaagttatgcaagactgaatgaggaacattagattatttagaaagtaagatgcaaggccctctctccatgccaaaaaaggggaatacctggccaaaacaaaatggtacttaataaagaaaagtggattatattgttggtatactaaacacactaaaaaaggcaaagcatgtcttctgtttgtttgtgctggaaaaagaaacattagattttccacctcttttatttttcttttccaacgtaaaggaaattcctccctatgtgaatatcatatgagagagacagaccaaatagaagttactatatgacatatgtgcaaatgcagtggaagtaaaaaaacaaaaactatgattattatgcttggtgcaatgagtaagggatgaatgagggaaatattaaccgtgatgcgctggtgcttctcccttttgttgtaaacgcacaaaacataaagcatctgcaagacgaaaaatgaaagcaaagaaaatcaatggaatggaatgcaaaggctacagtgaggattaggaatcaagagcacggaagagaagagatgtacatggccatggtgcatcttgaggccccggtcctcaaccctgcagttgccgtcgatgtgaagggacttaatggggagcttgggcatcttgtgctggggcttgcgtttgtagtaggacagcagccgggtctccagcacgaagtagcgcatgtggatgaatgaccgcccaattttgcggcgaccatacctgaccatccacccctcatatactacggatgacgaagacgacgacatccctcacccccgcttccaatacaacaatgctgcaatcgcaatgaagcaattgcataggtcaattatgcaatcagtgtaccgaaaaactaacctgaacaactgaattcgatccaactagtccttgttaagcacaacatttacttcacagcatcatagcatcctcttccagattaccaaagtgtcaggacacataccaactactaacgtttaacacccatctaccccgcagcatcacacaagtaaattaatacgaggagattgcccaaactagcacaaccgaaaccagcatcccgaacaacccctcaagcacatgataacgatccaccaaacaccttagagagcaaaagaaatcaatccacacctttcagaccagcagcgaacggagggaggggggcggtcgccgccgcctttcgttggggccgacgacgagtcaccgtggcgcgggcctacctaccaggacagcagcgcggcaggtccccgagacgggcggcggctcggctgcgacgcctcagagcgtccagatctggggcccccgctgcgtcggtggcggcggcggcggcggtggcggccacgtcgaggccgcgcggcgcagcgacgaggtgggttgggggggtggagagagagtgggcaagtccaacccggaaagaggcggagaggagacgagacgagacgaggacgaggagaagcacgtgccacctgcctctctctctgctgtgctccggcttccggcggaagccgcggccgaaaaggtggagacgttgcggggtcacggacatgtggggcccacgacgacagtgggctgtgtgcgcgaggcagcggaggagaccggcaactgccatatgcgcaccggcaacgacacggcgccaggtggccagtgttgctgggctggtaagatgggctccgcggataagtccacttgacattcctcaactttacgtcaagtttgtataacgtccctaacccctatacaagatatctttacccatcgaatgttcagaaccatacaaaataggtctcatgacagtcagaaagaagagaattaaaaaaaaacatgtgaaggccacatgtaagtggcacatccacaggaagatttcgttgcctcacgccggcgctcctcctactcacccacgcagaggcgccctctagccgcccgcggcacccccatttctcccacctcatcgtccgcaccgaccactacacctcgttccacgccagccactccccgttcaagcagcccatcactgagaacctccactacggtgtcatcaacctcaacaaagctgtctatccccttgtcgcacgaggtcgtcgcttggatcaagcgcctcctccttgtcgagaagaccaaccacagcgggacccttgacccccaaggtcactggcaacctcatcatcttgtgtcgaccgcgccactcgcctcgtcaagtgcagagatggtgactgcagattttgactttttgagttagtcaaatcttgaagtttcttcagaatttaatcgatgatgccttcaaagcaaaggatgatcccttgagagcacgatcagatgcagctacattaggaaaatcattgctgatgaacaacccgtacatacccatcccaaaatcagcatgactattctagcgagctactccttcatcccataaaaaccaatataatactagatgtgacacatcctatgaatacgaatcatccagttctagccttttaggttttttataagtacacatttgccctcaaagcagcagttttagttggccgtttcaaagcagcgagatacatatctgccatcaaatccggaattttttttgaaataatacgattttaatggaaaattgcaaaaatataggtcagtcaggtgaaatcacaaatttagcaccatggtttgacaggggtacctgttcaataggccactgccgagcattgcgcaaccctgttcatgtacttttttatttttttaagtggtcctgtcaaactgcggttgttcgacaggtacccacggttgttcaatagaatgctaaacttacgatttcgtctcaccgacctatatttttacgattttccattaaaatcacattatttctaaaaacaattcctcaaatcaacagcaaggagtacgtctgtgtggcgcgcttccacgcgaccacattgcccgtggcaatgccagacaccgcccacgtcgcacgcgcattcgaggcgccaggcctgctagagtccgtcgtggattttaggaaaaagtacaccgaaggtccctcaatttgtcatcgaattacaaaatcgtccctcaaccacaaaaccagatatatgacattccttaacttacaaaaccgttcactttaggtccttcggtggttttgaccccagtttgatccgatgtggctgctgaatcagcgtgggacccttgtgggccccacatatcagggtgaccacgtcaccactctccctctctttcccctgttctctctcttcctctctcatgtgttccagtttcccctggcgtggatggcggcagaatcttcaacgcagcggggaggagggccagcgactggcagggcgcaggggaggagcgcggcggcggcgggcgagcgccgggaggtcgccggttgcagaggggggagcaacggcgggtgagcgcggcagtgggctgtggcgagcggctggagcaggaaggcggcggcagagagcggagccggccgagcggagcgggggcggctgcgggcgagctctcacacgaggatactgaggtcgacatcgtccttggccggccgcagcggcgccgccaccggccacgccatgtttattcccatcagcatcctcctatccgagcacatgactggttgtcttgctggccgatggcgccgtataactcggcagcgaaaccattgatggcttcgattggcacatctggactcaaatcccatgaatcttgcctcattgcataatattgttaagtctctgatattcttctcaagggaaattaaagcactcaaatttctgtagtgattagtatcctggcgccacaatgtgctttcctattgaatgaatgcagtgacgcagtctaattttcttcattggtttagtaactaaatgcagctctgccatgatctgtgtgtttcgatctatttcccagagatgcagcaccatgtgatgagctttgatggtgttctaaaggattcaaggtggcaggcgccggttcagtaatgaagatagtaaacaccgagtgaaactgctcgggccacgtagtcggcacctgacgagggccgctgccgccgacgaatgccaccgccgcggcctcggattcgtcagcgggcggcggcggcggcggcggcagcggcatcagcgattcctccggcttaggctgattttattggagtgggccgcaagaggctgtcccgggttcatgggcggcacggcggtcgtgatcatgctgcagcagctcaagggattcctcggcaggacgtacttcaccaccaggaagtctccgcgttcgtcgtcggggccgtcgcgctcatcaccgcgccgttcgccgtccctcccgcgtcgttcgcccatgacatcgggcgcgccgttgccaagcgcgcggagcatgacggcggccatggacgaggggaggcggaggcagccgggggagaagtgggaccccgcggcggcggcgaggacgtggaggtgaaggaggagcacgggcaccgggagggaggcgcggcgcggcgcggcgcagcggggggagaggagaaaagtgtgtgtgagagagaggaggggaaagagagtgtgatgacgtggccacgctgactcagccgccacgtaggacaatactgggtcaaaaccaccgaaaaatctaaagtgaacgggttttgtaaattgagggatgcattgtatctgattttgcggttagcggacgattttgtaactcgatgacaagttgagggatcttcggtgtactttttcctggattttatggactttctcggataggccgaaatcttggcccgtacatgggtgtgggctaggtttttttagttcgaaatttgggcccatgtaacgcggatgggacgggattgaagcccatctaagtaagggcagaatatgggctatcctctccttttgcggcctttggcacaatgaagcgatggccctatctactagcccagtgttcaattcttcccccacacccattttttttttttgagaactcccacacccattgatatattcctacttaattaaccagcttgtcctcgcaaactacaattagtgttgtttttctcataacgggatgattagtagtagggattttttagagacttctcatatattcacaatcatgtgtcttcacactggtaaaaaaaaactgcctatttgatcgtgtcttagagagtgcatttttccgtcttcgttgatgttgcgtgtctgctgtgtaatcgtttttcgataatccagtatgtactgtagtaccagtattattaggggtaaagtaataatttactaatacaatgattaggagttactttactctctccgggctgataatacgacgataaggatgaggtcaaactttagaatatttgattgtgaattatttttaaaatatttgtctttcaaatatagtgactacatgtatagattggtctttaaaagtactttaataaaatcatatatttgttaacacttttatacgtattataatggaaaataatggtcaaaattgtttttttggagaccgtgtccttatccaaaatgacaagtattatcaatccggagagagtatcatttatgttattttcccggctaaatcgatctatgatcatctattgcgctagcatcactcgtatttcatcgaaaaaaccaaaaaaataggtaaataaaatttagtcacagctaaataacgattacacttctccacacctattattttttacaataatattattttatgtttctacaaccgttaacttaggtggtagtataaatatatcaaaaccctttaatcaaatgagatcaacgattaagattattttagtgagtaccgaagtagtgaggctcaaaaaaaatctgcacgacctccgcatgcaaagtaacttaactagtatatttatggcgccatatttttcaccaaaaaatagtcggcatgtatttacattgtaagtccctaaattacatatgtaattttagtatatctacaatgtaaattctagaattatatatgtaagtcctaaaattacatatgtaaatattaaaattacatactaattacatatgtaagtggtatgtaagtgcggtgtaactactgtgtaaatttgtataagagaacgtatcagtgcaatgttaaatgctaatcaaccgagaagattagggcttgctgcaatgccgccgtgtgtgaaaacatccaacgaccagcgaatactcgcggagcaatcgtacggccagcggcaccgactaaaatcaggcaaaaaaaaaaaaaaaaaacctgtcgacatatttttagcaattccgcttaactattagagcacagaaggcgagttcggcgcggtcgtcgccgccgccgccgccgccgcagccgtttacttcgctcgcctcgcgcgcgcttgctactactcactagaaaattagtcatggcagcatcgatcgagttcgatcgagttagatcgatgcgagctagctgagacgatccagatcagtgtgcaactggggcaagttgctgatgcttgcaagatctcacttcgcggtcaaactaatgcaatggatatacatatatccacctggaacagtgaagcacgcagatcgatcgatcgatcgcccggcattagtactactacatgctgtggatcggagtacagggtttagctagcttcgatctcaaagcaaagcaagagcagtacgtacggcgaagtacatcaggactgaactgaagttcctgacagttgaccctagctctcacatgcatgattaagttatacattatactgatgtactctacgtgctaatcaattgctatacttatgatcagcttaattaagcaagttgatcgagctagctatagcttgctttggatgcatgttcccgagatttgacaatgcaaatgttgctagctgggcgggtggatggatcgatcgcattgcttgtgctcagtgtatatagctgtactgtcaggaaagctcagaatgcaatatatacgtatacgcccaactcttccatcacatcataacttttctacacacgtagataaacttttaacttttctgtcacatcgttccaatttcaaccaaacttctaatcttgatgtgaactaaacacagccatactagcattagaagttagtgctgatcaggaaggcgatcgatttgaatgaccagtattactcgaattcttatatatcaaacagctaataaggcctcgtcgtttgctccacccaaaatttgaatttttaaactcaatttgaaagtcaattttaggatattttcaacgtatagtatattttttagcgttggcttctaagttactcttatctatgacaaaattttaaccacaaaatattctttatcactaggctaaccgatgggaaatcgagaggagagatatataaagctcttggcatgtcacatcatggatcgatcaatatggacgaattattctaaactctcgagggaatacgttgtttatatgaaactcaaatggttttaaaaaagtttttaaaaaatcaacaagatagattaatatgtgatagatcactccataaacatgtgcaacatcaaatttaacttatgcatattgcaaaaaataaaaattgactacgcatatacgttaactaattgtaatttaatttactttcttttgcaacatatacaagttaaattctaatttggatgtttgtggagtgatatattacatgttaatacatcttcttaatttttttttgaaatttgtttataattatttaagtggcatgcaaacaacgaggggacgtcccctcgagagtttaaaatccactcttaatcaatatatcattttgtaattgtgttaattaatttattagctatctgcaaacgcgtttcttaatttagctaaagtaaattaagcagccaatcagtaaattcagtttcttttcgttgacaagctgatcgcaagcgaccaagcagctccgatttcctttggctgacatcaggcacacaatcaccaccaacccctgcaggttacggagctggatcttctacatgactaaattattcagtctactgtcaacgttagtattgcaattgtattaaaatgatcgtgtgtcagcgcatctcactcatcccaatctccgcatacatcctgttcttgttgctagcttgtattccgtgtggcccccagtttgaattcgtcaaagtcagctgccatggatcgaaagttacgaggtcgatcgccctctgcatgcaatgtcaattcttccagatacaacactatttatcattagagatgcttgtgctgatttgcataattaagtgaagtcaaagtattagtccccgttcaaactagattaagataaatacagattatacctcggttttcattaacacgttttttcaaactgccaaaggatgtattttgtgtgaaactttttatatagaaattgctttaaaaatatcatataaatccattttttaagtttatagtaattaaaatccaaatcaatcatagagttaatgacttttttatttttcgtgtcctgacttcatgttcatactattcagaaatgaacaccatcgatctaagagctaactaattctctctctctctctctttttcgttaactaattccgctaggtatggtagtggtttaatttgtttaatttaccgtggtagttcctttttttttttagaaacacagtacaaacgcatgcgcttacaacgtgcgcacactcacccctatgaacgcacacacgcacaccatacccatatgagcacctccggaagactgggccggcatatcttgagattgacgaagtcaccacaggcgcctcgctgtcgacgggtacatcgcctatcactgaaagaataattagccgtaaatgcgagtacccgtgtcaaatctaggagttgaacccgggtgggctggttccaccactgtggtagttcctgaagctgtgttcaattaaattaaagatatttcacgcacgatctcgatcttgatatgcacccatggctagaactgatgtttgaattctcaccaaaaacattttggagaaataacattttggagcggtcctggagaaatataaagtggcaataaatatttgtatgaggagaaaattgcactttaaagtgtacgctgtttcattttacgctgggtttaacccatgcttacactttacattacaatatatcaaaataagttttactttagtttgcacgaggtgcgtcgtataattgaaagaaaaatcttgcaaattatgagtaaaacacacgaaacttgttttatttagaccatatttcacaaaatttataaatttcatgaaatttatataggtttgatatactaatacaaaaaatggtatatgtgctggatttcccagccgtcacctcccaagcggcattgatgaggaggactgaaatgtgccagtttaggaaccggcacctttaagttccacaaattaaaaaaaaatgacttgatgcattgaatcgctcctcatcaccccagaccaccatcgatccatccgacaacatcccccaaatcacacaactcaagtcaccatcgatcaatcctataacaacatctcccgcacgaatcacaaaaatttcaacaggatatccataaacaatttcatattatagaactaagcattcatgaaaaaccaaatcacaaaaaccgcagaggagatccaattacaaaggagtactctgctttgctaccatcactcactgggatgtcgaggatgtcgaggttgccgctgccgctgttgcctccatgcgcgagagccatcgccgctgccggatccacccatgagagtaggggtggaaacggagtggattcggatggataatagtcataccatatcctaaaccaaatattttaagcggattcggagcgggtgcggatagtgtatggatgcggatgcggagcggattgttttggatgtcggaaatggtgcggagttggtgcggaatcggttcgggaacggattaaatttatcggatgttacgtgtgtatgcaatcaatacaacattaagttagcaatgcaaggaacaataatacaataatcaataaacgacccatcgtaagaattatgtacttaagtgttaaacaacatgaatacatgatgttcatgatataaaaatacagctacgcaagtgtgacatgagacggcgaaaggctcatactaaaaaaatctaggttaattgatgaattaggctattggatgaaccaacttatgttatatgcaatagattgagtggttacatgtgttgataattttggattatccggtaaatggcctatcggataatcttacagaaatatcggataatccgcatccgccggattttaagataccatatcctcatcagcatccgtatctgcatccatatccgccggatttcaaaaagcccataccatatccttatttaggacggatttggctcggttttcacccctacatgagagccaccgatgctgccggatccgcccatgggagccgtcatcagcaccgacggatccgttcgggagctgccattaagttgttgcacgtagtgaatctgagcgctgcaacccgtggatccgccatcatcaccgcccatgggagctgccgtcgtgggagagaactccatgaagttgtagtggcagcgaggggaggaggggctgcagtggcggtggtgcgagaggaggatgagaggacggagagagaggacatggtggtgagtgggagagaggcgtcgacgataatgacgaagggagaaaggagatcgaagtaaaataagcgtggatggagaagcgattttttttcttccactccgcttggctaggcactatcttctctacatgtcggtttaataaaagaatggcaccgatgacaatttatgggtggcggttaaattaaaaaataggcaccaaaactatatgtgctagttttttctaataaaccagcacatataagaagttggtgtcggtttttaattttgggctcctctgagggggtaagaggaaggggaaatgctcatatgtgctggttttagattgaccggcacctatgaggcatcccctactacatttttagcatttatgacatattccggtgttaagtgaaacttattttaagacaatttggtgtatagtggaagtatatgttaaacctgctgcaaagtgaaacacggtgcattttatcgatgtaaaatgtaatttaatcttctaggaatttagaagtgttatattttggatttttttgagtaattttacggtccttgagaagttaaggagagttgtaatgtagcattgtcaatgttaatgttgaatttgttgtacctagtatcataacactagagtaaaaaaatagggacatctataagacatcttgagttaacctgcgcaaattccatatattgctaaattgaaatatatatatatatatatatatatatttgaaagtataaatgtatttgatatatataactatttcttaaattctataaaaacaaatatattaattttgcatgtatgtataacaatcaacatgcaccatcataattaggcccaccatgacgatttttctattgacctggttacttctaactttctaagccttcacaacaaatataatggatatttttagccttgtactctaaataatataatttaataaattaatataatgtaagtagtatatattggatacaacaagaaggatgatgttgtgatagaaggaagcaatagtaatgtaacgtccggcctctctcaggctaggcccacttatatctgacagcttttataggtcatagaatgccctcacagaccaacacaagtcttttctacacactttgtccttcccaatcggtcacccatcccgagattgctccaacagaccaacacaagtcttttacactttgtctttcccgatcggtcacccatcccaaaattgctccaagccaagcacgcttaacctaagagttctttggagatcggcttccgaaaaagaagttgcaacttgttgagtattctattaatcctattaagccctgggctgggatgtcacaagtaatctagtttcactactagaaaaatgattttttatggtggtatcctatttttttttccactggcggttatatgagaaatctgcttgtgaaattctatcgaggggtggagggtttaggacagccggcgaaaatctgtttttgctgacggttgcttgagaagtccgcttgtaaaaataagcttatttttactagcgtagattttcgctggcggttccttaaaaagtccgcttgtaaaaaataactctatttttactggcgggcctcttaactaaccgccaacgaaaatccattttcgctggcgggtactaagagcaccgcccttaaaagaaattcacgcacactaaaaaattcaccgcgcgcccaccaattacaaataatcgccgcccatcggccactccttatccactccactccagattaaaaatctcctccagatccaccaaccagcatcctctcctcctcccttcccatgcaaagggaggcggcggtggcggtggctcagtggtgacggtggctcacgcaggtggtggcgacggctctggcggcggccatggcccaccacccatccgccctagatctggcggctgcagcagcatggaaggggcggcggccggctgcggcaaagagtagagaaggtgaagaggagaggtggtggcaggccgagccgggcgacgacgacgacgagggagagcgtggtcactgggaaggggtcagcagcagtggcacgggagaggggggcggtgaggagcggatccggccccagcgagtctcgggaggttgatccgccgccgccgggcctcgggagcatcgcgtctggcggtggacggagcgtaaggtggtggtgtccgcgtcgtctgcgagaagccctgccggcaccacgcagaagttcctcggcctcctctagaggaactcaaattgaaaatctgtgagcaaatctatgatggaatttatagaatttgtgctgtgatgtgaatgtggaatttttgtgctatatgatcatgatcaaaccattttgtgaattatttgtgttcgttgtggatttggaattcggggatatggatttgggaatgcagggcagcagcatgcggcatattcattttcgcttttcatctttttttcatctttgctagcgggtagaggacagctgcatggcgtattttcaattttttttgcccccaaaacgattatcgctggcgggtggcttaaaaccactatcagcgaaaacgaataatcgctggcggtccacgtaacacaactgccagcgaaaacaattatcgcaagcggacctcttaagggtccacttaagaggtccgcctgcaaaaatcgagcggattgcaaccgccagcgaaaatcttagatttttactggcctttgctttgtggcggcaccaaatgccgccagcgaagattcaaaatggccaccatgaaagatggttttcgtagtagtgtttctaaacataataaataataataatacgatattgtgattctctgcatgcgtaacattatttcctcaagtaaaccatctatttgttgtagctatgtaacaccaacttgacatatatataatttcctacggaggttttgccaaatcaaaaggcaaagtggatcttttaagataagtaactagtgctgcaaatggtctcatcaagtactataaatactaaccatgcaatccatcacccagcaattctcatctctgttgatatattattcagagtaatctcacaatggcaggcattaaacttgcagctcttgggtttgttgtcctcctaagcattggactagctagtgctgcaagagtagaaagatactctagttccgaaggttcaggcacaggaaatggagaggggggaggatatgtgaacggtgggggagttgggtctggaagcggtgccgggtctggtagcagtggtggtaactatggtgcccatgcaagcggtggaggagggggcgaaggtggtggttacagccaatacggtgggtcagggtcaggtagtggatctggttcgggctcaggctctagtgaatatactcaaaatggaggttatggttatgccggttcatccagcgctggtggtagtggtgccggtgctggtgccggacaagctggtggttattggccatccagtagccatggatctggtagtggtatgggctctggttctagtagcgctgctacttactggaaaggaccatatgcaagtgcatatggcaatggcaatggtggcggtaacggccagggccaatacggtggcagtggcgttggtgcaggttctgggtctgggtttggcgatgctagcccttaatttccttcaaataggaaatttggaaattaatggagcccaacctggggtcatatttatgaagtaggatttgtttttcatttacttgtacttgttttatgcattatgcaaaaagaaataaagggctcaattgtttcagtaaaatttggtattgtgtaactaatgatgagagatgtggctattaagaccgtcatgtgtgaattgatagatagctctgcttcgacatcactcggatatctatacatgggccggtacatcattccaatgtgctaactataatcacttaggagaacattacgtggtgttatccacagttatgatttcagcttccgtgatagaagaaacaactttttttttccaattatatatggctcaatggagatgttctgtcctacttgtgcaagcaatgcattactccatccgtccaataaaaaacaaatctaagataggatgtgacattttctaatataatgaatctggacacacatctcatactagattgatattttataggacagagggagagggagtatgtgtgtatattgctctatggcgtaaaaaacatatggtgactgcaaaacgatatactaagcaagcaaagcacgcagaacgtatggtgactgcaaaacgatatatatctcttaagcaaaacgatatggttttgcaagcaaagcatggagaacgtacggcaaattaagtacctcgggcttgtttcttgactgatctcacatgcacgatcaattaactatacactatactaagtatgtgttaagagcaattttatggtacttgagaagttaccatgaaataccattttttctattgtaaatttggtatctcttggtacctaggtactatgagataccaaattttacactaattttttggtacctcatggtaccttcttaaggacagtagaattgcccatgtgctaatgaattacattgctaattagtacttgtgatcagcataagcaagttgatcgaactagcttgctttggatcgatgcaacttctgagatttgacaaatgttgctggtgatctgctgctcatcggtactgtctgtactgtcagaaagttcagaatggaacaccagtatttaggtggtgtttggatctagtgacttaactctagtccctgtatttaaacactaatttagagtattaaatataggctacttataaaactaattacagaaatgaaagctaattcacgagacaaattttttaagcctaattaatctataattagataatgtttactgtagcatcacataggctaattatggattaattaggctcaatagattcgtctcgcgaattagtccaagattatggatgggtttttattaatagtctatgtttaatatttataattagtgtccaaacatccgatgtgatagggacttaaaagttttagtcccatctaaacagggtcttaatatttaggtctggtttagtttccaattttttcctcaaaaacatcacatcgaatctttgtacacatgcattaagcattaaatatagataaaaaatactaattgcacagtttgcatggaaatcccgagacgaatcttttgagccagattagtccatgttagagatatgtgctnngtaacctacatgtgctaatgatggattaattaggctcaaaagattcgtctcgcggtttccaggcgagttatgaaattagttttttcattcttgtccgaaaacttcttccgacatccggtcaaatatccgatgtgacacccaaaatgttctt

SEQ ID NO: 14020 - DNA, 696 bp, Oryza sativa
taagcagagaagatctgtaatttcagtttctttttgtcagaacacagctactgcactttgtattgaaatgatcgtgtcagcgtgtctctgcactcatcccaatctccgcatgcatcgcgtgttcttgcttgtttcctgtgtggtcgatccaatggtcggatctccacttatcacggcgtatgaattcgtcaaagtcagctgctgccatggatcgagagcttcgaggtcgcctctacaatgtcaatttctctcttgatatatataattatattcatcagtagattcttgttctgattttgcataagtcaaagtcaattaaacagttagtaattctgctaggtatagcagtgtgagtcatcagtcatggagtgtaatcgagttggtggtttgtttactatagtttcctgctgtgttcaattaaatggtcgatctttcatacacgatctcgatcttgatatatgcacacatggctagcgtaatcatgctgatgtttgcactattaacaaaaaagaagaacaacgttatattttggagctgtatgaaggtcttttgatttgcattttcagttatatatatgaagaatgtttttagaaatacttgtttaacctaaacatttttaagaacatatataggagtgctataatgggctatattttgaatccaagtgatttcacggtttgagaagttattggggag

SEQ ID NO: 14021 - DNA, 467 bp, Oryza sativa
  unsure (1)..(467): unsure at all n locations
taaatcccgtggtgtaatgaaaccatgtttgccagcaaagactctgctgttttgtcgatgtgtttgtaaatctttcataacttgaaccattcgtgtggcataactgcaggcaattgaacatctctgctccaaaattgtgattagctcatcttctgggatttcatcaacatgcacttcaataaaacggttgcggaacgcccgagacaatattttacgtcccccatagagcacaggtggattttgagtagcaaagagcataaaattagggtgagcaggaatggtctcctgaagctctggcacaaagagctccctgttgtcatccaacagccgatttaaagcttccaagacatcagacggtgcaagatttagttcatccaacacaatccagtgtccctcacgtacagccttcaccaaagcaccctcctgaaattgnnnnnnnnnnnnnnnnnnnnnnnnnnnnnnnnnnn

SEQ ID NO: 14022 - DNA, 626 bp, Oryza sativa
cagaaacatcaatctgatctgaatcctcctcatccagcactacagttaatgaagactatatcatatgcaaactagactcctatcatgtctaaaagtctcgaggaaaatggaatcacaatgtacctggcagtttaacaggtgcatcatggccatgagttgatgtctgcacagtatacataatcttacttagaatttaaggtgtgagtaaattggaaacactatgagtaattcatcaacctcttgctcagattcaggtatttgatcttcatcttcatcagattcctcatcaagcattgtagattgtctactttggtccatttgaaggccggtttgcatagtattatcttgtgttgttctccctttcttagaagaaacaggcggagccatattggccataacaggaatcctaggaagtattagattttcatcactttgtgaaaaccattccctgagccctgtcagtaggaaaaagaaggtgcatcgcaactttgtaagtaatagagggactgtaatttttgtaagtaatagagcacagcacaaccaccaactcatgtaatatcaaccttagtcaacttaaaggaaaattctacgatttgacactgacaagcgctcgattcaacaaaatg

SEQ ID NO: 14023 - DNA, 3441 bp, Oryza sativa
ttgtttatgactcatccatcatataaaactagcctactcgcagttagaaataaccagcaagaaaccgaaattttcgacactttttcatgtatcacgaattatagcaatcaaggaacatatacgatttgtgtatgctctgcatcggatttattggaaatgcctccatacctcactacggatgaaaatcatcaacaagaagggggcaagaatatattgattcattttttgggggaaaaagcatagcatttgtttcaagttgctaccttcaccagaaactggaaatatcttcaaattcaaaacctcttagtgctatcgatgaaaggaaactaaatactcgtgttgatgcagaaaatgtatatcaagtgttacgaggccaaaattatgggggctggtatctttcttaggcatacctttagtgcgagttcttcaaaacacttctcaacattatctcgtgttttcgcgctactctcaagaaataggcatccagattcttctgcaaaggcaagcccttcttctcttgtgacagttctttcatcctcctgaaagatagaaccatcaaaatcaactatgctcccatgagatgttcaacagtattttatgaaatcgatggaacttaagggctgaaaagggcatactataatgaacttgaatcaatgaaataaaagctaaaactcaggaacagccaggatcactttttttttcaaagaaataactactttggccaaatagtaccttgtcaattttgtttccaacaagcatttttatgcactctttgtttgatgagtgtgactctatttccttactccatacttcagccagatttgtgaagctttctctcttcgtgacgtcatatactaggagtaaacaaaatcacgtcagttgttcatctagtgtgaagcatgaaaacgggagcacacatgacctgatagcccggttctcaggttaattatcataaaacaatttctgcatagtcaacctaggcacaaactattcaaagcaccattaataaaaaaataaataccgcggtgaattatacatgtaatgtataactttcggtggttcaaagagtcgcacagatggtcaaggtagaagaaatagttggtgcatcataaagacgtctcaagatgaaacagacattgatatgtcacaacacttggaagtttaagtgaggatcacactattaggctggacaagtctgcaagatatgatcttaagaattacagcagtgcagaacaacatgtttataatttgagcaatcgatcctacctaacaaaattgttatttacctagaataatgccttgagcacctctgtagtaagaactagtaattgtcctaaacctctcctggccagctgcaacacaacataatagtgctgtcagaatatttgagatattggaaatactgtaaagtaatccattttccattcaacaatagcatggttcattttgtttatagacaactcataaatttccagcaacaatgcagttgtaaggaaggactgggtaagatggttaatactgagacatctagagcaagtaacgtaatgggctacaaatctggaatattggaatctctgatggtagatggtagggagggaagggggtaccagggaggatgaaccaaaatattttaggcacaaaccggacaggtggggctataaatctgtgaatcaggagtcagaacctccaatagcaatgatgtaagcacagggcaggtgcaacatggagggacaacaccaaatatattaggtgcaaagcaatcacaaaaacaagttctaattctaatgacagcagaaaaggatggaaagtcaaaattagtggaaagcaaagtatgttactgcaaagaagtgaactgaggcttaaaaactgagtataggttgctcaatcattctaggcatgttcctcacttattgatgttcttggattgtctttagttggtgtttgcaatagcttgtactagtagatctcaagatgcccaatcatcatcagatctgtacaggaaattcaactacttcctctgaatcaaataactattgcgtgcataaccagttactgaggccctcttttattgctagaagaaagaccgtgtgctaaagtttctaaacatggagaacaacatctagtaggatatacggaataagtgcccgtaaaccatatcatgaactctgtttcactcataaccttaatatactccaagcaaacatttgctagcccctcaaaataatcatgtactaagagcaattccatcattccacatgtgacagatcatcaactatacttagtattgcatgataattgtttgcactttacactactaaagcgcagaaaggctttccaaacattgtatattcacatctgaagctaaatatcatcgaaaagcaggccatttctatacaacccaagttatgaactcaccagtatcccatattgtcagcttcaatttctttccaccaatcgtaaggaacttgatcttaaaatccactcctgccaaccagtgtggaacaaaaatcatgaaacaagtgaaacgacaaccatgaccatacactagaagaagtgaactagaaattctgcattggtcaaatttattaaccacacataagaccgatcatgaagggctatggggtaaggctacactgaccgaaatttcccaaccaacaagaagaaagctggggccttgttcagtataggagcaaaggaagaaaacagctaggacaagaaaaaaggacaaggttcgtccaccaaatcccaatgtccttaaccctctacctaccactgatccattatcctcgtccaactgaaccagaaaatgaaaagggagaacatcccacatttaggatcgcccacattcagtttggtcgctgtattgattgagctacacaataactactagtagtagtagctagcactagtactaaaacgaccaaagtaccctacctgattggagtacaaaatctgaagttctgaaccaacatttgagctgcatttcaggcgtatttccaaggaaagaactaatcaagatcgtagccaagctgggatttatatttatttatttatttttgggcggcgcaccgacagatgggtagaatcgtcgcggaattatactaggatgaacagctagtgtacgttgtggtggtaagctacgacggcgatcggtgggctgcatctgtccgggagtgatgtgggggggcacgtacgtacgtaccgatggtgggagcgatgtcgtcgtcgaggtgggcggcggcggcggcgacgacgaagctgacgaggaggctgctcttgccgacgccggagtccccgatgagcaggatcttgaagctgcactcatgcccacctccaccgccgccgctgctccccgcccccggcgaccccatagccaccacctcagattcgctccctccctcccgcccctcgtcaagagggggacccaacctggaccggcgg

SEQ ID NO: 14024 - DNA, 15133 bp, Oryza sativa
ccgtcacacacgccggtggcgtggcggtttttgggtgggatatgattcgcgggcggggtggaacacgggagagggtgggggtgggggcgtggagccgtgggtgttgcgttccgcgggtgagaggggtgggggaaagggatcgtgtgatcgtgtcgtggttggcagcagatcaagcggaaggaagcgtacgtgcgagctagctagcttgctgatggggacgggcgacgccacgacgatccctttgggggaatatatttagggctgccactatatacctatacctatttagggaatatgagtactccctccgtttcagtttacaagatgttttgactttattaaaattaaactattttaagttcaccaaatttgtagaaaaaaaagtagtagcatttttaacccaagacaaatttattatgaaaatatattcaattattgatttgatgaaactaatttagtattataaatattactaaatttgtctacaaagtcaatcaaacttgaaacagtttaactttgaccaaaatcaaaacgtcttgtaacctaaaacgagggagtagaaaggaattacacttacccatactatttgggggaggacataagtagaaaggaattacgcattttaattttgggtaggggaggataatgctcattattacccacctttctcatttccatgtatgtgtgtaaaactcggacacaaaatttaaaactcgttttcacattataaaacttatcaaatttgactgaatttcataggaatgaattattatatagagaagcaactttatataatttttgagccatttctatatgtgaggcccacgtataaattatccatatggataatctaattatgaaatgggtaaggatatggttacccataccctccccagttgcatgcctaaatataagcctatatgtggtagaattctctagctcaacctcttataaggatgtgtttggtacgataagttctcaacttctatttctttgtttttcacgtacacacttttcgaaaaattttatataataaagttgcttaaaaaagtcacatttagtcttttttttttagtttcttaagttaatactgtactaatgagccatcccgtttccgtttagaatttagaaattcatgactttctagtttgaacacaatctaatattgttagaagagaagtaaagcgggctgtcgggctaaaataatattagaaaaataaactagaaaggggtggagtaaggttcggattactccacacgccctatatcagactttattccggagttatttttaagagttgatcaattaacttcattaagaaaaagagacttgatcagttagagctctataataaacatattctagtagtatgagcgactctaggtgttcgttacgcgtggtatcatcggtatttgtgtgtaaaccggccggtgttatctggagcgttgagatacgtacggtgacgcgacaccgcgacagtatagtgatgctagtttttggccgtgtgtgcactacgtctacgtacacgcgaaggcaattcgccagtgacctgaatttgctcgatctcttgtgatcttaatttacggcgtttcgtccacgcggaggagttcgtaatactgatccttgggacgtacgggccgccgtgctcatcagcctcagccagcacgacgtgcgcgagtttctcagtttcttttgtttgctgcttctgctgctgctgctagagacacgtcgtgtgtgacagcataatatttggggcttattcgttttaaaaaagaagaatttctaaggattaatttctattaatatctgtttgtaggaatgagatataggaaaaccaaattaaggaaattttattttcctacaagttatagggagagaacgcaaaaaaaagtaattaaattatccatttaaaccttaaagaaaaattcctatggattgatatgtgcatttctttctatttctttaattttttatttttatgggttgaaattcctccaaacccaataaacaatcgacgtttgggacagcaaaatactgctacgtgtaagtcatttttgatgtttcaagcatcaaataattctgtctaagagataataatactactagtcgtaatagctaactgatataacaaaagagacaaatatgtataacaatatactactgatatctacataatggatgtatatatatagtcaaacgtactgtggagataggagatattatgtcatgcatgcatacacctgttgatagggacatgatggcgctgtaaaaacacgtagcataaggtcgcggttgcgctacacatcaggcaatgcgtgtctccacaaacccgccagctacgttgcttaattaagggaaaaacggcgagtgagtcttcgagtatgcgctgccgcatagaatttttttccgtgtgggtgtcccggactccaggtgatgtttgctgtttttgtcattagtgtagtattatatatttatatgtgcgcaaagtacacttgcaattgcatgattgcatctgttaattgttatcttcagtactggtaagattgcgtttgactactctgaggtcgtgttttattacgtacgggttgccgcctctcagattttcaatttggagcagtaggggcgttctttctgaagaatgaaactattccatttatcaacattgtgattctttttcaaaaaaatgcatacatattatttttatagaactgttttaaatcaaggtgaactaaactccatgatactccctttatgtcaaaatacaactatatttttttttataaaatagctatattttgaattgagcgagtagttttaaaaagagtgaagtatatagggagtctctaaacttgtgtaaatatgtcatccagatccctgaactatcaaaatatattctggatctatgaacttatcttgggtatcatacaagtctaaacggtttcaacctgctccgtgtgttgacatagtataccacggtagcacataaatattaaaaacatttttttctcctcttaggtagagaggagtacttttcaattttaaaggaaggcaggttaataagacgtgtttaatttttaatttttttatgtgactgacacataggtcctagctactaacatacatgcactatcatggcatgctatgtcaatgcatgaagcaggttatagcccgtttgtcgtgacttatatgtaagaaaaaattgcatctattaaaaagaatatggcaaccgaagagaaaggacacaatttaattaattatatacaagcttgactatgaataagttgcgctctggattttttttcaggaaaaaaaaacacttaatgcggtcttataggagaggtggtaatgggctcaaacttttgacatacaaaatatgagggttggataaaaaggttgagctaaactttagtagatttttttaaaaaaaaatatttaagatgagaggattgtgaaagggtccatgggtcctgacccattgtccggattctattcatgatcttagtttagtttcgcttggccggccaattgttgatgaaactgtacacttttcatttttgtttcgaaaatgacgagatctaggtgtcaaagggaaataaaatagcccagctttttttgttcatagaaagggaggaagagcatgatatcatagcacgatatgcatcacaggacagatgatttgtaaagagaggatggcaccgagaatttgttgagcgatctttatcagccaatcaagtgagatggttcactggaaagaatagaaaaaaaaatgtcagatggttaaggtgtgtaggcagaaggccccacccaccacattgaccagtttggccgtggacagcaatattgtaccgaagtggctgacaggttcattgacgaaaaccaagaaattttttgtgaaattaatctttagggcccatttgaaatagagaattgctataagaattttagaggatttaatttcctaagaaattacttaaacactttgattcgtaggaaaggattgaaaattttccatacgattgtatttctatggcttaatttcatacgaaataagtagaatgttgaaccttttagaagctttcatttgctttgtttgtttcatagaaacatgccgcttcaattactgtgttttttctatacatgtgttttttctatccttgtatgttttttatatgttttaaaggtgcttttagatgttgagagtctaaaagtctatttatatgagagtcagcttaaattataaaacttaattttaggagcaattctacggtccttgaagagctaccatgaggtaccaaaattttagtgcctcatagtacttaggtaccatgaagtaccaaatttataatagaaaaaatggtacttcatggtgcctccgcaaggaccataaaattgctctaattttagagttggagtaggtttttttagaaaaaaaaaagtacgaattacccactaaactatcgtgtggttgacccaattaccccctgaaccataaaaccggacaatttaaaccggacgaataacccccctggctcaatccggagcggttttagtcctatgtgaccgcacatgtggcactggccccacatgtcagcctccaccacatccttcctctattatgaagctagtgggcccccacatgtaagctgctctttcctcttcctttgtctacaaccatagagacgcccacgtcgccgtcaccctcatctcgaaccctgcctcctttagctagtcgttgtcgccattgcccccatccaaccgctggagagaggaaagagaggggagaggaaaaaagatatgacaagcggcagtggcggcgccctccagggcaaccgggaaagcgaccgactcctccactccgatcaaggattgccgctgcccgagtttcaccggtgtggccctatctccaccaccgtcgatgctggcatccagactccgctcccgccttgcttcgccgttgtcggaggatggatactgctccaccgcctcgatctactatgcatcgatttcctccgccgaccccgtcgtcaggaggccaccactgaccgtcgtccccttgtcgtgggctcccctgacggccggccccagcctctggctggcgtccgcagtcgaggccgtcggcatcgctccaggggaacccatctttgtggccgaatttcacggctccagtcggtgccttctcctgcgaccgcgccggtgccggtctccatcgccgctagggggagggctaccacttcaccataaccgccaccgctctgcctggctgccgtcgggctctcctctcccttgtgccacatctctgcctttctctctctgcgccacatcaccattgccgctctcgtcgtcgcctggagagcactcccagccatgcctcctagagcgccctcccatccgcgcccatcgtcgctcaccaccgaacggttcctcctcccagccgcgcccaccaccgctcccccagccgcgcccgtagccgctcacctccaatgctaacatcacacacacagacagaaggtattaatatgacatgtgggccctatattattttattctattttctgttgatgggatttccacgtcagtgcccatgtttatgacatgcaggaccaaaaccgctccggattgagctaagggggttattcgtgcggtataaattgttcagggtttaaaatatctggttttgtggttcagggggtaattcggtcaaccacgatagtttagaggagtattttttttctttttttatatcgtagtctattgtttatcattggcttttaaaccctaatagctttattaattatttttcatggctaatctttttgctgaaacgatcatagctataacaatattatagtccaaatggaaaaaaaaaagagattgggaaaaaacagctattactaaatttatgcaccacaatataaaatgtaacggaataattgaataatttcgtaaacgtgcatgcttggctagttaattggctgtttgcgtcaaggcaacgagactttcatatatcggtcttcaagttccagactcccagtaggtggcgggcctgtttagttgggggaaaaattttttggggttattttgggcgtttgaccagatgtcggaagggcttttcggacatgaacgagaaaactaatttcataactcgcctggaaaccgcgagacgattttgagcctaattaatctatcattagcgcatgtgggttattgtagcacttatggctaatcatggactaattaggctcaaaagattcgtctcgcgatttcctccctaactgcacaattggtttttgtttttatctatatttgatgctccatatatgtatctaaaaatttgatctatccaaaaattcgatgtgatgtttttaggaaaaaaaaattgtgaactaaactgggccgtagtactccagttgtgtgtcatttgctgtacggatttcatgacatctggatagtgcactagcaataaatgggctaccaatatccagtgcatggctttgaccaaccgagcccacaacttattcctgtaattaagtaccaataatatgtgaaactgaaaatgacaggggttgggagaaaaaatgtggaaatgcggcttcttttatgttagagaagattttcatccttgcaaactctcttggaccagaggaaattgttgggcttttatatagtcttttgggccgtaaagcaacaatctgagacggcctagcaaagatgttgagcagtgagatgcactcgtagagtaatggcaggggtgctggcatgcaccctatccgctcggattcgattctcttcgagcacgttcatctgaaatatttgcttcttgctccctctgaaaatatttgactccctctgtttctaaatatttgacgttgttaatttttttaaatatgtttgaccgttcgttttattcaaaaaatttaagtaactattaattattttcctatcattgattcattgttaaatatatttatatgtatacatatagttttacatatttcatcaaagttgttgaataagatgaatggtcaaatatgtactaaaaagttaacggtgttaaatatttagaaaaatatttagaaacggagagagttcttaaaatcatcaacaccaaatctttccttggtgtccaactttttaaagatgttgatcagtagcatcgcttcactttgaccagaaatgtatatcagcatggcactgtgtctatcatttcttttcttttcttttcttgagaagatgtctctcttttattaggagtatcatttagtaataataatagttggagtttcaaaacataacatatatcctcacaaaaaagagagagagagaaaacacaacatatatgggctattcaactcgctgcatactgcgccaaaatcaccatactcctcttggcgcaaagtgtgtctaccaaactcgacgccgatcgattttgcagcttttgctcgacggctaagttcagaggaagccgtctctgcatcttgtttgtcgctctcgatttcatccttagtttgtgagatggatgccaactcgtctctgctgctgctgctcctgctgctgaaatcaaaccgtggagcgcgcggctgcagggcggccgcagcctctggtctcccgggtgttgtaggagctgcatccggggcacttctgcgccaggacgtggaagttcacgttcgacgtcgcgccgcagtcgttgcagaggatccatatctgaatgaggaggaagaagaagaatcatcaaaggattgttcagagtcccagccatgttcactcaagaattggtagccaaagaacttttattccagtctggatggcgtagtacctacagaattttgtgatagaatctacatgattttagaaacattattttagtagatcatattattggtagaagttgagggtttgtcccatctcgtctttttttaagctcttttctattcacttctggactttttagttgtgtgcctacgagcagaggccggagatgtaatccatttccattatctaaaaaaatgttcactgaagaatggcacacgagattttggagaaatgtttggtgttttactgaccatcttcttctggtagaactccggcatcggcgtcgcggccacctcctcgtcgagcttcttccacgcgtccgacatgtcgcaggccgaccgtgagcacaccgggcaagcgaagctgggggatatcagaatcattgcattggtttggttaggagaaagttttatcaggtgaagttttttgtctgaagaacactcactgatgatgcgctctcatcacgttcaggcattccagatggatcgtgtgcccgcagtgcaagacgctgatgtccttcgtcgagtcaaataggtactgtgatttggaaaaggagagcaaatttttttatgtcagatctcaagaactggaaacaaattgagaatgttgtttttttttctctacctttctgaataccaaatgcatttgtggaaagcaaggctcacctcgaagcagacaggacagttgtgatgcattgctccttctacacagtgatgagaatccctcaagacattactgtagcaacaccctgtttagtgaggaatagcaaatgttagaccaatcttgtttatcagcgacatgtggcgagaatgtcaaaaaattttggggaatacgcatcactggctcattgcattaagatcatgcagaacataccgcatttgtcgcagtgaaagaacttatccacaccaccagttctggaaaaaaaatgggcatatccaaaattgatcaaactgaataaaatagtaaatgcagaaaataattcatagagatagatttaggacttgcctgcatatgccgcatccatcgcagtgatactggttctttgagacctggaacaaaccaaacaaatatgttagtcaggttgttaagcatcatcatacatttatgaaccatacttgccacattagaaacttagatgtaacgtagaatcatcatttgtaatccaaacatgcttacatcatcatcaaagaagttgcatttttcgcagaagtatttccccatgcatgccccacaaccagaacagtactgttgtacctgtcgatcaaagtgaacaattttcatgtgatcagtacagaaaaaaaaaagttagcacaatccagaaattctactgttgtacactcgagaaattctattgcacctttctataaactacttacatcctgttctttgtcgcagagagagcagataacctgtgatacaccataaagtaaaacagtttcagtaactccacaatctggttaagaaagttagtgataatgacaaaagcgtaacagccattgaaattcttatccactagattcccccaggaaattagtgctgtgataattgcacaatcagtttgactatttgaggcactgttagctatggacacctgttgggccacataaacgaatcaatcatgtgctgctactcaattattcaggaatcaatcagctgaccgcactcaagttaatcttggctgatggtgagacatgcctttgtcatttccctttcctcctctgccgtcatccttctagtgacattgtcacatggagataagcaagcaagcaagcaatcaatcatgtggaccagacaatggtcactagtagcagaaactaacctagtgtgcaagttgagttgtggaatggaaaatatcaagaagaatctgtccccatggagcactaagacaattagacaaccttatctgaagaagggggggagaaggaaaggaaaggaaaaaaaaaattcttgggatgggggcattcttggccacttcatggcaggggtcccaaacatcattgtccagggctccagaggcatgcatcagcatcagactgaaatggcaattactaatcggattttgaattttggactgaagaaattgataggtttgtgaaaactgaggtatgatctctccggcgacacgccatcaaatattgaccgcagatttttttcttttcttttttgtctatcaggcgttgtgtgtccaagcaaaattcagataaatttgacacggattatatcggatgaaattgggtatgacaagcatcaaagcttacacgaattgaaaacaaaagggaaagctgatgctaaaatcaaacagaagagtgagaacaaacaaacaccttcttgatttcgtggcgggggatctcgtgacggtcattgagatggatctcgagcgaattctgcagcaaataatcaaaagccaatatcagtaccgtttgaacgattttcctctcctcaataggagccaacaaaaaaagaaaaacagaatcaaaattcaaaagcgaaatggattggaagaagagagaagaatccatccaaccttggcctcgttgtggcaatgcctgcagccgaacacctcgccgcagcacggcgccctgatcctgcatcccctcgtgtaatgctcgcagcttcacccgccagaaaaaaaaaacaaaaaaaaaacaaaaaagcccaagcaaacaaacacaggtgagatgagatttccagaaccaaagctctcgaatcagagggtaataaaaatctcgcagccaaccacatgatcgattccctctttcttgcttacccgtgctgctccgactccaattccatcctctctctctctctctctccctctccgagctcaacaaccaacgcgctgtttggctctctaggtctcaccgacgacgagacggccgccggcggcgagggcgaggggggaggggaagggggtggttggcaacggcgggagggaaggagggaggggagcttgcgcgcgtgcggccgcgttttatagtggggaaacacgtttttttttctctctctagttttttttttcctccttcaaatatggcggtaacggctgtgtttcctctcctatcttttgtttgtgcttgtccccccaagatggcgtgaacgacatctctttggcacatgattcaaatgccgactgtctcaaacaaaataaataaattttatagatgaatttagataaatattgatccaaattcatccgtagaattggattcattttagatagagaaagtagtatagaacaattaatctcaacaatgtaacataagaattgtttcttggaatcatactttcaagaaaaagcttagagcaaatatgtggccaaaagcgtaatttgctctaaaaatactacctacatcccaaattagatgtcgttttgacttattacttataacgtttgacagttcatcttatttaaaagttagtgcaaatatagaaaatgataaaatcatatttaaagtacttctgataataaagtgtcatacataaaacaaataataattttataattttctaaaatgaagaaggatcaaacaaaaactcaaaacaactagtgttttgggatggaggtaattaacatttttatgatggaatagctaacttggttgaacgcacttgccgtgagctggaaaatatctgcctgcatagttcaatgcaatcatggaccagaccattcacagctaaatggaacctgtctttcatcgatctcgcctcataagaaacaacagaacaaagataaacaactactactagaatccactaacagtcagcggctggttgcccatagggtggcgcgagagcaaacggttttcgtatgagtcggcaatgcgagtgggccccacagagcacgaaaaggcacaccgggaggtggggccccggccgttactgggtgagggcgaggatgaggattacggtgtcaggcgtcaggtacacgttggatggggatagggatgtgtaggggttatacagtaagtcgcctggattacgtcgccaacgagacggtgacatacggatatgctatgccagatttccaatgagtgttgtcttgggcattgcccagtgattaggggctagtttaattccaatgtttttcttcaaacttttaatttttttatcatatcaaaacttttctacacacaaactttcaatttttccgtcacatcgttccaatttcaaccaaacttataattttagcgtgaactaagcacaagtgttatctcgacttgtcacatggaactacacgtgacaatttattagcacaaaatatacaagacgccacagtttagaaaagaatacttcctccgttttttaatagatgacaccgttgactttttctcatatgtttaaccattcgtcttattaattataatttattttgttatgagttgttttatcactcatagtacttcaagtataatttatatcatatacatttgcataaaatttttgaataagacgaatggtcaaacatgtgagaaaaaatcaacggcgtcatctattaaaaaacggagataatacttgggatggtaaagattttaagtgcctgacgtgacggcaggtaccaaataacgacagtactcttctcaaagttttgctgcaatcatcgcacaaaaagagggcagtgaccagtgggaatgaagaggaaatttctttccagacgctcatgagtcatgagtagtagctacaaaattgcttgcatttctcaaatgcagtttacaacgaaatgtggtatattttgtacacagctcaggccttggaacagttgttaacccaaagtgtgtaagcagctagaagcctaggggactcaaaattttggtagtattctatacacaaattacagtgatgggcgcgagggcattcttcctccggttactttgatgagcatccaaaagatcattcattagcgctctgcatgagctcaaaccactgcaacagagagaagacaagtccacatgtcagacagagagggaccagagaacagaaatgagtaaaccatccattagttcgtaaatagcaggagctaaggcagaggataatctgtacctgtctaagcaagtcagccaatgtacgaggaagtgcttcaatattcttcagcatgacatagtaagggaatggaaaggagtccatatatttccccatggttagtttggtaccttgataggatacttcctgcacgtcaatgccaaaaggattccaaactcagttaattagctaatcgtgaaaagtgataaccatgtcactgagatttgaggggtacgcaccagtgaatccatgatagattcctcgtgaccatctaggagcacatatgcgatcatcctctttctgttaaggacattcctgacgcaacgcttcaaattttcctaatgacgcgatgcgaacatcagaaccaaaaggtaggcactgtgagatatacaaaattatgtgatggaaaaactggtaccttttcgtggaacttcccgtcagatattattagtacgagttgctgaagtggattttgccctgacggtgtacgtgaccgtgccacggcagtatcaagcattgtgttcagatgcatcaagagatcagcaactggttcatcctcaagtttgttgtcttgctcaaaggacaaactagaaatcatctgtcatcagagaagaaagtgagcaacagctcgtgagtttcatttattggaaagcaaaagagcatgcaatcaatttcatgaaacctacattcgttcctgcttctccattgaagacctgatcgaaatcatgtagcactttgacatttccctttttccgaaacttgcaactgcaaactgtccaacctcaagttgtgacatggcccggcagactgtaactaatgcttcaatagccacttttccacacttgccctcggacatactccgtgagtcgtccacagcaataaccacttggtaattacgtttattaggtttagttcggcgcaaccatatcttatccctgcggaaatgacttgcaatatatggaataacctgaaaaaatagcaatgcaccatcatatgagtgaacaccttgaaaatggaaaaggctgttcttttagcattaaaacaagatcgtgagaaacagaagtacctttttcatgtttattctctttccagttctgtaatctccttgaagcttacttgcaagagttggttccatgacaaggcgcaattgctcagcaagttcttgggacaacttcatagttgtgagctcaacacttttccagtcaacaataggacctttcatatctacatcagtgatgttcatttccatcggagtagacaactccctctcattggctaaatcatcccgcataactgttttttcatctgctggaggttgtttgaacgaaacaaaatctccaaaagtctcgtctgtttcaccttgaactgaatcctgaacatatgtatcagtttgaatctctctatgctcaaggttgttggcattttcagatttgttggtacgtgattgtgaagcttgcagatgtggcacttcaagattatgatcatctccaggtgccctgtaagtattgtgttcctctttttgcacacggttttcatcctccatggaagactgtttgacttgcaggtcatcgttgatttgatcagctgttgcattacccagtgcctgagaggtgctctgctcactgtccggcacataacgaaattcggtagcactttcatcatcaatatggtgttcagcttctggttgatgatcctgcgtatcagctgagactttggcccgttctttccagtccgccattgcatctccaatgctcctaaaaggatttgtctgtttgatctgcgatggtggagtatcagtctgcaactctggcttagagttagacaataacctagagccatccccagagttgggcatagatatttccagactagggacttcattgcttgaaaaattaacagaaggagcagcagcactgttcatatcagtgctgttagccaagtttgattcagattctctgttatagtccatttcggcattatttggttgtatgccttgtgaaggatgctcaagtgactcaatattatgaagttctttctccatgttatttgtctccatctgtccatcttcagcatgctcctgctcaccatcaatctcattgtcaccatgttgagctgcatctacatcctccacatcgtctgaagcatctaaacacccatctgctgctagcttttcctcttctggactgagttcttcaccatcagcatccatttcatcaatatgttctgtcccatccatatccacatcctcagaatcatcctttggttcagggagttcaggtgctgttcgatcatcatgggctgcaggaa

SEQ ID NO: 14025 - DNA, 7051 bp, Oryza sativa
tgtaacaggataacttaaagccataaaactacaagaaatggcaaaaccgtgtgtggtaggaaagatatgcttacgcggcacctatgttgacctgaagtatcaatccagacgactcgaacaaagagcacatcttgttcagataatggtatgccgttgtcagctattgctgttatctgaccgactgacccgttggcaacattcaacttgtatagatacaatgcatttcgtctaaatatgtcctcaactgcttcaatagcttcttgaatgctaaggtcaccatcttcacatgcagctgagagtacacgataaacaacatcacgtgccctccttgcacctgtaaatcaaactccatagttttgcacatttttttaagagctttactatataatgacttttcacttaacttatggaacaattatggctaaggaatgtacctaggtaatatgtctctggaaaagcataaccatctgtgctgaacatgacctagaaatgataaaattagaaatgtaaagcatggcatatcttcaaaatgggcaaaaactagttgcagatatataagtgaaaatattacactcgtccaggttcttgcaaaatagatcagaatgaaattcttttacaaggcaccttgagtgaatactacaatgagaactaacataatgaaaattagatgcacttcaagcatgtaggagggaaagaaattcccagacctctactgcaaaatattgcagtaatcctacaaagcaacaattgttaatgggattctgtatttatcagttctattattcattatcaataatttacatggtatggaaaacagggggggcaatatgatattgagttgccagaaaataaaacacagttcagctttccataaatcagtggaacatacaggtaaaatgtggactgtttcaataacctcaaaaaaaaaaaggaagcaattatccagaagacagagattttaccttctttatgggagctagctcaaggacctctttaattgatgatgtcattccttgaacactaagttttggaattgccaagccaaaatcaaggtatacctgtttgttttaaacaattaaaacataaagtccatcaaaggcaatgcataagtcatcaatcatataaggatcccacctgggagtacactgatgctagatatgatgcttcctttgaaaatggataagaggcatgtaaaagaacaatttggcacttagagaatcttgtgtcctcaagaacagcacgcagatggagagggttgcactttcgcaagtccaggtccttatctccaaatctgaaaaagggtggaaattaattgaaatattgaaagtttaaaacagaataatcatattttaggattaaaatgttgtcatcaccctgtgtgaatctgcattggcaggtgatatgatacagcaatttcaagactgcaagtaaatagatagtcaatcaggttcttatttgtaatccgaagaggcctctgacctgaaaaggataaaatagtccaggtgtataaaatattgatggatccaacaatgtgttctcactctctcctctctctctccgcaaaaaaatacattacctgataactccttacgtagtccatcctctgcatctgtcttgctaatatttggatcaatctctaagccacttctatatgcagctatacttttcaatccaacaattttgttggcaactgtgataaattagttaaggaaatcaatacattctaaaacagtatacaacaagaactatccactgcgcctgaaaacaaatactggggaggatatgatttcagcttagtgacaaaaatttcagtaaaagagtcaagtgtccagcttgatgcgctgaatgattcctgaaaaaagtttattactcatagatgctaacagaattatgaaagctgacaaactttgtaaaatggagaaaaggtacaactttggagaaaatagacaggtcagaacgataaaaaaaatgcactcacatcattaataattgtttctgccagcttttcaatcctcagaattctgccaactgtaggagcaaacgccttgtgtgcctccagttcaagcatcttgtcaaagtctatgccatcatctataagaattgcagataagttggcagccttgaagcactttgagcttatagacgacaacccttcagcccttctgaactcctccaccttctcaagtgaagcttcacagttgtacaatgcagcgatgtccctcaggcttctctgcatttcacgacgttccaaacgatctaatgagcttctaaaaaccatactcttagttgcaacgaaacaactacgaatacagcattacgaaagcaagaatgtactagcaacatttgcaggttggaacaaacagagagctacgactcatatacagcatcctaacactgcacagagtacagacaaaagtggtccacatgaccacatcacatgcatgcatgccggcatggacacctgctgaaacgcacataatttctcagacagaagtagaacagtgaagcagtgaaccatgccgaaatggcccagtaactcctctcatgtgtcatggaccctagcaacgtttccattccattgctcgcatcgcacgcctcggtgcccacatccaccaccactgagctctccttgacagggcaaagagacgagacaaaaaaaaggcgtgtactactcaacagtgctgctactatgggaaattggcaaagccgacataaagcctgtggcctctgccatgccaccagttaaaagagaaggacggattccgcatattccactataaaccacatcgccaatctcggtaataaaatggatcatggagacgataaagttcgcattccgttttcatttctgccctgaaactactctccgaaatccaccagtggtggcggtggtggtggactggtggttgcagttctgaacctgagttgaacacaaatttctctcggaaaaaattcattggattaagacagaattactgttgactcggctttcggagtaaccaaatccagtgaaatacagtgattcatttttttttcagatgacaacagtaaattttcactgcaaaaattatctgcatcactcaacagtgtatatattttttattttgcaaatgaaaactctgcagccgactcaatctagcacacactgttacgcgaactagtctgacgaacagagtaggggaagcgcacaagtcgtagccgtcgcgatctcgagcagcacacggaagtaagcggcgtaggcgacccaacggggccgtgcggataaacggagctgagaactgcatgtgtaccttgaaggagagggtgtggggagcgagggcgagggcgtcggcggcgtcggcctcggagaagcagcggaggaaggggaacgcggagccgtcggcgacgaggttgtgcgcgtgcgcgtccaccgccgccgcctcctccgccgcgcgccgcagcgccgcgtacttggactccatctccatctccgccgggctccggctccggcggtcgtcgtcggtggccgcctcgccgccgctcgctcactcgctcggtgtctcgaggatttttttttttttgttttgtttttaagaaatttttttttctctcgcttcgtttgaccgcgcggaatttgcaacgcggccacacggggcgtggggtttttataagcggggcggcacgagagtggaggaggggcgctgcctgcggggcacgtgcaccgcaactgtccgcttcggctagtgggttagtggtgaccggtcaccggtgagcgtcgcagtttgattggctggctgcctggcatgtgggtccggtttgtcagttgtcactcgggggttgcgtggggttataatctaaagtaatgaaaaaactaaaggtgttcatcacctagatgtgccacgtcatgggaaaattagaaccgttggatgcagccagatattgaacaacagccgtttattctcaaaataaccaaaagaaaaagcatggtcaagggacttcggaagtcaactggaagactcgtgaatccaccacggcaatatccgaaggtccgccaatattaaaagcccatgtgtccagcgcgatatatagggcatcacggatatagcccaaaataaaagaaaaagtcgaatttcatggatatctcttttaatgaacgaaaaatgtttattccttccatcattgagccacgtatacttatatagcatgaacctttgaatttggtgtgaacggttggattaataatgaagatcgttggaagagtcaggagacttccatcggagagatgaaacagaaaagacaaaagtaataaaaatccattcatggggtaccgttaagtaagagaaataaagaaacaccacagttaaacttaattaaaataaaagctactaaataatagtaaaaagagcactataataactcaaaataaatcatcgtattctttgcccacctaacaacatttaaatatcttccactaacaacatggtactctaactcctaatattatcacagcgtatatctttagtatataatacctgtaaatctcactctttggcaaaacttaaatatagtagttccaatagctgtaattacctaattaaattctaacatatataattattacaaacgatatgcatttaaaaatgcaagtcatagtcccaattattatagatctaattacctaattaaattttaacatatataaatgatcggatttgttagaaaacttccacaaattttttgcccctaaaactttcagatttgtcaccatcggatcgcctcgagatttgtgtatgaagaaaaaaaattgttacaactaatttttcacacatgtcacgtctaaccaaatcatagttgaatacaagttttatataagttatatcgtagttactaatacaattacagtgtagttacaatgtaattatacttcaattatactatagttacatatcaaagtttttgactcaaaaaatttacgataattttttaggtattcccatgaatgatacttaccgttaccgttacatataaaagtgcaagtcatagtcgtatgaatgtacgacttaattggctagtatgaagaatgtacgacttaattggctagtatgaaacggaggaaatatatgagagtaaataggtagatcgttcttaaacaactttcgaagataggagcaactataaccgaagatttaaaggcttgagatttgcccgcaactatcactatcacttgtggtagcaacagtgatgatgaatctctacgattagtgacagactgactgagcactgcggtttgttgtggcggttgggttggtctgctgttatgtactccctccgtccaaaaaaaccaacctcgtactaacatgtgacatgttatggggttcttttcttctaaagatgaaatgtggatgaagattaatttttttacataaaacgaggtggtattaacgtatgattgattgaattttaattattacaaacttgaaaagtagattaatataatattttagagcaactttcatatagaaaattttcacatgaaacacaccgtttaacagtttgaaaagcgtgccacggaaattattcttggagaaaagaacggtaacgaggttagcttcttttatgagggagggagtaggtccaagatagcatttgggattgagtggatgaagagaaccattgccatgagatagatagtttgcatgaattattctgttttcttttttacaagtttatagttagtcactgtagcttttaattactcaatcgaaatcacaccccaagtaaaaaaaaacagctgacgtgacattatgacgacgtgagagttatgcattactatggaaagaagagggttcaggctaaattatgccacatcatatttctgaccaaatggaacagggccaggttaggtacgtactccctccgtcccataatatatgaaattttaagtttttacttacaacatttgaccactcgtcttatttaaatttttttgaaattattatttattttatttgtgacttactttattatctacagtattttaagcacaactttttatttttaatattttttaaaaaattgaataacacgaatggtcaaacgttacaaacaaaaacttaaaatccctaatactgtgggacggagggagtaaatgcaaaatgcattatccccaggccgttggctaacgaaaccgacgcgtatggttcttgtcggtgataataaggttgattgcagcatgtacctgcttttgatcgagttactgatttggaactaacgatcgatcaagctcagatattttgggactggacggcactccaaacccatttaaggaagcttgtttgcgcgtcacactccatagctgccaagatgtctgcactcggagtctggactctggacgtactacaccatccgctctttaaaaaaaatagatgtgatccctcgtaatataacgaatctacgaatctggatattgtctaaattcattgtattagaagagatcacaatcctatttagattaagtttttttagggagagagtaagtctcaaatctcaacaggggaataggttagcccaatcatttcgcttataccgatctttttgatagttcaaaggcaacgaacaattttatattataattgatgatcacagtgttgaaaaaaaaacacaattcagatatgtataatgtactttaggcttttaacacctaaacttttgtgtgtagatcattatgacaaattaaagaaaaacagactaatttgattttgacctttaatccagcctcagcgatggtgattgcctgattggtggtgagagtgtataaatgaactggtgaaatattagcttttgtactaattctgttgcgccagatctcagagataagtgcaatgcatcatgcactttgcaagttattagtattttctccgttttatattataagattttctagcattatcacattcatatatatgtaaataaatctagacacacacacacacacacatatatatatatatatatatatatatatatatatatatatatatatatatatatatatatatatatatatatatat

SEQ ID NO: 14026 - DNA, 4239 bp, Oryza sativa
ctgttttaaaatatgaaacggacgaatttagtagttagttccactgttaattcacttactccctctgtctcataacatagcaacctatgaccggatgtgatatttcatagtacaacgaatctggacatgtatctgtccagattcgttgtcctataaaatatctcgtccgattcttgattgctatattatgagacggagggagtaacatgcatcttactatcttagggcatgttcactttgataccattttcaaccatactaataaatcctggtaaaattttggcaatattgacatgttgccaaaattttggtattgccaggtttattttggctacagtctgaatatgcccttgattatgcaataatgctgtacacgtacgctagttagtactttagtagtgctggaaccagcacgtacgtgcgctcccgtggcccgtcgacgtccctcccagcaaagcatgggaaaacgatcgagctagcatagatcaatgcatcaactatcgatcagcaagtatacatgaacacatgacattatgttgcaagttgcaaccacctaaatagaccaaattaaatggaaaatttaatttccttgtgctctttaattacagttgcattgcgcagcatcaacgatcgatcgatgcctagacggattggctgttgtattttttttagataatggaatataacatctcggtctttactcaagagagttacagccaattattatagagaagcacctaaacaagaatgtagttcaacaaatcattgaaaacacccaatgaacaaaataagtaacgaatctaaaataaggagaacacattattgaagtctatttgtgaatctccaaccataattgataaaaagttgcataattatcgtctcaagtttgcaacatgcaacttgtttatacccaaatttggcacctatggacgaaataggggaaaattgccaaagtttagaaagtgacgggtttccttcacagggccgatcagaccacaggtgtgtgggcggtctgaccggccagtagggccggtctgaccgcaggtatgtgggcggtcagaccgtcagggtccgagtccgagtatgttttcgtcgggtctcgggtttccttgctcggaaaggcatgtttcgagtttcctttaatttctatcccgagttggacgtggagaagggcctgtagagggcaagaccaacccctatttaagggacaaggccggttcattgtaaaacccccgaatataatctatttgaatcgttcttttactatgttttctattttaccctagtttagtccatctttgtcggtttgcgccgtaaaccatccgccgctgctgcgagagtgcgacacctctttgtaggtttgtcttggaaaccttccgttttgcccacgagatgggtagttatcctcatatcgatttaaatcggcctaggggctgattttgatctctaaatcggctccgctagccggtttagctgtttttctccaaaacccatcttaatttggccctttagctagatcgaggtggttggcgactctaggatcaccgcaaggcgtttaggtgctacgatcgtgcttgtcgacttgtcacaaaaagttgccaacataacttttataaactctcggttttcttcaaacttttgtggttgccccggtatcggagatggattggctattgtatacgtactatgtgtacttataccaaaagccgaattgccaatcgagctgcatgccacgcactgtgtgtgtgttggcaacacctgaccgaccgatccatgttccgtgatcgatcggtgtgcgtgcagtgtgcagtgcagtccagggcagccggtggggcaaaaagggcgtgaaataatagggatgagatcgtgcgtttgcacgcacgcacggtaggaggagtacgtactgttggtgaatccgcatcgcactaacagttcgcgcgcgcggcggaggagattcctacgcactacgcagccttttttatatcgtaaaggttgagcatcaccaacagaacgtgaataattcaccttcaaaattttgttattgggttttctaaattaaaaataagaagtgaaaatatatctctctccaagagaaagtctcaatttaatttcaaaaactaaaagtaagcactactgttgaactaccaaccgaaataactatttttccattgacccggcgcggaaaaagatcgttcctccacccagcccacgcgcgggaagaaaaagaagctaatgggtatgagagattagaattgggagatgtggcgtcgttcctcctcaaacgaagagagtgatggatgtggtgatgaggtttccaaaatatcataataggatttgttggaggtattatttttcactaaaatccaaaaaatcaggattggggatggaataaaagcactgttggtgatgctaagggcgttgccatgcaccgaccattaccagggaggcgcgcgcgttgtgttgcggcagttgcacacgccccgctgtacgtgcgtgcgagagagatcgactgaaatcacgagtgtttcgctaactcgtaccgtcgtgcggcgtcgcgtggagagatcactctcttatatccaaaatgatttaaaggaggagatatgacttatagggtatgtcacattttatacgaagatgaattattttgagacggagagagtagacagccgagactggattgtaatttgctgagacgacaaccggcatggcggcagcaaattacagagtcttacctatgtgcggcgcgcatgcacgttcattgtacggtgggccgtggaggtgcacgtacgggcttctaaagtcgtgcgatgatataattgactttgtatgatctttttccaaagtcgttggttttaaggatttttttccctgcgagttgtataaccgtccgtgcaatcataatccatttccaggtaattgcaatcgtaatccatttccaaaaaaaaccaattttggaggagtggggatattacatctcctatatagaacaaaaggttcagtcttttttaaatggagtgagtatgtactgtgctactttacaaaaagaattcagtatattcatttggcaaaattcagtgttatcttcatttcggtcaattaagcaggccaatactgggccatatgatggctgaaaaatatatacttactccatttcatattataagttatttgatcttttcttagtcaaagtttttttaagatttaatcaaatttatgaaaaaagataacatctacaacactaaataagttttactaaatttaacattgaatatattttgataatatgtttcttttatttatattgaaaatgttactctatgtttctacaaatttagttaaatttaaagaagtttaactaaaaaagtcaaatgacttataatatgataaaacggagggagtacatgttttgcttcgacaataacaatccttgatgccctgcaaacatgttaacaccaaaacatttcccttcccatggcacacaagtcacaagtctccgttttcgtttcaaaaagatcttacttcctccgtttcacattgtaagtcattttagcattttccacattcatattcatttaatgaatctagataaatatataagtctagattcattaacatcaatatgaatgtaggaaatactagaatgacttacattgtgaaacagagggagtagataagtatccagaaacaagatctggtccactaaccggacgcggtctgggccattatattatgggcccattataggcctatataatggcatatattaggaataagttcacttagactcccttaattagcgaccgaatctaatttacatctcgacctccaactattaaaacttccttgatggttttggaggacggtttcgctgatgtggcacccacgtggcaatgttggccttgtctgtggtgtgcacgtggcactcaggtgacattagaattaaaaactttcaactcattctaaaacttttaatttaaaatttaagaaattttaactcaaaattcaaaaactttcacctcaaagtttaaaacctccaacccaaattttaaaactttgagtttgatttttttaatttcaactcaaatttaaaactttcaatttaactttttaaaacttttaactcaattgtttatatatcattttattataaaaatgctaaacatggattagtaatgttattaatacctagaaggaattagcggcgggaggtgaggcgtgccgcgcgctaggatcgtg

SEQ ID NO: 14027 - DNA, 17323 bp, Oryza sativa
aaaaattacttccaacagatttccataactaaaattttttgggatataattttagaatgctcttgatgattctctaataaacgggaacatatctcccttaactgcatgacgtcaaagcgccaaaaagtagtataaagaacatgcagcctgatagatggataacataaggacataacatgcaatgcaatgaaccagacagaaccctgaatatgtcgaaatggagagccaccggtggaatattagtactatgacgtaggctagtagcaaatcaaccatactggacatggtgggcatgcaaatcgaactctagctaaccgatgaacaaaatggctaatcgtggaaaatcaagggtggccttgggcagcttgaaaaggaacaaaatgcagatccagcaggtaactggccaaaagaaagaaagaaatagcaactgagtctttcggcggttggccccaaccatgaagctgtggctgtgtttagtttcacatcaaaaatagaagtttgaagaaattggaacgatgtgacggaaaagttggaagtttgtgtgtgtataaaagttcaatgtgacggaaaagttaaaagtttgaagaaaaaaattggaatctaaacagggcctgaataatcaacaatttaatacaactatagaaatagcccaaaaatagtgaattttcctattgcttgcttcattgtcatcctcctaaggattgaaagggagatgaatagagtgcttggtaggacatgataatttaaagcacaaaactcccaaatggaataagatgcattcgatccattatcttcacaaagatcaagagtagttcatttcaacgttccagatttgacatcacaaacatttgtgttattatgttttcagctcacacaagaaaggtatacatgcactttctctccacagaacagaaggcaaaatgatgtgtgcactaactcagcatatatagcaagccttcagtaactggtaacctgatattaatcgtaagttcttcaatttcctaaaagaaaaaaaaaaccttcagttttcaaacactgatggttggtttcaatttctcaggccaggtgtactgaccttcatgctaaactaaactgattttacatcaaagtacaataagtactaaaatcagtagatgatgaatacctcagaatagaggcttaacatggtaacattgagcaaatttcttgtttaagcaattagtacaaactacaaagtgccgatgcatgaattcaacaaactaatgtgttctgggtgataaaatacaacaacagtgtcctgcagaaacactcatatgaactagctagctacaacaaagccatatgtgcttaagatacacggtagttcaaaaatattatatcaagcacaacatttgagactcagcgcacataattcacgagatgttcatgaggaagcagggcatgtattgacaccattcttgcaatcacgagtaagatcactgaatgtctccaatttcctcttcccccgaaggaacacctcagtgtcaactgcaaccctcatgtatccatcgaattcaacagcattaccattgctcagctcctttgtttcagtgtaccactcgctgttctcatcccataaatccttgaagtcatccaggaagtgtgttcgatacttacccttcattgggtcaaagaatgatttatcgggttcattggttgcaatgtacaaatgccggccagcaccgaccttatcattaagtgtcgtaaggagactatctggagaagtatctctatcaagatttggccacaactgtttgttctgggctttctcccccctcacaacatggactgaatcaaagtcccaatccatccgggaggaaatggcagacacgatctccatcaatcgacgcgatttccacaataaataccatgggcgcttgatcactgcctccgtctcaccctcacatacacgagaccagaagttatcaggctcaacattcccaaacttcctcatgatcagtgtgtccttgacgtcacgaagttgcatcggggtcaccttgatgtcttcagtgtagtgattcttcagtctatccttcttgtgccacttcccccaatctgtccagaactggctctggtcaatgaccgatgctgattgcttcaagtgctcaaaatcaaagtagagcctaaaatctctctcttcatccttgccacttgaagtataccgtgaattgaggcacacattaaggtccataacaagtgtccggttcaagtactgtgcctcaccaagtgcacacaagaatccccaaacgtagtggttcatgctcttgcatctctcaccaccgcccatgtagatgagatactttccgcggctgaattcagactcagattcgaccaccggtaaattgtcattgacagcttcaccgacaactagctccggctcggaggcggccgtggtgtctgcattggcagcgttctcatcgagcctcatctgcgtcttggccggcacaaagtcggtgaccggtgcctcgcgcttgcccttcttccccttcttgcccttgcggcggccgctgcgcttggcgccggtgccggagtggtactcgcccacattgccgacgacgaggttgcaggtgttgacgtcgcgggtgagcgtgaagcggcggtagtccttgtagtaggtggtgcggccgttggtgtcctcggcggggcggaagcgccatgcgaggtcgcactccatggggctccccggcacggcgacggggcggccgaagcggtagaagtggaggtcggagaacttctcgatcgccgtgcgcatgagcaggttgaagagatccttgtcccccgtgcagtccaccggcgcctccgtgtcgcaggagaccgcctcgacgatggggttctcctccgccgcggcgcccgcgtccgagctggcgtcggtgtcaacggtgacggcccgctccgcccccgacgactcctccttggtcgcgacgtcctcgagcttgatgaacgggacggcctcggcgacgacggtggcctccgcggcggcggcggcatcggaggagttggcgccgatggcggcggcgaagtcctcgccggtgcggaggacggagtcgtcggcgaggaaggtggagttggaggtggcggaggtgaggaacgcggtgagctggtgcgatgaggggtggaggagcgggtcgtcggggctgtggaccgcggcgaggagggtgaaggcgaggacggccgccacgaagagcgcgaagaggaggttgcccccggagcgcagcgcggcgcgcaggtcgatcccgatcccggtcccggtcccggcgccgccgcgccaccgcgccgcggacagcgcccccgcccggcccagcattccgccgcccggatctggccgccgcggcgaggggggaagagtgggggagtgagagcgaggtggggatctgggagtgggaggagtcgccgacaaggcgagggtgcgtgcggcttactccagtgttggtgtttttttactggggaatgtggccgcggttgcttgcggtggtcgccggcgatgggcggtgtcggatggcccgttgactggggtggcccgggaattgcggtctgttgttgtgggctttcatgggccggaatttcgcttcttttttttgaataagttcacatgacgtccctcaactttacgtcgagtctagctgatatccccagtccacaatatcagaaatctatacccctcaactatcacaaaccgtgcaaaaaaaaaaaaaaaggtcctgagacattattgactcagtttttcctaggttgcgctgacgtggcattacgtggaccccacaatttagcgtcctctattctcttctcttctttttcttcttcttcttcttcttcttcttctcttttctctcctcttttctttcatctcctctcttctctacttcaccaagactgagaggccagcgggcaaagcaggcagggggcggcgcggctatgactatgagtacaaaagaaacaacagtaaatttaataatcctcaggtttctaaacgataattagattcacatttaagccgcagttgtgctgctcttctctcttgcgtgaatttcatcaagcatgtttctggctagcggcgagatcctagcctccaactcctagaagtccacctatacctccgccgcctctgtcttgaagcccagcttttcatcccccttacatgtactcgtccacctcgtagcctcctatccttaccaccgcctcatacaccctccacgtcgcatgcgccctccccttcaccaccaacgcgtcagcttgtacaagtcctcctccccctccacgaacctgccgccttgctcattctcctccaggaacgcctccacgagcgcatccacaggggcggcggcgccgtcctcgattatcggcgaggaggacacgaacgtggcatagatggccaggtcggcgtggtaccaaggttcggcacgatggaccagtagccatgacgctggagctcggccatgtggcgaggaggtcgctcttgaggaggcggccgaggagcggtcagaggaggtgaggcgcttgagggattgcacggcgaggatggccttcgtgtagtgggagcggccgcactggattgcgccatggttgtcgcacgggccacaggtgatgcgccccgcccccttcttgctttgctcactgcgccgctcgccgctgcactcgcccgctgcccctgcctgcttcgccttctgcctgcccccgccctgccaatctcgctgaagaagagaagagaggagacaaaaggaaagagtagagaaaagagaagaagaaaagagaaaaaaaagaagagaagagaagtgaagtgaagatatgacactgacatatggtgcccactatatgccacgtctgtgaaaccgaggaaaaattgagtcaatattatctcgggaccttttttttttcacacggcttgtaatagtataggagtagagatttatggtattgcggattccaaatttgatcaccgtcatagccatcatagtcgatccaacggaaacataaacatcgaggacacttcaccaatatgaaacatccagtgtgagccaccaagtaaatcgtgactcatcttaccaatcaacgactcatcttaccaatcaaataaaaagttaacttatcttgtacatacaactatttttctttataaacgacctcgtgctaaaaacatactacctcctttcttaatatacgacgctaacgctgttgactttttacatactactcatactattaaaaaaattaagtaaatatttttttcttgatttatcactaaagtaactttgagcattacttataatttttaagatttatataaattttttaataaaacaaatgatcaaagattgtgaaaaaaatcagcagtatcttgctccctccgtcccataaaaaataaatctatgaccggatgtgatatatatgtattgctagatttatagtattaggttggtattttatgggacggagggagtaaatgactatatcggaccttccaattggattttacccaaccgagagagttactgtgaaatttaccccggcgagaaactgtggaggctgaaggggcaatcagccaaacaagtaggcagttggcagagtggacgggagacgggagggaggccaccatggagagctcgccgccgccgccgccgccgaccatcaccgtccaggtcaagttcggcggccgcacgatcccggtggaggtcccggccgccgccaccgccgccgacctgaagcgcctcctccagccgctcaccaacgtcctcccccgcggccagaggctcatctgcaaaggcacccgattccccctcccccacccaaacccttgacctcctcctgaccgccaatctgcttccgattataggttttggatacttatcgttctcttgatgtggttgcagggaaagttctggcggatgccgccagcctgagctcgatgcaggtggtgaacggatccaaggtcatgctcatggcctcgcaggggctccatcagggggtaaattaaattaaccgcctcatctttagtgtttttagcaattagctccttttggaatgtggtgaggtacagtttgatttgagggagccttttgtggttgccgaagttgaatgacgatcagaattcgttttgtaggtgcctccatatgttaattagcttgattttttactccgattcgacaccatttcctcttaatattgagattcgtgaactgtgatgtttggggtaaatggctgaatagtttgtagtactgtcatatccttgacccaaccgcacctcaaggcaggattgcctatatgctttgcccgtttgccgcttgcgctaatgttctgtgggacgtctgcaacagccacttttcgcaacaaaaatatttgccatttcacaattgctacaagaaatcaaggacaagctcagtctgtggaaacatcgcatcaaatgcagacatcgcagccatatcaccagctggttactcgagctcagctgatctatgctgcattgctgccccaaatgggagtttgctgcaacaacatcaagatgaattatgctgtaaaatttgcttttatctttctttttcctgttatatttctttctgcattttcttctctttcctttctccctttctctactccttattgtacttggtttttccttttttctcttctttcttctttcttctttttctttttttttctcttttcttgtaccctcccctctatttctctgtactcttgacctaccattaatacaatggttataaggtagagtctctctacctttttgcttaaaaaaaaaccttattgcagtgccaaagcagcgtgagaaatcaatttcttgtccaattcattgtattgagcttacatgtgttccactctccaacaggacggtcccatcactaagaatagtagtgttccagcaccaagcacgagaagagcctcaaatgtgaaggaagctcaaatacaaaagtcggatacaaatgtcagtaaaatccgacctgaacgttggaaagcaactggtattattgcattgtctgattccagcttgaaggtaactgattccaactttcttacattacttttaaactaagcaacttagcgtagttatgctttgaagttcatgaaactttccatgtctgcctttctatcaaaagcaaattgaagtgcctgtgtcaaaactgccaatcgttggtaaggaaaaacatgcacatcgctagagtattatttgtatacttttgtagtcaccacagcctgtagaaaatactataatagtcttgaacatactttctttaatgcatctgtttgcaaaatgctattcatgaatcatgattggaagactgatttatatggcacaggcgcacagccatttgactgccgctatcaactgaatcaggattttcagtgcatacaaggcatctattattcatcaccacgtgataaagcaggccttttagttgttcagcattcaagaacttcattgatattccttactatccattatctttacccttttgaattaagagtcttattagctgtttctcacacttttgtttgttcaacacttagggtgtgtttggttgcctgtatgaagggtggctcgcatctcctcagcaaaattcgctgtgtttggttgcctgcatgggcatgggagccaggctcagctgatgcaaaaaggaccgttgggccaggctgaggggaaacgcaggaatcgaccgtagctcctcagccaggctaggctcatgcacacgcggggatgagcgggtgcagccgcgggatgagggggtgcaggcaacgggcaggggtcgagccatctcgcaatcccctcccctcatttgtttcctcagcaatcggtcgccgtcgtctccatcagtttccctcctcttcaacggcttgagcccgggcagatccaggaggaagaaggctcgacgagggtatccagccgtctggtgagctcgagctcggccatatccaaggaagaagagggccagatccaggaggaagaagagggcaagaggaaggagggctcaacgaggatacccggatctggtcgcttggagggcaacgtcgccaccgccggcatcatcttcctcctcttctcctcgttctcgccggcgctgtcttcttcgttggctcccaactccctccttcaggacctgcgatgttccggatccagtgggcagggcgtccggaagcaacagatccggagccacaaactccgacgacagcgacagacggggcgcaagggggaggagcgacgagcggcggtcatgggctctcagcgtcagcggtctctgtcgaccagcgatggggacgaaggcttcgagggctttctcttttcttttttttttccttcttttcttctttttctcgccgattaagcccgtgattaggaacgtttacttgttttctttttcttgccgattaagcacgtgattaaggaacgtgtactgctactgcgtaatttaccgtttcgatcttttattttgtgaaaattaataatacagtcctgtcatgttacaatttattgagtttctatttgttctacctaattaaatttgatactacattttgttcaaatttgaaagattatagattagataatatttatgtatggttggctaatatcaccatccaaataaagagacaattgagttcaaagtacatgcatccaaccaaacacaatcttttgcatacaagtttttatatccaaccaaccaaacaatatctcatacgagccgggctcatctaatacatacaaccaaacaactcctattgcatcattctaaccaggctaaacccagcctggatgaggcatacgagccaggctgagtgcattcgagcaaccaaacacacccttaatttcacttttggttgaatttttgggcttatactgtggttgtcttttcgagtaggcagtgcctgaagaagtatggggctgtggttcttctattagagtactggatgtcagtaacaactgtattgaagcaattccacaagaaattgctgctctgagatctttacaggtaattgttcttccccaatatgttggttgagacatcttcttcattcacaaggaaatataattgaatgtatcatcctttcatcttgtagaaattgatcctgactgctaatgatatagctgatgggaacatttcctgggaaggcctaacatgtgttcaaacattaacagttttatctctaagccaaaatcggtaggtctgatttttcaacatcctgtttcatcatgctatgaatatttgttttgttgccagtggatataaacaaccctttgtaatttccttaaataatcttctctttgtgctctcaataatgaaaaccgctaagctataatttttttttctccagactcttatatatgttcttagattcacccacctaatatttcaaactccacttaaacagttaggctcatacattgaaaagaaaaatgtagcaatgcataatatcttaagctggttcttttttgggttaattagatacatgccattaaaaattcaccggttttgaaatataccattactatttgcgtatttggaacgatgccattgatatttgtttgtaatttcagtggtgccactaagacacgtattttgcatgtattggacgaaaatgccctcatcttctacctctctccctcttctctcatcttcaagctctctctccccgctgcttcaactccggcgccgtcaccgccgctgctgctgccgctgccgcgccgttgctgctcgatgccgctgctgctcgccgctcgcgctgctgctcgccgccgctccgcatgctgctgccgccgcaccgccgctgccgctcaccgctgccgttgctccgccgccgctgccgctcgccgctcgcgccgctgctgccgttgttactcgccgccgctccgcacgctgccgccgccgctccgccgctgccgctcgccgctcgcgccattgctgccgttgctggtcgccgcctctccgcacgctgccggctccgccgctgccgctcgctccgccactgccgctcgctccaccgctgttgctcgccgctcgctgctgccgccgctccgccgccgctgccgctgctgccgttgctgccgccgctgctccgccgctgccgctcgccgctcgctccgacgctgccgctgctgccgctcgctccgccgccgcttgctccgccgccgcctgttctctgagctgtggaagaaggagaggggagaaaaagaagcaaagaagggtaatttggtccaaattttttcgtaaatggtaggtagtggcatatcttgaatatgtgtaaaattgtaatggcatggttccaaatacgcgaatactgatggtatatttcaaaactgataaatttttaatggtatgtatctaattaacccttgttttttcttgaataactggaaaggccttgaggtgctcagtttatctcagtggtttatgtggtgcaaattgttcttgtatcccttaattttcctgtcttgtgccagcacccgtgtcatgctgggccagcaatatcaaaggtgccagggcaacctgtccacggtagcagattatgggcatgctggcaaggcacagtagaccttaggtctttatccattaggaagtttcatgtccgccattattgtttagaattgaagatgacgagatgatatgttctaaatttataatttttcatgcaggctggtcactttaccttcaagtttgggctcaataactcatttacgtgaacttcgtattgcaaataacaggcttgagaacttacctgttgaaatagggttactgaagcatcttgagattctgatagcaaataataataggtactgtgctactagtgcttaactgaagtgactcattgaagtctcatttttttgctatgcttatagcataatttacactttgtgctaatgtgaagagttacctcaagagaggatttctgtatataatatagttgttgatagatttttcacaatcatgtgagactttcagcctgtgagcagttccattatagaaaaacttttaaagaaaatgtattctatcaagccagaaaatatgtcttttcttatacttctaatgagaatttacatgattacttttgttttgagaattgaaaggtatcctgacttccacactgctacaatttcacttgttggcaggataacttcattgccttcatctataggtggttgtgaatctctcaatgaggtgtgtgctttatttctgtttcagttttccttctagttctaggccatactgagcacttagctcttctgagtttccatatggcaatttctggttcatcaaaatttttaatttcattaggttgatttgtcatcaaatcttttggctgaactgccagaggcttttggaaaccttcaacatctcaaggtatgtgcctatgggccacacatggagaaatatattccttaataaaagactaaatctgcatgcatacttctaagctatcttgttcctagcattgaaacaagatattactagtgcccttggttcaagatggtacaactacatgcttactcccccattttaaggaagtttaagttgcatgttcataaccaatgaacatataaaaatattatttcgcacaacagtaatgccacaacaaacctgatatgtgagtagtcagcgtgaaacattccatgcaattttgtggtatcatgtagcctgcaggttcagtttgaacttaattttttatttattatcagcatacggtggacaaagttttggcttatgacttgacagttgagagagtcatgagtatttatcgttcatttgttatactccctccggtcaaaaatatttttgtcggaattttaattgtttgaccaaaccttgtcctaaacaacagatatttttgactggagggagtatatgattattgcaccagatcgttattaaactatagcattactagctaaacttggtcaaaagatttactatcctgctgcttctagttgttcactgtatattatttatgtcagagcagatggttatttgtgctttcctttatggtgatattttttttccattcaatattttttcttttgtctagcatgggtgtaataatcagttacattgtactgtcatcagtttctaatgttccttttttcaaaataactttattccatcaggctttgagtgtacggaacaatggtcttacatccctaccttcagctttcttcataaaatgctcgcagctcattacacttgatctccatggcactgaaatcacaaacgacgttcttcggcaggtataagtgacctaagtgacccaaggcttcacagttatgtagtgtttgttactttgttatggtcagtactctactgaattaagatagctaccagcatatgcttaagacctggacagttcagtaatcactctcttaaatagcctattggtttcactttttgggacgccaaagttgatacccaccacgttaaatacataatacataatacccacaacgttgatcaagttatatagttcagggtaaacatgtggtgaaaaccccaacttaggtgacaactcgtgtccatctacatgtgtgatttattttgatgaatttagacgacttttttggcttgggtttacacgagttttcacctaagttgggatttccaccatatatttacctttccgttgcgaaaaaggcggataagtcgtttatttgctagcggttgctttcattggtcctggctctgatggagacatttcaaccttgccactgctaatgccagtttttacttgtggaaaacaggtggacggttgggaggagtttgacgaacgtcgaaggaagaagcatcaaaagcagctcgatttccgggtgggatcatcagttgtgttcgatgaaggtgcggatgacgattacaggcgtttataaataaaatctctctttggataagattgtgtattttatgtctccagcttaatccgttgtcgcaagaataacttgtatacttaagaacaaattaggagctgatgttgctactcacatcaatcctagatatgtacttgtacttcatcctttttcaaaatcccttctttttagggattctttaaactgtttagggcatcaagagtggaaaaacattactccgtccatttctatttactcgtgactgttgaccaatcctgttgtaactttgaccactaataaattttgaatggtttgaattatgatgaacggaaacttactggattcagatttgctatttcacttgacagatttttggctcctatctttttttttccgtaggatcttgcatcaagattatgatatcatacttacagttatacttagttacaaaatatttacactcagttacataacacttaaaatcagttgcatagcatttacacttagttacaatgcaccaaaattagatttttacaacatttttttcctctagatttacgctttttgacatgtttatttcatttaaaaagggctatatcaattagttaaaaattccgtaagattcaaaactataaatctatcgaaagattaataggtagtcccggatacggatacaacataatgccttttttgtaaatatggataatatcaccctataaacattccatattttaatatgctgtgcggtctccctctctgttttacggtaaagtaaatatggataatatcaggtgccaagtggagtagtattaagtgacggagggagcagtaatcacttgtagacattagagactttatacgtatatatatattagaaaaaatccacgttgcaaccttgcaacggttggaggctattttaatcttattattgctactatttagttaaggtgaaatttactatggaaattcacttagtgatatattttctaagaaaatcatgagatgcaattagtagtctaatgttttttttaaagaaatttcttatacaactccttttgtattttaaaaaacgaacgaacttagaaatagactcaaatacaaatctgtgtttccaaaagcgaataaacttaaaaatagactaatacatgggtgatttaccaaagtaccgataaaaatatatttaatttttataatagtagaaatagagatagagatagagaaaaagatagagacagatttatcatgtactgtcactctacagatagagtattacctcactaaacattacaaatttattattattttattatgtcactatacaactgtcactctacatacaagccaaagctattcatttttttttattccaacacaccaacaataatactcctataacactccagcttatcggagaagcacacgaagggggagagagctcggtcacgcgaagccgccattgacccggatgacctggccgttcacccacgccgcggcgtcgctgacgaggaaggccaccaccggcgcgacgtccgtcgtctcggcgatccgccccatcgacctctcctccaccttcttcacgaacgcctcgtccttccccgccatgaacagctccgtcctcaccggccccggcgccaccacgttcgccgtcacccccttcgccgccacctccttcgccatgatcctcgtcatcgcctccaccgcgccgttcgtcgccgtgtacgccgcgtacccggggaggagcgtgccgaggatggacgacgagaacgtcacgacgcggccccccgcccccgccgggaagcggttcgccgcctcgcggcacaccaggaacgtgccgcgcacgttgacggcgagcatggcgtcgaagtcctccacggcggtgtcggccagcgacgggtacttggactccaggaggcccgcgcaggcgacgacgatgtgcggcggcgtgccgaacgcctcctccgtgcggtcgaacagcgcgcgcaccgccgccgggtcggacacgtcggcgcgcacccccacggcgcgcgggagggcggcggcaccgcgggagttgaggtcggcggcgaaggcgtcggcgttggcggagttggaggcgtagttgacgacgacgcgggcgccgagggaggcgaggtgggcgcacacctcgcggccgatgccgcgggagccgccggtgacgagcgcgacgcggccgtcgagcgggagcgcgctggctgctggcgccgccatggcttcacacgcactcactcgctcggggtgttgctgcttcgcgtgtttgtttgggcgcgcgagtaggattttttggtgtgttgaggaggtgcacgatgggcaagctagggtcctttttatagacgaccaaaagctgtaaatgtgacgtacgcggtgacactgggctgggttgatttttactgctattgttatagatgtgttgtgaattatcatgttcatgatgcagccacaaagggccacagggatgtagtttacttgtgatcatatgaattgctatgttcatgcaaaagtaattatttaattagtatgataaaattaacataacagatagactattgtactagttggcttcagcaatagctgtaaaatgatgtggacataatatagccagcagccgactacactattaatcttgctcttatggtaaggaaaatagccctcactgtcacgatgacttggctgagttcgtttagaggagatgaaaccgatctcctgcacacgaaaaacggagcaatgcattagcacgtgattaattaagtattagctactttttttttaaaaaaaatgatcaatatgatttattttttcaatatgatcaatatgggcaagggtcttttttatagacgaccaaaagctgtaaatgtgacgtacgcggtgacactgggcttgggttgaattttactgctattatggaaaggaaaatagtttttttcccacctgccctcactgtctcggtgagtggtgagtggtgacttcttcttttgaccaacttctccaggagtccaggttcttagcccccggcgcttccctgtttaatccgttatttgttagtaacaaaaaattacttcctcagttttatattataagttgttggaccttttgtttaaattttattaagtttaatcaagtttatgaaaaatattagcaacatctaaaatataaaattattttattaaatttaacgttaaatatatttttataatacatttattttgtgttagaaatactattatatttattttataattttgttcaaaaagtttgactaagaaaaaaagtcaaacgactaataatataaaacggatggagtaatacataggtatatcttctatataagtacgtggtcttagtgattaaaaataaatattgtaaaataaattatgataacaaatcacaaattatgtttaaaattaagttttacattttaaattttatagcttataagtatgaaaacgatgatagcagctcatcttctctgatcactgatcggcatcaagggacaaccagacaagcgcggttgctgtggttgtttaatcgatacgtggcgccgtcatacatagtaggataactatagtggcggctaagcaatgatattatgtttttgtctcaaaagtatggagatgtgacggacaactaggctatgacttttaactaggttggatatagtgacgaagaatacgtactcatttgaaagcagctataatagcagactataagctaactataaataaattttaaaaaaaataaaagagaagagataagaacagtgtgctacatatttgtgggaccggacattaatagtgtagtatatgtttataggtaactattatatgaatttgctatcaaatagactatagatgatttggagctagtagtggactgtactattacttgctccgataagaacaaatgaacgcaacacataatatatttatattgtaattatataaaatagtataatattataattaacaacttaaggcataaatcatatgagtaatcaccacacatgaattaagcgagtttgtcttgtaatggtcttaacatcgttgtcaacccggcattacactagcgaccggaactctctaaacctaagaacaaattaatactcaaattctaattacgagcaaccgcgtggctagataaaggtaccatcactaattgctaaatatttattctgaaattccaaatattgatttttttaaaactagacaaacataaaataaatgaatattttatatatctaaaaaaattatctataactttcgtgtttggagaacaatttaactagggactacttttggattacccttgcagcaaagaacatcaatttgaaatggatttcatggaattccccaatttcctcctttttccttgctctcttcttccttgtcttctaaattacattgttgaaaatgtaaaagtttatcgcatgagactatcacaattatgaggttgctgtgcaacaca

SEQ ID NO: 14028 - DNA, 9062 bp, Oryza sativa
  unsure (1)..(9062): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtacccgccattgttatagcttactctatgagctatgactgcaggaagagatgagtcttgagtgaagaattgcatgggtatttatagtgcttgaggccacatgcaacactagtttcgtgatagcatgcacgttagcttttttagttggcaactcccagtaggatataatatcaagttgaggcttaaagaactgtagaaaaaagagctcatttacttcaagagatccttgctaatacatatccctgattaattacatatcaatgtagttaattgcagccacttgtattcctccctccatcttagagcaagtttaatagtatagccaactactagctccaattcatctatagccaatctaatagtccgttcatacaatagctacatactacactattaatatctgatcccacatgtcatacgcacattgtgtcttgaagtccgtgctacagttggctataaatctgtagcccgctgccattctctctcctcatttatcttcttaaaatatgtttgcagttgacttatagcctgctattgtacctgcacttagacgtattaatttcatttgtagtactataaggtttcttgtgttaacgaaacaaaatgcatcctatatttttaaaatattttaaagtagagagagtacttattactgaatatacgaatatacaaaaggtgactcaagatgcagagtgcttctatgctctaaacaaattgattgactaattacagtactacagcctggtaaactcttaatttcaatgacttccgcaaatcagcacgaccatctatgctgctaattaatgaataaaattacagctagaagaattgacattacgaggagacttcgaggctctcgactcgatcccatcgctgctgactttgacacattcaaacgccgttttgtactagtaaaagtgacaaattaaactgacaacccgaccagtctaccacacacagaatacttacaagaaaaggacagccagccgatgaattcatatggttgcatgatctgcatgcggagaatgggatgaatgagcgagacgcgctgacacaatcgttttaatagtgcttaattaatactccctccatcccaaaatatagcaatcttgtactggatgggacacatcctagtccaacgtacaagattgctaaattttgggacggagggagtagactactctctccgtcacaaaatatatgtaagagattttgatcggatatggcacgcactagtactaggatgtgtcatatccgataagggattttcatcgaatgtgatacgtcctaatatcacaaatttagacttgattcgtggtactaggaaatatttcaatgaaaatcccttatattttaggacggatggagtatctcttagtacagtgccttctctatgtggattattatttgaatacacaaacggcattctaaactttaagagcaggtacaatagcagactattagccagctataaacatattttaatgagataaaagataagagagaaaagcagcgggctacagatctgtagccagctgcagcacggactccaagacgcagtgtttgtatgacaggtgggaccatatattcatagtataataagcaactattgtatgaattggctattagattggctatagatgaactagagtaagtagtgggctatactattaaacttgctctaagcaacaattaaacagtactactgtaaaccacgttctagcacttaggggtgggcattcggtctaaccgaaaatttcggtctcggtcttcggtctttcggtctttgaaggacagacaaattcggtctcggtcttttcggtctcggtctcggtcctgaccgaaattcaacagcattttcatatatgtaaagaaataatggaaattttcaacacagaaatcacaaaaaaaattcgtatgcacttataagtaaagactcttattaggttgcatgcttagaagaagtagggatgtgaaaattagagtttaatcctattaaacatagtggattgtaggttgtatttagactttttttttgataattcggtcttttcggtctattcggttacccgatgagactaaccgaattgatgaccgaatttctcggtctcgatctcggtcccggttttttcggtacgttcggtctttttctgcccacccctatgtcacgccccgaactagtcccgaccggaactagcccgtgacgctccaaattaacctgttaatcgataccagtcccaggaaacagtgctggtatcacagggagacagaatatcacagcaacagaggtctctttattatagagtagaagtacagtcatgttgggctgcggacagatcccgagctcacaactgcattacaaaaggaaagcggaagccaggacttggaccaaacatcacaggcgcgacttgggaactaggccgaaaccctaaaactcatcgtagccggcttgctcctggaagaactcctcgtcagcaggatccacttcatcttcttcagcaactgggggggattatttatatagagcaagggtgagtacgggagtactcagcaagccaggggaaatgagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaaccacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcaagagcgggaaaccgtacacccggtacgttccccggtccgcggttttggaaattcatttagttcgcaagcaccgacccaagtgtcgggttttccaagtcttttgtaaaactccagttttacccaagttgttactcagattttaagtttgaaggcgaccgtcgatactcgcacagagtgcacgaatatcgaggtgcaactgggtggttacaaggggacatagtatggcaattaacaatggaaggatcaaatgcaataagttaggtaagtccgccaatctgccctacagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaatagagccctattaatgacctctaagcgtgccactagatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagactttttctcgggcggctagggcgcggcccaaggtaaatggagcggctcggccgagcttaacgggccggccggcccaagacggcccaagcgcgcgcgcgcgggagggaggagagagagtccggtggaccgggctcaccacgcgcggtcccgggtgggacccgcttgtcagcggctcggctcaccgtgcggagggagtacgtggctcatgcgcgcgggcggggaaaggacgtggtgcacgcgcgcggtccgtggtggacgcaggtgcggcgggcccacgcgcagcctcacggctcgcggtggaacacgcgcacggggagggactgaccggggtcggctcgatccggtctaggctgagctggcgccgacgtggcgcctacgtggcggccacgtgggctggcgggaggtagacgacgacccggccgcgaatggacgtcgggcggcggcggcgagcggcggagcgaaccacggcgatacgggcaaaagcgtgcacaccgggcggttgcacgtgacaagggaagacgagccaacggctcggattcgccggaggttgctcgacggcggcggattgcggcggcggcaaccggtggcgggagaagagggaaacggcgacgaggtcacgagaggtcgattcccggcggtgagagcatctacgcggcttcgggaactcgacgctagcgtcggattgggcggaactacgccgagcgaggccggcgacgagcgggtgctacggagctcgagcggcgacggcggcgaacacacggcgagcgacggcaacggtcggggcggcgccggctaactacggggaggctactcaagctactaccgaaagctagggggaggtgatggagcgaggaggaagaacggagagaggcatcaccgagaagaggagcggcgctgtgacgagaggccgacggcgcgggagtaatctctccggcctcgggccggggaagagaaaggagagggcgcggccgaagtccccttccgcgtcctcgaacgcaccggctctcccggcgcttggcgaaggacggcggaggcgagacagaacacgggggcggggtggcggcaatggcgcggagacgaatggaagatgaagggaaagggggaggctggggtttaatgggcggtaatgtcgatttgggaaccgccttgcgcggtcaagggcgagctggcgctcggcgcttgcagccaaagcggcgacaggaggatgacgccggcggagaggggaaaagaaaaaaagagagaaaggggagctcgcccctttctcctttgggaaaaaggaggaggagagcgaggcgactcggcagagggagaggggacgctgcctccgtcccttggcggcttgcgcgccgagtggcgggggccgggcggtgacgacggcgatgacggcgggcggtttggagcggagcggcgacactggcgacaggcgcggcaggcgctgacgacggcggcgaccgggcggtcggccactcggcgcgcacgcgcgggaaacaacgggcggcgtccgcgcgggcgcgcgcacgcgaacacggcgcgcgggaagcggctttgcgagcggggagctcgcgcgaggggaggggcgctcggcgcgggcgactcccgcgcacgcgcgcgcggcgcgcgggcggggcggaggggggagcggggagagaggcgctcggggcggctctcgcacgcgcgagcagcgtgcgggcgaggctgagcggggggggaaggagcgcgccggggggagagagagagagagagagagagcgcccgggagagagggagagatgggccggggaagagagagatgggccgagcgagattcggcccatcgacctcgggggaggcaaaatagacttttgcggaggaatttgattggaaggatttggattcggaattgaactcgacgatagatcggtgattgagatcttgagatggcacggacactagacaacaagcaaagaaacaaatttcgcaattagggcttttaagagataatttttccgctaggcgtcacgacggaacgggcgctacaccctactagccctaggcacaccatccttgttaaatctcgaaaattgcgtggcaaagcaagctaaatcgatccacgaacttatctatgacgacaagtactttatcagtcgattagcacaaacagaacgttcatcattatgcatctatatgagaaatcaagaacctcaggcacccaatagtttgccatactgcttctctatgaatctgcgaggtggcaccttaattcctatgacatatactactagagaacacgctaaatgtgcatgctcttatcaagaaccggcaccaataatactctccacgaccatcccgggctgcactggaggctatctgtgccggtttcaaaatcgatagtgatggttcttacaaattagcatggagagatgagcaggggcagatctatatagagccatggggattcctagacacccgggtgaaagaaaaatttaagctgtaagtatccatcttaccatgcatgtaggcacccccgtcggcctaactttgtgtaacccaagcagccaataagaccgagcaaggacaataaatcaatagagatacacagtacgtgatgactcatcacaggttaagtataacaccagtagtcaataatttgacaaattgtcatgcttggagcccaacacaaccagtctcatcaaccttacgccctcatttttttaatagatgacatcgttgacttttaaatacatatttgatcattcgtcttattcaaaaatgtcatgcaaatgtgtaagatataaagcatgcttaaaatactttgagcgataaaacaactcacaaaaaaataaattataattatttaaacttttttgaataatatgaatgatcaaacgtgtgacaaaaattcaataacattatctattaaaatacggaggtacttagtatgcaatcatagtgaaacagaacgctcttgccggccagactagtcaagctattctgtaatgttgtttgatactacctctgtcccaaaatgtagttatttctagcacaataacttgtccaaaataaagctatttctccacctgcctccttctctcaaccaatcacaaccattcttcttcacctattttttctttttaaccaatcatacactttctcttattattctcacttactttcttaatacatgtgtcaactttgaaaatatctatattttaggacacgggaaatagaacatataagcaacatatatagtggtgtacccctctgctttgctctagctctgccccgggagatgaggtgttctgaggtagtgatattatgtgtatgccggcactgcgagtttcattacaagtgtacctctattcaaaacttgccttagattgtcgttagatcaatactaaatagtaatgattagattttagaaggtaatggttttatctaactaataattggggcatactatgcagaactgacctaattaatcttgatagtatatttcctatttccatttttatatggcaaccaactaaacaactgctaggtatattataagagatacaccccaaaaatgtttgaatcctgcgggataataattttgggcttcatgtttaatttgtgtagtcctatgatgcatgtgactgttgaattcctcagcatttctggggtacgtacagacaattatcaccttccaatttgtctagttgttgctttggttgtgcgaatccttttctactggttgatatgatcatgctagatcgtcgtcctggtcgtggaaggaggaaaaatatatagtacaaatcaaatatatagtggaatcctaaaactaggagaatctaaaaatggacaagtgagaattgttcacgtcatcatgagtagatttaactgatggtgacatgaacatatcatatgtttattttttttatcctacggtagtttcctagctgcatgtagctagcacattgcagaattgtgtccataaatattagagtgacatgaagcataataatattatcaactgacagatcacatacttaattgcaaaatctctcatggttgtacactactaaattactaaaacaatggagccctttatttcattctgcataatgcataaacaagtactaataaattaaaagaaattctacttcacagacaatcaaaaatgactactagttgggctccattttccaatttcctttgtgaaggaaattaagggttcgcatcaccaaacccagatccggaacctacaccagcaccgctgccaccatattgaccctgaccgttaccaccaccgttgccaccagcatttgcatttgcatactgtccataccaggtattagtagcctcactagagcctgagccggtaccactaccagacccatgaccataggatggccagtaaccaccagcttgtccagctccagcaccagcaccgctnnnnnnnnnnnnnnnnnnnnnnnnntaaccataatacccattttgactggtctggctagagcctgagcccgaaccagatccactaccagaccctgacccaccatattggctgtagccaccgcctccgcctcctcctccaccacttgcatgggcaccattgtaaccacttctaccagacccagtcccacttcccaacccagctcccgcaccattcacgcttcctgtgccctctccacttcctgtgcccgaaccttgggcatttgagtatctttctacccttacagcactagctaatccaatgctcaagaggacaataaacccaagagctgcaagcttagtgcctgccattgtgagattattctgagtagtgaaagaatagatgaatacttttgggtgatgggtgatggattgcatgggtagtatttatagtgcttgacgaggccatatgcaacacttgttacttattatcttaa

SEQ ID NO: 14029 - DNA, 997 bp, Oryza sativa
  unsure (1)..(997): unsure at all n locations
gtgggnattgannattcgannatcgactaacacatggtacagnagctcatcagaggcgagccggcggtgaagtcgtagacgcccatgaacggtggtgtgaccaaccaaccgtataggccaggacaccagtcggcggcgacggaggcaggccggcggtgaagtcgtagacgcccaacagcggcggcataataggccagccgtgtaggcggaggcaccactcggcggcaacggaggcaggccggcggtgaagtcgtggacgcccaacagcggcggcataatagaccagccgtgtaggcggaggcaccactcggcggcaacggaggcgagccggcggtgaagtcgtagacgcccatgaacggtggtgtgaccaaccaaccgtataggcgaggacaccagtcggcggcgacggaggcaggccggcggtgaagtcgtagacgcccaacagcggcggcataataggccagccgtgtaggcggaggcaccagtctgcggcgacggaggcaggccggcggtgaagtcgtggacgcccatgaacggtggtgtgaccaaccgaccgtataggcggggacaccagtcggcggcgacggaggcaggccggcggtgaagtcgtagacgcccaacagcggcggcataataggccagccgtgtaggcggaggcaccagtctgcggcgacagaggcaggccggcggtgaagtcgtggacgcccatgaacggtggtgtgaccaaccgaccgtataggcggggacaccaatctgcggcgacggaggcaagccggcggtgtatatgacgatgcccatcaacggtggtgtgaccaaccgaccgtatatgcgaagacaccagtcngtcggcgacggaagcaggcccgcggtgtatattaccatgccatcaaccgggtgtgaccaacgaacgtattggcgggacacaattggggtgacagagcagaccgcggggttattaccatcccatcaccgtgtggccaccggaaattttgttctt

SEQ ID NO: 14030 - DNA, 29945 bp, Oryza sativa
  unsure (1)..(29945): unsure at all n locations
gtggacaacgtgaacgtcactctccattggcacaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagagcatcacctgatgaactacgccacaactcaggtgatcttgttagagcacttgtgcatgttcgatgttctgacgtggcaatggaaggagaggaagattctgctgaagaaaagagacagaaggcattagttgccttgctggtaacctgcacatttgaatcattagatgttctcaccaagttgctgtactcatcaagcgtggatgtaagtcagcgcattttgattattgatgttatgactgaggctgcacaggagcttgcggaaactaaaattgtaaggagagagctgcggcatggaaacttgatatccgacacctctccctcttggctagttcctagtgatcagggacctgctggtgcaggtccttggagggaagtctcagaatcaggaacacttctgaattggtcacaccggtatgaaagagaagttccatctagatctggtcaagttaaatcaggaaaatctcgtaaatggggtcttggaaaagctaaagatttgcagacagagtggtcaaaaaacagatttcctttatatgctgctgcttttatgctccctgttatgcaaggatatgataaaagatcacatggtgttgacttgctcaatcgggactttgttgtcctaggtaaattgatatacatgcttggtgtctgtatgaagtgcatggcaatgcatccagaagcatcagctgttgccccagctcttcttgatatgatcagatctaggtctgccaagcctaaaacaagcatttccgtgttaaagactttcttagttataaccaagtggtacgattttgacattggattttgtttctgcagggctgtttcgcaacatcccgaagcatacgtcaggaggtctgtgttgtttgcagcttcttgcatactgatagcgctgcatccgtcgtatgttgcatcatctcttatagaaggaaatcaggatgtttctactggtttggaatggatacgcacatgggctcttcatgttgcagaaacagatcctgatacagaatgctcatcagtaagtactctggtctatatctgttatcgatcacttgttcgtgttttgttcgtcgacgtagagagcaattatggtataataggatgacatttgtttcttaaaaccacacacaataataataggtcattttttgacgaacaaaggagtacagttatgctggttttgtatcaaagtttgtctgcatcgcctaatcatttcagtaacctacccttatatgctttagttttctgtaacctactcatttctctcattccttcagtatacaaattcagtgacccagctcttttcagcaatttgtaacgaaaaacaggacatatttttacttataagctggaaaccagtttttacttaaaagagaaaccaattcagtataagctggaaactcagtaacttttcacactgtcatctaactcctcccattggcatgtttgtcttcaagatggctatgacctgcctgcggcttcattctgagatggcccttcagacatcacgagcactggaatcggcggatcacagcaaggccagcagcagcagcagcaggtcgctaccttctaagcttgataacatcatcataccatttgccaacatgatgtgatcgatgtactagattaagttgtaaataagcatatattatcttgccatgtaatattagaaattccaggtcagctaattctgattaggcttgatattgtcatattacagggttttttaatctgggatttgaaaatgctagaatttttgtcgattcgtgtggagattgtatggaagttgtcctgatccagattaaagagaattgatgaaaattgtacccagattgatgaactgactaatagttgatgatgatgagtaaaagagaattggacgagtcatgcaggggcgagggatccgtggggaccaccagccacaggatggggccactcctcgagcgttggatcagccgcgagggacgatccgacggaggagatgcgtctggtccaggtatttaagcgcaacttttttttgcccttcgcagcacaactgcacaaccacttttccgcatctctctctctctcgcgtctcaagagcagcggcgaaaggtgggaggtgagatctctctctcacttcatcctcctctcctcttctgtggtttcgtccgccgcctccatccctaaaccctacttcttctccgaaagcgccgtgagattcttctccctactcttcttcgatcttgctccattggtggtggtgtttgtttgcttggagtgtttggtgtcgcggtttctctcgttcttgtcttcgctgaatcgagcagcaccctgcgtcttggttggttcctgtttaccgcggtctggtcctcttttttcgtgttcttcgcttcccgtacccgtgatgttgttgcttgatgcatttgaggcgtggttttctcggagttggatgaggaggtcgacgagcaccgaagcttcatggttggtctccgttcgcctctctcccatcggagcacgttgatcttgacggttcctggcgcgaccaatgcgtgcgcgagaagttagacgccatgaattcgtttctcttctctgctttgttttttttttggctcctgttttgcagttggtgtgttgcggaggtgtcagtttctgaatttgtataaaccaaatgccctcttcttattctttttgctgttcctgatgcaatctgcccgtcttccttacgtcttgatcaagtagaacggcgcctctttctcttctcgaattttaaggcgtttcggaatccgaaatttgctaagattttacctggccgtgatcatttttttcctcctgttcttggcttcccttacccgtgttgttgttgcttgatgcttttgaagttgggtgtgtgagtttcttggaggaggttgaagagcacggaagcttcatggtgatctcgttcgcctctcctcggaacatgttagtcttgatcttgccttccgtttctctatttggtcttgatcttgccttccgtttctctatttctaccagtgcaagctcgagaaattaaaccacatcaattcgtttctcttttcagtttgttctgttttggtatgctgcggaagtgccagtttctgaatttgtattagctagatgccttcttctgttcttttcgctgctcctgatgcaatatgcaggatgcttcttctctacacgtctctctgttttctgcctcgaaagaactctctgtcctattgtggctttgtttactcgatgctattttttcgttcaatgatttctgcatgtgtcgctccattgaattacttgtaaatcttctgattctttacctatcaaagaaacttccatctcttgaatcttgatttggcttccttctcccttaccgagatattgtgcattttttgtctgtaacctgtttttcacttctctgtgatggtgttcggtgccgtactgtactgttaggttgttcttgctttttttcttctgttcttcattctttgtttgcaattgtttaagttttgattcgccgaagcagtgccatatctaaaggaaatcgatcattcttgtacagtacactttatgcgctcgtttcctcttcttatctcactttgaaatttggtgttatgatatgtgtcagtaaagcttatatcgcgtttgtagaaaaccttgtgtgtattttgttcgcagtaataaaataagatttaggtgtaaaataatgcagcactgcaactgaagattgatacttccatgttatatatctcaaaaatgcatttaagcatttaagggccctgaatgaaagcaccaattacaccctgtgctttgagctagataagtagtgccatatcaagtttgatgattctacttcactttatttcatatgtaacctagctttctggcatttaattgatctgtattattgtttaagtgtctttccccgtttttgttaataatgttattttatatttgtattcatgttaaattttcagcaaagcaagttccgctatgggtaacagccttcctgtagaatcgaagttcacttttgaagaagagaatgacagaattaagtatgttgtgtcgtctatgcaaggatggggtgagaaaatggaagatgctgtgagtaaacttgcagccttttgtatgacaaaaaaagggacagttctgcaaaattttcttactgatctttaagtaattgtgtaaaatactgtgattgacatatgccctctatattctctagcatgcagctattctaaatcttgatgataccacgtccacgtctttctttggtgtttatgatggccatggaggtttgcttcattctcatttttttttttaatttcaaaccctccaaattgttggcgtaactgtttgtcatgctatgtttgtctgtgtgtatcactttgtttatctctgcgcatgttttgaaaactttgttgtatatgttgaaacatttacctgtcaattttcaaataaatatgatgctacagttatggataatgaacaagttagctaatcagtaatcacattcgtgtggcatgcttgcaaggataacatgaactacataaaaagaaattttaattcatgagagataaaacactgcatgaatgagttactagtaatataaatggtgatgataatttagaggataattacagattaacaggttagttttttttttaatgatgcctattcaagtgttgttctgctactaatgttcacaacagtgttttgatttataagcttctatgcaatagaagtaatcttgatccatcgtattgagcgagacgccatactgaattgtttttttctatctcaggagctgaagtagcattgtattgcgcaaaacaatttcacattgagctatgcaatcatgaagactatcacaacgatctgattaatgcactggacaatgtgtttttaaggttattttggcctactttacataattttgtttatagctgcacttggaaatgtgggatatcattgttcgtgtgattgctgcagcatggatgagaacctgcaacagtccgatgcttggagagagttagttattcctcatgataatggatgtatgtattttctcaaggctggtgtctgtgctaagcctttcccacaggtagtaatcttttaacccctagcatcctcaaatattcatgtcgtgaagaagttactcaaaattgtatttgttggacagtgtgcatattgtatctatgaaaaaggaaatggaagaatgtgtttgatatcgagactgttgttctttcttgtgttgtactttggagttggaggagatatgtttaaccctaatctcgactaattgctcctattaaaaatggttcaattagttacatatcaattggctggtttactgagttggaggccaacaggttcttaagttctcattgcaccttggttcttatcatactatgctatccaaattgaggtattgtttgcgatatcccttcgatggttatttctttcatacattggtttggttttcagaaatgtttttctatacctgttggctttcttgagctattttttggtagtcttttccttctaacaatgttgtgattctgtgttatatacttcagtttggttgttgttttcccaggcgacatatactgggccagcgtatgaagggagcacagcatgtgtggttgtcatcagaggtaaccaaatgattgttggacatgttggtgattctcgttgcgtactctcaagacagggtggcctggtatagtgattgtttccctattgaatttctggttaatacctaatttgcaagctcgttcattgtggcgcctaacatttgtgcttgtttccattttgtcaataggctattgatttatccttcgatcacaaaccatgcacaagaactgagtctgaaagagagagagttcaaaatgcaggagggagatctcttggacttaggtgtgaacaagtaatggggaattatgtagtcaaggaacaatgggtcctcggtgattttgggggaggtgtaacaatctcaagatcaattggtatagtcttgtctggatctgtttttcattgattgcatgtaatagcacaaaaagaagcacattacactgtgattggcgttttacctacttacatttcaggtgactttgctttcaagaagaacaaagatttagatcgtgaaaaacaaatgctggtatgtgatccggacatcctcgctgtaagtgtaactaagtgtaaataggtccgtttggtagaatatgaagttcagttttgccgggttgggatctgatggaaaattgccctttcaatgtcaggatgacataactgatgacatggagtttcttgttattgcaagtcaaggtctctggtaagtggtaactcttcagcaaaaaatacctgtcaataactattggatcatttttatgtcaccagtactcattggcattctcttttttttttttcctcctatttggttcatatatagtttcactcatagttccatactaattgcattgactactgtatattttccccctgcaggtcttgcgtggacagtgcggacgtggtttcttacatacatgaccgtttatcggtggtgagtcttttctttccctcagtttgtcttcttggcaggacaagatatcttagtggtgttaatcatgctatctgttctaggaaatgacttcaatcaagcaatgtaaatatcctgattttctcttttcttttaaaaaaaaactgtgtaagccctaaacctcacaaaaccatttgttagtttagcactgaatatgcatgcctggctgacaaactgccatctgctttgacttcgattctttcgctgttaaaactgctgttaccaataatgctgtgaccaattaatattgctatgcaggagggtgcagagctgcgtgtcatctgtgaggaggttgttgagttcggcttggcatcgggcgagaacactaccgtcatcctggttcagttcaagcccggcgccttccagtaccagctggtggatcccgctggatttggcactgccgtctctaacattgccagcaccagtgctgcgccggctggtgccagcgacacaagcgacgagggcgtcgatgacgctgccactgccaggcccaccgttatgggctacgacgcggactccagcaccggcagcgccgatgccacggtcgacagcgacgaggtcgatcccaacgccacggctgacagctacaatcccagggggcacgctgagatcgttgccagccacaccgacgacgaggtctacaccagcggcagtgccagggttgagagcggcgagctcgccgtccccactcccagcgccaacaacaccgtcgcggatgaggtcaaggtcgacgccgctgtcgtcgccggcggcagtaccaccgccatggctgctgacgaagccaccgtggtgtcgttgttgtcgaccatcgtggataactactactccattaacaccagcgaggagccagcgaggaggttgatcccactgccactgtcgcagccgacgacaaggtcaccaacggcagcaccagcgccacggccggcagcaagctgcacaccagcgattcttcactcaattttgtcctggtcgaagatgatgtgtgatgatgcgtgcaccgctgcatgcgcaggatgatactgatcctaggtagcactagtatcgtagtagtagaactttgctttggtaggatcggaatagttggtttctgctacccttgtttttggtttatgcctcctggttggtggantgggtaggnnngcccccccccccccccccccccccgattttgcttgccagactcggttaattaatgaggcacttgaatggtttttgagttttcaaagtacttaatctagtgatgcttttgttgacctccattttgaatctctatacatgctgggtatgaactacttctctgttcccgattcgggatcaacaaacaaaactgtcctgatagtcctagatagcagcaatagcttcaaaggttcagagcgaacgaaaataattttcaatagtgctggcacatgttttttcagaaacatcgagtggtctcaagtctcaactcttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatggacgccggcggcgaggaggcgaagcaggagcgccacctggtgctggctcacgagctcttcctcctctcccgccccgacctcgacgacctcgccaatgtcgccctccgctccgatgccctcgacgccgtcaagtccgatggcatggcgccgctgttcgagtcgctggccaccgcgggcgtgctgctcaagccggacgacgcagctgctcgccgagatgcgcgcgcggatcgacgaggaggtccgcaagctcgacgagaagtgagtggattcttcctctcttcgattttatttctagccccacaaaaaagaggtcgcccgttgctgtgttgcgtatgcctgcagtagtactatgtggggataggttttgtgataaataactctggtgttgatatgatccgtttgcctaaactaacctagcttgctctcggtgcggaacatggatgctaaagctggtagacagtggcgaagctagagcaaaatggaggggggttcgagattttgccacaagtatatcaatatatataacttcaagctacattttcgatagaaccgttgattaataattttttacatcaacagtagagacacacatgcatcaataaaataaaaaaagtgacaaacattgtttttcaaaattaagaaatccactaataacattgataattgagaattggttactaacccatgagcaaaagatgatctgcatatgcaaacataagcaaacaccattctatttcattatctcaacatcctcgacgatgatttgataacctaaaacaagttaacatcaaaatcagttctcatttttcaaataaaaagtagaatccagcgcacttagatacaatcattaccttcaatcatcatcaaatatgcgtccttgcattttcatgaagcgacgaacaacggcctcattggtgactttcttcatttcttctttctccacataacaaataaggctatcacttaagtactcatcaccaattttattgcacaaatatgttttcacattcttcatagctgaaaagcacctctcaactgtggcagtagcgacgggcaatacaagtacaagttttaaaagttgataaaccaatggataacaaagatgttttcttgtctccaccattatttgagaaagctcggcaatagtttgtatgttggagaatctaccatcatccctcacatcagcgatgtagagaccaagttggtggctaaggtccctcaaatttccagaattaaaatcactaggatacaattttgctaaactcatcaaattctctagattgaaatcatgaaatgagtctcttggactaaaagccgatgagcaaataagcaattgagagcttgtctcactgaagcgattgtcaagctcttgaagtatccaatcaataacatcattaaaacaatccacttgatagtaatgcttgtttgtaattctagatttgtgcctacgcttcttgggatcaatatatgtatcttccatttccaatttgacaatatcatacttgtcacaaaagtcagagacttcatctagaactttctcccacttttctcttctaagctcatccaaattgagcctagttgactttacacatttcatagcattcactatgtcttgatccttccgttgcaatgctagtgacaagctgtttgtgattgttaatatagtcaacatgaggtgcaaatagaagacaaaatcaaaagattggaagtactccaaaagattcgatgcttgatctctaattttccaatcatttttgtctttttccacaatttctagcactttgactattgtagcaaacatgccaaccaaacttttgagagttttatagtgggaactccatcgagtatccccaggtctctgaagacattgctcttgattcaacccggttctagtttgaagttgcccacaacccaatgccttactcatttctttaacattaatatctctaatcaaatcccttctcttagatgatccacccaccacattcagtaagatggaaatcttagtaaaaaaatcactaacgcctttatgttttctcacaatagccacaagaacctattggagttggtgagcaaaacagtgaacataataagctgaactattttccctcatgatcaatgattgcaaaccattgaactcacctcacatattgctagcaccgtcatatccttgccctctaacttgctttagacttagcttcagttctgcaaatagagcatcaatagaagacttgagataggcagaagttgtttcagtcacatggacaagaccaacaaatctctctctcacaattccatatttatcaacatatctcaagaccactgccatttgttctttgcaagaaacatctcttgattcatcaactagcaagcaaaaaacatcatgcccaatttcttctagaatagcatgtagcacttcctttgcaaaacatttcacaatatccctctgtatttcaggagcaaccaaaagactgttatctgatttttttgtacctattgcctttcttaaggatgggttttgctccgctgtgtaatcacgaaattccctgaagttgcctctgttgtagggctcctttgactcatcgtgacctcggaaaggcaatcctagctttactagcatcctagcaacatcaatggacccattcaatcgagtaagatagtccctcttaccagtttctctcacactatgaaaagcaacatcaatgtgctggctttttttgtaataaatcatcacacttcttcattgcttgatagtgtgaaccaccgacatcacctacatgcaatttcaacctttcttttctatgaaaaccattccaaccatttttaacaaatgcttcatatccaccatccttcttttctctaaacaagaaatagaaaaaacaatatgctcgatttttggactcactgtattcaagccaacttccaaactcatcaaaccattccgggacaaaccttcttgaacctgtcataggaaaagcaaatgtgcgaggttgacaagggccattctccaagtatttccttctcaccctctctctgagattaggatggtactcatcaatttgttttcttaatcctggatcatatttaatctcatcttcccagtttatatcatccaaacatgaattacatgcattgttagcactattcggctctggcactttccttttgtaaaatcgttccatcaattaacctatcattagatgatttaggaggatgtaaatatatactgattttatcattcattcaagtacagaagtagaatgaaaattgatatgacttacatccaaatagcaccttcaactcaaattctcaaatttccccccaatctgcaattttattccaattctgaaggattccaaattgaaccctactggcctcctaattctacaatgtaaaaaaaaacaaccaataaaaattttaggcctttgtatctaataaatcaaattgattaaaaaagaaatagatgaagcatgctttcttaccttgtctctactaacgcacaatgtggctgtgtgctgatcagttgatggagatggatgatgtcattgttggcttcatggcttgtgaaagtgtggtctgacgcttgctcctggttagctggttgcctggcgaccggcttcctgccttcctggctcctgcggctggagcgagcaacgtaggcactaagcaagcaggggcgacggcgacagcgacagtgagctgccgagggcgacggccgacggcggcgcgtcacgatgccgagatgggcaagtgttgtctgggagactgggattggctgattgcagagcagtggcgtggaagccaaacagatgcgaggcggagtcgtcaagattggcagcgacgggacgcggcatacgagaagtcgagaagagaaaagattgatctggattcgactctcctcatgggcttacaacgttaactggactgttgtttggactgtgggtgcactatattgggccaaggggggtgcatatagggccgagatatgggggtaataactaaaaattttgtttgaggggggttcatctgcacccacgggcctctattgggcttcgcccccgctggtagatccgtagatagcttgcatttgatttggtagttgtaaatttacgaattatgcttagggtcaattcacctctatataaatctgtactacataatactaataaactttctccacagttttgttttagattcatgtacatattgatgattttgtacattatctctgcaatgtgtaatttagcatgtagaaaagtaattgagattgctaaggatcacaatgcacaacatcccaactgatacgaataatttgtgtgtcccttttatccagaaaaaataccagtgtaaactaatgtgaaggaagaatggcatgttgaacttcgttagtaatatggtatcgatttccttggtcgctactttgttgtcctaggtaaattgttatacatgctcggtgtctgtatgaagtgcatggcaatgcatccggaagcatcagctgtcgccccatgtcttcttgatatgatcagatctaggtatgccaagcctaaacaaacatttccctgttaaggaattttattggtaagttaccattttgacatcaaattttgttctatacagctgtttcacaacatcctgaagcatcagaaggtctgtgttgtttgcagctttttgcatattgatagtgctgcacccattgtatgtctcatcagctcttatagaaggaaatcgggacatttcaactggtttggaattgatacacatatgggctcttcatgttgcagaagctgatcctgatacagaatgaatatcagtatgtactttggtcactatggggggatatatctgttatgaatcaccgatttgcattttgttcgtcaaagtagagcaattatagtacaataggctcagcacataatactaatagggtcatttttgaaccaacaaagaagtacagttgttcagggtaaacgttatatcaaattcatttgcatcgtctttgattttaacctgaaagaagagtattttcactgtgagataattcactatctgaaaataaagagctaataactcccaccttatgctttagtttcctgtaacgtacttctttctatcattccatttggtcttctattatactcaaccagtgatccagctcttttcagtaatgtgtagagtaaaaccagactagttttttgttcaactcataattagaaaaccatttcagtacactggaaactcagtaacttctcacattgtcatctaactcttccattgtcatgtttgtctccttgcaggcatcatgacctgtttgcaactctgttccgagatcttcagacatcatgagcactgaatcagtggatcgcagcatggccaggaactgcaggtctctgccttttaagcttgataccatcaaaatgatcaatgtactggactagatatataaatcgattgatgtatttggtttcggagtgctagatttttcgtcattcatacatagaacatgaattgatttacgtgaaacaatttatgtaagtcttctgttccagattactactatgtttgaaaactttgaactgattagttgagcaaaagaaaatttacctgtggatgggtcatgcagggcgagaggaggaggaggagggcgtgtgctccatggggaccaccagccacagaacggggcactcctggagcgttggatcagctgcgagggacaatccgacggccgagatgcgtccagtgcaggtatttaagcgcaatgctgcttctccttgcgcggtttgctgcacaaccactttctgcttctccctccctcacaggctcacgcattctcatctcaagagcactagtggcgaaagataaagggcaaatgttatatccaattccgtctgcatcgcctttgattttagcctgaaagaactaataatttcactgtgatatgattcacaatctgaaaatgaaagagctaatatcactcatcatatgctttaattttcagtaacctactccctcctctcattcctttaatctaatgttatactcattcagtgatccagctctttcagcaatctgtaaagaaaagagatcttcaaacgagtagattaacaaaagcgtaaagtgtctagagtttttggaggcgtcaccctaaggtggccgtttttcttttcttttggggggcgttagctgcggctagcaccctgctcgactgtctaaggtcgattctgtaaccttcgtgacaccctctttcttcttaatacaatttgggcgacctctttcggctgtcccggcaaatctgtaaagaaaaacaggacctctttttaccttataaagagaaaccaatccactaagctggaaacgcaataacttttaacactgccatctaactccattggcatgtttgtcttgtagatggctatgagctgcatgcggctccattctgagatggcccttcagacatcacgagcactggaatcggcggatcacagcaagaccagcagcagcagcagcagcagcaggtctctctaccttctaagcttgataacatcatcataccatttgccaacatgatgtgatcgatgtactggattaatttgtaaaaaaaacttatattatcttgccatgtaatattacaaattccagttcagctaatcctgctacagtctacatgatttttttttgtctgggatttgaaatgttagaattttggtcatccatgcaatgatgcaaaagaacatgacttgattagtgtggaaattgtatggaagctgtcatgttccagattaggagtatgtgtggaaactgtactcagattgatgaactgactagttgatgatgagtataaaagagaactacacggggatgagtcatgcaggctgagggatccgtggggaccaccagccacaggatggggccactcctcgagcgttggatcagccgcgagggacgatccgacggaggagatgcgtctggtccaggtatttaagcgcaactttttttttgcccttcgcagcacaactgcacaaccacttttccgcatctctctctctctctctctctctcgtctctctctcgcgcgcgcgtctcaagagcagcggcgaaaggtgagaggtgagatctctctcccacttcgtcgtcctctcctctgtggtttcgtccgccgcctccatccctaaaccctactttttctccgaaagcgccgtgagattcttctccctactcttcttcgatcttgctccattggtgcggtggtggtgtttgtttgcttggtgtttcgtgtcgcggtcctctcgttcttgtcttcgctgagtggcattgatcgagcggcgccgcgcgtcgaactcttgcttgaatctggaggcgtctcggtttccgaaacttgaacctctttaccgcgctatgatcctctttgtttttttttttcgtgttcttggcttcctgtacccgtgatgttgctgcttgatggttgatgcatttgaggcgtggttttcttagagttggatgagaaggttgacgagcaacggaacttcatggtggtctccgactccgttcgcctctctcccatcggagcatgttgatgttgacagttcctggcgcgaccagtgcgtgcgcgagaagttagacgccatgaattcgtctcttctctgatttttttttaattttttcagttctgttttggtgtgttcttattatttttgctgttcctgatgcaatccgctcgtcttccttacgtcttggtcaagtagcaccgcgcctcgttctcttctcgaattttaaggcgtttcggagtccgaaatttgctaagattttacctggcagtgatcttttttcccctcgtgttcttggcttccgtacccgtgttgtactgttgcttgatgtttttgaagttggggtgtgcgtgggtttcttggatgagtttgatgagcaccgaagcttcatggtgatctcgttcgcctctcctcagaacacgttggtcttgatcttgccttccgtttctctatttgtaccagtgcaagcgcgagaaattagaccacatcaattcgtttatcttctctgcttgtcttttcagtttgctctgttttggtatgttgccgaagtgccagtttctgaatttgtattagctagatgccttcttctgttcatttcgctgttcctgatgcaatatgcaggatgcttcttctctacacgtctcttctgttttctgcctcgaaagaactctctgtcctattgtggctttgtttactcgatgctattttttcgttcaatgatttctgcatgtgtcgctccattgaattgcttgtaaatcttctgattctttacctatcaaagaaacttccatctcttgaatcttgatttggcttccttcccccttaccgagcaattgtacttttttttcttgtcttttacctattttttacttctctgtgatagtgttcggtgctgtactgtaggttacatgtctctggttttcttcttcttccgtccatcatactctgtttggaatttctttaagttttgactcgctgaagagatgaccatatctagaggaaattgatcatccttgtacagtacactttatctgttgtttcctcttcttttctcactttggaatttggttttatgatttgtgtctgtaaagcttatatggcgttcatagaaaaccttgtgtgtattttgttcacagtaatatttcaattccttgcttaattcttgtacaagataagatgtaggtgtaaaatactgcaacgctgcaactgaaatcactattaacaccctgtgctttgcgctagataactagtgtcgtatcaagtctgatgattctacctgactttatttcatatgtaaccaagctttctggcatttaatcgatctgtattgttgtttaagtgtattcactttattctttccccgtttttgtcaataatgttattgtatatttgtattcatgttaaattttcagcaaagcaagctccactatgggtaacagccttcctgtagaatcgaaggtcactgttgaagaagaaaatgatagaattaagtatatcgtgtcatctatgcagggattgggtcataaaatggaagatgctgtgagtaaacttgcagccttttgtattacaaaaattaggatagttctgccaaaaaattcttattgatctgtaagtaatttgtgtaaaatgccgagactgatatacgctctccttattctctagcatgcagctattctaagtcttgatgataccacgtccacgtcattttttggtgtttatgatggccatggaggtttgcttcattgtcatcttttttgtttcaaaccctccaaattgttggcgtaactgcttacgtcatgctatgtttgtctgtgtggatcacacttttatcttttggcatgttttgaaaacttaactgtatatgttgaaacttttacctgtcaattttcaaataaatatgatgctatagttaaggataacgaaccaagttcagtaatcacattcgtgcggcatgcttgcaagggtaacctgaactacataaaaggaaattttaattcatgagggataaaacaccgcatgaatgtgagttaatacaaatagtcatgataattaagaggataatcacagattaacaggttggctaactctattttcttatgaaacctgttaaagtgatgttctgctactagtgttcataacattgttttaatttataagcttctatgcacatagaagtaatcatgatccatcctatcgagccaccatactgagttgtttattttctatcacaggagctgaagtagcatcgtactgcgcaaaacgatttcacattgagctttgcaatcatgaagactatcacaatgatctcaccaacgcactggacaatgtgttttttaggttattttagcctactttatcattttgtttatagctgcacttggaaatgtgggatatcattgttcttgtgtaaatgctgcagcatggatgagaacctgcaacaatccgatgcttggagagagttagttattcctcgtgataatggatggatgtattttctcaaggctggtgtctgtgctaacttttggcctttcccgcaggtagtaatcttttatcccctagtgtcctcgaatatccatatcttgaagaagttactcaaaattgtatttgttggacagtgtgcatattgtatctatgaaaaaggaaatggaagaatgtgtttgatatcgagactgttgttctttcttgagatgtactttggagttggaggagatatgtttaaccctaacctcgactaattgctcctattaaaaaaggttcaattagttacatatcaattgctggtttacagagttggaggccaacaggttattaagttctcattgcaccttggttcttatcatactatgctacccaaattgaggtattttttgcaacatcccttcgatggctatttctttcgtacactggtttggttttcagaaatgtttttctttacctgttggctttcttgagctattttttggtagccttttccttctatgttgtggttctgtgttttacacttcagttttgttcttgtttttccaggcgtatactgggccagcatatgaagggagcacagcatgtgtggttgtcatcagaggtgaccaaatgattgttggacatgctggtgattctcgttgcgtactctcaagacaaggtggtctggtatagtgattgtttccctattgaatttctggtcgttacctaatttgcatgctcgtttcttgtggtgcctaacatttgtgcttgtttctgttctgtcaaaaggctattgatttatcctccgatcataaaccaagaacaagcgagtctgaaagagagagagttcaaaatgcaggaggaatatctcttggagttgattgtgaaaaagtaatggagaattatgtaatcaaggaacaatggatcctcggttactttggggaaagtgtaacaatctcaagatcaattggtatagttttgcctgagcctatttttcattgattgcatgtaataaaaaaaaccacataacactgtgattggcgttttacctacttacatttcaggtgactttgctttcaagcagaacaaagatttaaatcgtgaagaacaaatgttgatatgtgatcctgacatccacactgtaagtgtaaatatgttcgtttggtagaatataaagtttgttttgccggggtgggatctgatggaaaatggccctttctacgtcagcatgacataactggtgacatggaatttcttgttatagcaagtcaaggcctctggtaagtggtaactcttcagcaaaaaagaactgtcagtaactatttgatcattttgatgtcaccagtactcattggcatgattctttttctcctttttgatgcatatatagtttcattcataatttcatactaaccgcattacgtactgtatattttttccctgcaggtcttgcatggaaagtgcggatgtggttgcttacatacatgtccgtttattggtgagtctttttttttttcctcagtttgtcttcttggcaggacaatatatcttattggtattaattatgctatctgttctaggaagtgacttcaaccaagaaatataaataacctggtttctcttttttatagaataacagtgcttatcccctaaacccccgaaaaccagtactttgtttcgcgctgaatatacatgcctgactgacaaactgccatctgctttgagtttggattctttccctgttaaaactgctgttaccaatattgctgtgaccaattaatattgctatgcaggagggtgtagagctgcgtgtcatctgtgaggagcttgttcagtccggcttggcatcgggcgagaacacgaccgtcatcctggttcagttcaagcccggcgccttccagttccagtatgagctagtcgatcccgctgcctttgacactgccgcctctaacgttgccagcaccagtgccggcccggctggtggcagcgacagcgacacgagcgccacgagcgacgagggcgtcgacgacactgccactgccgggaccaccaccacgggctatgaggccggctccagcaccggccccggcagcggcggcggcagcgccaatgccgcgttcgacagcggcggcgacctcgccgctaacttggacatcgccactaacttcggcagcgacgacctcgccgctaacttggacatcgccacggacatcgacaccgaggacgtcttcaccttcatcaacagcgacgacacgttcggcatcaacagcgacgaggtggagctcgatcccaacttcaggcccaagcctcaggtccgcagggcccacgacgggcccttttccactcccagcgaaatcgaggccgacctcaatgccagccccacgaggtacaatatgagggatatcttcgaggccttcgacaaagtcgaggccgagttgggcggcttcccgttacagggccacgatgtctccagcaccagcaccaaccccaacaccgcgactgacactggcagtggcagccgcaccggcgacgatgacgtcgacggcgccattgccagagccatggccgtggctagcagcgtcatgacgggcgcgggctacgaggtcgactccaccaccaccaatcccagcgctgcggctgacactggcagctacaccggcgacgagatcaaggtcgacgacagcaccagcggcagtgccaggggtgacagcggcgagctcgtcaacaacgacaccaccgttgctgacaacaatgccagtggcgttgctgacagcaccaccgtcggcgacgaggtcgatcccactgccactgtcgcggccgacgacagcaacaccggcgacaaggtcgatccccctgccatcaccaaagccacggccgacagcaacaccagcggcgaggtcgacgtcgacgccactgccactgccactgccagcgccagcgccgccgtggctgatgacgagggcacggctcctgatgacagcgagggcagcccgtagatgcatgattcagaagaaagaggtcaccggttcattacagcttccactcaattttgtccaagacggagatgatgtgtgatgatgcatgcaccactgcattcgagggatgttactgatcataggtagtagtagtagaactaatgcattgataggatcggagtagttggtttctgctaccttgtttttggtttatgactcctggttggctgggtacgtttggggtaggagattttgcttgctagacttggttactgagaacacttgtctggtttttgagtttttatcaaagtacttaatctagtgatgcttttgttgatcttcattttgaatctattacacatgctgagagctgagtatgtactacttgctctgttcccgaattaatgttctcttggatacgtaatcagtaatgcgcttggtttggctgattacctctcttctcttgtctgaactgaagagaattgcgtgctgaaaccggctctgaaaatctgaagccggcctatggcatactccagcaccgcaacagcaacggactcgtcactatcaatataaggaaatcgggacatttctactagttctgcacatgggttcttcatgctgcagaagctgatcctgatacaaaatgtacgtcagtaagtgttctggtcattatggatcactagtttgcatttcgttcgtcaacatagagagcaagtatggtattggctgagcgcataatattaatagcgtcattgttcaacgccaaacaaagaaatacagttgtgcagggtaaatgttataccaaaattcatttgcgtcgattttgattttagcccgaaagaagagtaacttcattatgagctaacaactgcaatttgggtcaattagtactaaaatcaacccaaatactataatctactctctccgatccccaaaactctcttgcttcgtgctgcccaaactcgcaggaccaaatatttatgtccgaggtgatctcccttgtggcagacgaactgtatgacttgggaacaaatgctatttcgctgtcacgtataacaaggtcgacatggatggtctcgggccagtcgtacagcctcgggaggaacaccttgttgtgcatcaacctaagcttagtcttcctcaacatcgtcgtgtatgtcccggtgaacaacgcatgtccttccaatgaccgcatcttctcccactccatcgtctcttcattgagcttgacgacatggacaggcgcaccactgtagccaacgaggacagccatgagcgcgccagcttggtcggactcaaacaggtggctatcgacttggtgttcgattccaaagctcccaggcttatcaagaaccttaaaactatcgccatggttgcacggatcgtacaccgcgagctccccgtcttcgccaagaacgtacagcaagccaccgtggagcaccgggttgctggtcggtgccgccagaatttgcggtccgaagcccgtcaattcccagggcccccattggccatcgtcttgttggatcgcacgggcgagccgtagcgcggacgtcgtgttgacgcaatacatccttcgcgcgcggtcgtcgtagacgatgaaatcgggcgacgagtcgaaaggcggtgtcggcttcggcagctcatggatggtgctgccggcgagtagtacgagatcggcttggaggatcgatttaggtgagcacagcgtgaggcgtcgtccggtggagcagcagatcctagcgttaggcaccttgacgagcgtgtcggcgatctggaaacacttgtggtagtaggggctgtagtacctggcgctcgtgacgccgacgtcggcggcgctcaggaggagaggcgtgatccacgccgggtagaagggcgacacggcggagcgccagtgccggcacgtcgacgcgaagctggggtgggtcgaccacccgagccgatattccaggacgagcacgagcatgtccaacgggagagacgaccagtcccgtcgtccttgcgccgccgtcgcggcggccgcctccatctgtcgatctctgcttgcgcttctttttgcggtgctcctcacgcgagtcgcgagagttcgtgcctgcatggcgagctgcgttttgtgctgctacggagctctactttcatggcgtgtttcctccggactcgtattataggtcggcttcagctcggagattgtataccgccccagcgccccggttggtttttgttggtttgctacccactctccatatatgcaaagtatttagattttgcttttgaattgggttgatagtttgaattttgatatcgtgtaggaactcatgtttccttttcctgatctacgggcggtgcagatgataattggtaggagtactaattgtaggtagtggacgtgcatacctctttcctatgccaatagttatttataaggactagcaaatatacccgttcgttgcaccgggtgaatatcaaacaaatatggatggttaagattgcttgtgtacttataatacatgtgcacaaaaatattgaatttgtacataccttgcaaatatctccaagttttatacaggaaaatatcaaaacatatctcatactgtatacatattcagattcaggtcgtatctcaaactatattccaaattttctacacattcagacaatattccaactttcacaaattttcataaacgggggcagttacagctctgaattcaccatgctctacaaaagaaaaatggtaaaggcatctgcaatgggaaagaaacacacactttgtagtatcgaaataaaattcactcaaaaatctttagtggaatatgtttgaattctagaaataatttaatatttaaggaaataatggggcgttttggtttgataccaaaatattgccatatcaattttttggtagtttaaatagtaaatatgatgatttggtttgaagccaaatgtttggtaatgcctatactcaatttggcacaattctagaatattcttcatcacaatttaaaatttggctctcaattggcataaatccaaagacactcatttataattctaccctaccaaaatattggtagtgtcaaaacttgcctagagtttggcactaccaacataggataataaaccaaacaagcccaataattattttgacatgaaaccatattaacttggtcaaatacaatatcatatgattaatactttctagataaattttttgttggtttcatttatctaaaaataatctatgagtgattaaataattaatcgtaatttcccaacaattttaaatggcttaaaatagtaccaaacaaatttctgtaaatataaaaataattaaatcagttgcttagaaaaataaactgattttggcctagcattgtggtttagggatgaagatttggggacaacttgagggaccaaatctgaacttatccgtgcgaagcatacacgtggcccaattgtgtggcggcctgggaacggcaacccgacgcgggagaagccacactcgtctgatctgatcaacggtcccgattgatccgaacatatataaaaagtcggcagcccaaaccctaaccctaaaatcacttcccctcccttctctctctctcaaacctacggcgtcagcggcgcctctccccttccgccgcttcccctctccctccccaccggcggcgccgctccccttccccctccctccatcagcaacgccgctccccttcccctcccccatcggcagcaccgttccatctccccctctccctcccgtctcgctagcatggcacagtgttgggggacgacggcgacgacgaccatccttccatttcccctctccccgtaggcctcgatggtggggctacaagcctatgacacggagacggcggcgacgacagtccttctctctttctctcctctgtctccgagcaagaagagagcgccggaaggtaggtcgccggggtagagggagggggtgtgtaagttcaagtgccttaatttggtttcggtgattaatgacaaatctaattatatgagactaacgtttttatgagtctttctttgactagtctcatttggatatgaaagtaaaaatgatgagaggtatgtattaaacttcacatattctaacttggtctctcttgtggatccaaaatatagtgtgagcttcctatttgatctttattgattatgtgcatatgcgttccttcatatgcatatgtatgcacatcttgagggggagcttattctattttttttattataagatttctatcttgatttgaaattattttttatctcatctctctatattgtttatatcgggttattatccatcaccaaagagagaaaagattgaaagatcttggattaaacaatttgtgtaattgttactttggtgatagatgataaaccgatgtttatgggattaacttctcttttgtataagttgtctactaggttatttcccgataatgagatgtggaagacatgcatttttttgtgatggaccttaatcatgacaagaatgaaatgcatggagataaaacgatatataccacttcttatctcctacgttttgatatgttcatatatatgatttccatgttattgatatataagtgtgagactaatgtttactcgaatgttatcttatttagtctcatttacattgagaacatggagatcatgaaggtatatgttttatgttagtctacatcattactacatatgtcttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatatttcatatgcacccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcatcatgttggcaagaatgaagtcaagcttgtgatgagaataaagtcctgacaaaagatggacaagacctcggcataaacatggttcaaccggatggttacaagtgttgatctcggctcaagcttgaccccaagatggatggcgcaaggcaaaggtataatgtagctaagaatgttttcttagtcttttcccggtcttggtgtttggtgtagaccggatttgctagataggcgccgtactatcaagaggggtctatgaagcgagcttgtggatgatcttgtgccatattagttcctatgcatgtaggtgcattttgtgggcttgtctaaccaagtgtgatgagttttctcaagtcctaaaccaagagagaagtgggcatgtcaaataggagtgagtgacatcttgtgggtatgtccggtggatatcctttggagtgtgagccctttatccttgacttaagttgtgtttcttggatggatttttcatgggttggatggccctttgaataagctttccatatattccaagaacgccaaattccgagacccgagtcaagagatatcgccgttttactaacggtcggttgagctgaaaagtgacctgcggtctgaccgtgggccttaggccggtctgaccgggtctgttagccagtctgactggcgtggtaaggccggtctgaccggccccattggtctgttgcactagtctggtttttggtggcgatacagagccgccagagccgcaaccggtcagaccgagccgacagcagtctgaccgagccgtggacggtctaaccggccactacactgcggtcagaccggccaggttgagtgggctcaatgattgccctgtaacggctagttttctagccgttacaaagtagtccggtctgaccggcatcacaacggcggtctgaccggcagaacacaaagttggggattttggttccaacggctagttttgatggttgggggtatatatacccactccccagcagcaagggtaaggttttggcactccattgcattatcttgaacccttgcaagagctctcacacccttgtgcacttagtttatctagtgaggtgttagagagtgagttaagtcaatccaagtgcattgcttcattgttagagctagtgtggcacctgatcatcctcggcaagcatcctagacttgttactcttggaggttgccgcctcctagacggcttgtggaggtgttgcccggtgacctctccgaggagattgtggaggaggcccggcgccggttgtgagtggtttggagttcaccaccttcggagcgaaggaagaactacccctagtgatcgaggcttgggtagtcctctccgtgggccggctctcaccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttattttctgcatttacatttgtgcaatttgcattcatagagacatatttgagcccatatcacctaggtttgcaaaatttaacttagttgcttagttaaccttgcacctcaccttgcctagcaacttaggttagttttgtttaagtgccattaagttttaagaccgcctattcaccccccctctagtcggcctccttgatcctacagggtgccgtgcgcggttggggatgtggtgagtgtggccgtgcccggcgggcgaggccatgacaggagcgcggtcaatggcaatggtgactgtcacaccctgaagttctttcccaagcctaaattgaagttataaatggtctcaagaaaataccagtgtaaagcaagagtaaaccttaataaattaatgcaaataataatcagatttggcatgtgggatttttcttgagttctaaatgtcgaaatacgctaacaagatttttagtggaattttcagagctctagaaataattttaaccaattaaaattgagcacaagcaatatttaatcccaggaaaatccatttccttccttttctttttcttttcccctttttttctttcgaatgggccgccggcccgttctctctccctcctcttcttgttgggccggtcgaaggccgaggcccagccgagctgagccagccgcccgcctccctctcccggggttgccgacaggtggggcccacctgtcgggcccgtccccttcctccggccggagccgccgcgccccgctcccacgtctcccgggccacgtcgcccacgtcgccctcgcgcccgcgttccccgcgcccacttcccctctctccagcatgcgccggcgctcgagacagccgggattcgattttggaatcccgcctctctctcctctcccacttcccccacgtcggccggcgattccctcttctaccggccacgtccgagctccctctcccctatttaagcatccccactctctcctctctctttttcccatttcgccaagctctcccgtgccctctatcgccctagcgtcgtcaccctcctctccgccgctgccgctgctccggtcgccgctagccacctctagccgccgtgccgagccgtgtcgtcgacgccgtcgcgttcgccgtcgtgccggccaccccgtccacccctctcccgtcggattccgccgccggaacccgctccacgccgtgcgccggtgagcatcgccatggccgccgcccttggccgccgtcctcgccctcttccatctccctctccctctctaactcctttcatcgtgttcgctaggtggttccggagatcgtcccgccgtcgccatcgccctccgtcgctcgccgtcgtcgcttgtcgtcgatgaggcacctcctcctctttctctctctctctctctctctctctcccgcaccatctagtcgccgcgccgccgcctagccgcttagnnnnnnnnnnnnnnnnnnnnnnnnnnnnnnnacgaccgg

SEQ ID NO: 14031 - DNA, 15253 bp, Oryza sativa
  unsure (1)..(15253): unsure at all n locations
cccgtgggcgccggccgggtgctccccaccgcggtccgatctaccctcgggtagttcggggccgtcggttcagccgcccgcgtggcgtgccatgtggccgccgcgtgtgcgccacgtcagcgccacgtggtgccccgctccttccccggtccgtgaacttggtccaccatgaaccgccctccccgagtcactgccatgtggggcccgcatgtcggcgccgcccctctctctctcccgtgatttatttattgcgcaataattcaattaaggatttttctgtttatagtaaaaacacagtgaatcttctaaaatttatatctaattcatccaagctccgtttaagcccattgaagtctcagtaaatcaataaaaatgtgtagaatccattaaaaatggttttgttctctgtttcagtagtcttatagcctgtttgtattgtttgctttgtatgtcgcttagattccggctctccccacgctccggtgtactttgaaatagtcgccgaggttcctccagcagtagagcaaggcaagtcatgcttgtcacttgaacatgttgatcctatattgcaaatgctccattgttttccttcaaatactgcattgttttataatattaccatgggaagtttacctactgttatagccatgctattttgtaccatgttcctttgttagcttgggatataacatgactagagattggactagggatttcttagccttgcttagttcaactagcacacaatgggggacaacattaatgcatagatatcagattctaggaatgatgttggttaatgctcaccgctccagtgttggttaattaaaatatattaaatggtgggctgtgggtgcatggttttgatggtcgcgcccatggcaattaaggaccggttcgcgggaaatcctggaagaattcctcgtacttaccacaagccagcgtgggcaacggctgagcttgtagtgtagcttttctctagccgacacatccaggcaagggtgggcgtgatggagtttggatgggccttacgacggcctatgcggcttccggattcacctaggcacgagaggggactgcccgctgccttgcgagaagtgggagtgaaacctgaggtgtggtgtgcttggttagaggtggttatgcgaagggtcctgtcatggcctctttccggtatgtcgtggtggcatgtcggcgcacggaaacgtgtcgtggggctgtgtcttgtgggtacagttgtacacctctgatcagagtaaaactattcaaatagccgtgcccgcggttatgggcggtcaaccagattcaccgtgattagtctcaccctagggtagtctgatggaactgattagttcaggtggatggttgggcctgttgcaacgtggtgtaacgttggacagtggatggttaatattgattaattactataatgggtttacttcttccaactactgtttataaatgctcgctttatgcaaatgaaccactctagctatcctttgattaccctgcatcatacccctatcccggtatgacttgctgagtacagtgggtagtacttagtcttgctctatttttcccaaaccccagagtttgagtatgcgtcagatggtggcttttccgaggagtaggtttcgtccgtgccatcgaggatgcctgtggagtggtgttcccgctgcagtccaagtcaaggctaagctccagatatcttttaagttttccgctgcatttatgtaagacttttataatatttgtaagacgtggatctgtatgtcaactttgtcgtttgtgtaccccggccggtcctggacggggattttaatgcacattctgcttggaattctattcgggaatttctaggcgtgacagtgacgagctcagaacaaccggatccgatggcaaactcgctcatttgtgtgatttttttcctctctttttttccttttttctagggttctcaatctgtgtaactatccgattggatgattcttttagattctccgtgtagttctgtttgataggatgacttttttcaggttctctcagtccgtgtagatctttgatttgattttgtgctttatccatcgtacatgattggtatatagagtgattaataagaacaaaaaaaattctaccttttttatcacggacggtgggtcttcttttctccgtgtcattgatgaatcggacttttcttttttttttctttttatatgatgagggcatcatcaccatggataaaccataatgatgttttacctaatcgaacataaggtgcaagcttcttatgaatcggagaggtgtatcgatcgctaagggcgcaacgcaatgccttgtacggttgtagtcggatcatcaacgtttcttccaaatcgtagttatctcaactcaccgaaagatcggtccaaacaacagctttgagcatcttgagtggagctcagggtttatcattatatatttgttcgcctttttttttatcacgatgacgaaaacaccttcaattttttaagtatttttttaagtagtagagatagagataatagaaagattaaacaagattcgatagacgcatgtgatgatatctctaatctaaaaaatataccaacttagtcttggagattctcatagagatatgttgtgcgtgtgtgctttcatatggatcaatgtgcacgtgtttatatgaatgcatgtatctatactgtgtttcgaaaaaaaatacaacctgttctcaacgctatattgacgtgaaagtaaagtgaaagtcttttttactttcacgtagaataattgattttgtatttttcttatttacttaaagttgtctttataaattttagcaaatgagatattttcaatagactttcatgtctaaccggaggaccgtagcgtttaaaaaggaaagaaaataaataaagaaaatgggaaccgttttctcgctccccttcccaggcgctatctcctcccaccactcgaaccttatcccctccaggcgcctcactcgaaccttaatttcgtgttctagttagaaatttggaatttagaaacacagctggattggggttctcctatggatcatgcttcagattttatttaggtggattagagtcttattcctttcgattttggaacgacctgggctacggactacacacgttaggatttttatcgatctctttttctttctttggccgctgtaaaatagcgaagatagagggccactcagtcggaatcgacggacgaatcggtcggaattgacgcacgaaaattttgtgacgaaaggaaaattttgccaaaggaaaattacgattctttatattagttaagatttatgaatttgatcggccagtcgtccgtcgaaatcatggaggaggcagtcgacgcatctgccgctctggatcccaagcttgctcctctgctgctgttcggcggccacggcgacgccacgttcctgtacagcgtgccgaagagagcgctgctggcgccaatgccaacgccaacgagggtgggcgacggcggcgtcgacgacatgatgagaggccaccgctggtggaccacggcgcagggctggttgctcatggcgcgccgcggctcgccgtgcactttcctatgggaccctttcaccggccgccgtgtcaggctgccccccgaccacgacggcaccgtcctcaccgccgaaggcagccatcgccggaggtgcctcctgtcatgctgtggtcccatggacccgaccagctgcaccgatctcgtcatcgacctcgccgacccggagctctggtattgccgtcccggcgacaaccactgggtgaagctccatcagcaaccgtaccagtaccgcaaccctgcccaccgtgacgccatcatcagttttttacgcaagtttacggcgatcgacggcaagttctacaccgaactacacaccggcaatgtcggcgtcctcgagttctcgccggaggttgccgaggggaactaattcccctcggcccaccggcacccgttgtcaagcgttatcaaatccatgcaggctcttaagtcgtgtagttatacaaagtcacaaacctgtattatcgacgaaaatctcgttccttgtagattgagatgcatggcctctctgtttactttaaacatcattcaagcggacaacaggtggatgttaatttgcctaaaaccgacatttttcatcttcactaatagctgatccattttgctgtgctacttatttactgttctctgcaatgactgtttggagatgctgctccacaaaattcagtggtgaatagatgtgtcttgtgtatttatcatacatctgttcactttaagccaatattcgagccttttgccctgttacatcaaattgcattattcacttaaataaataggtatgaataaggttactcaaaaaaatgctttcgcagcaacaaatctgacaaaactgcaaaagttcacccttaagaagagggatatatatatatagcattggttctgcacttctgcatgctaaagtactccacatgatacagcaggctggctttccatccataaggttacaaatgggcaggattgccgtttctgtttgagataaaccaaaggagttgcaagttagaataaagcatttatagtcacatcatgcatacagtttcagtactacctccgtcccaaaataagtgcagtcgtggaaattcgtgtctaacgtttgaccgtccgtcttatttgaaaactttatgatttttttaaaaaaaattagtcagacataaagtactatttatgttctatcatttaatagcaataaaaatagtaatcataaaaaaatttcaaataaaacgaatggtcaaacgttggagatgaatagtgcaaaactgcacttattttgggacggagggagtacaagatacaacacacagcgaactggcaatagattgcttttttgtaaatcttagcactccaatgcagcttgagcttgattagttccaggtgttgacagacggtcctgtgactggttgctcatctagggcacggcgcaactcctcaaagaagttcatctgtactaccaatgaccacagaaaaggaatcagagtacagaaactaagacgtaggagaacagtatgacaaaatcgcaggttcaatatacctgatgaggaagtttcatgtgaccatgaccccatgatgatccactagatccagagtacatcaccggcttatctggcaaaacatcaacagcatttaataggttactttggtttagtgcttcccgttggtacaactgacatgaaaattcacttgagtgcacagggtacttgatggtgttcatagtaacatattaacatcacgaattgctatacaatactataattgctagcaccataattgtgcggcgtcactactgttgccaacactttatattcacctccatatttctatcataacttatgaaacggtaatctaaattaaacataggtctaggatagtatgccaggtcttgtagaaattgatcctaaaatatctaaagattcctctaccatgattcatgacatagtaaatctcccatcatgcggcctgaatttgcttaaggactcaccaggggaatcatatgactgatcattgtacaagttcattgctgcagcccaacctacaggggaaaagcagcaaaggtttattatcacataagaagaatggttgtaaataaagttggttcaaaattagtacagcaactgtaggaatacatctttgttatatatgcctagaccatccttgattaaaagttgcctaacttccggtaaattaccggtggcatatgcacaattgcacataaagagaacagttgatggtatgattaatgaacaaaaaagataggataagcagtaggtacacagtttgaatattcttccatgttactaacatgcagagaaccccaaaataaatcacaacaggtgctccacgtatttttctttacaacttacagtatctgaatattggattatcagcctgtgtaaacttattaaagcaatgggcggttctgtaatatactgcatgtgcttttactacttactccctccgtcccaaaatataagcatttttagaccacgacatagtattcgagatgctactttgaccaacaatatctataaaaataaaatggtttaaataaaaagagttgcatataataatagtttgattaatgataaatttagtaacatcaatttcacattattgattttttttatttttttgctattaatagttaaagttaaaaatggttgacttagcactatgctaaaaatgcttatattttgggacaaaatgagtaatatcttattactgtagacataatgtatcactaccacaataacatgcaacaattcccagaaagtcaaaaagataagaacttatatcatagaacttctacaagcatttaaaagggcagcttggtctctgagaaacatacggtcattgagaagctgggcagcctcactggcacaacatccctccaagggtattaatcttgtttgactgtaatcattctgaggattgctgaaaaaagtctcatgagggataattggtggaaggttctttaatgaaggagcatggctcttctctccatcattattgtacaaataactagccttctcagccctatctgtttggtataacaaaagtgttacagtgtcagccaaaaaaaatcacctcataaattaaattgttatgcttaaacatacagataaatcattaaaaaaacacatggataaggaaaagatagcccataaaaaaattattggaaatatgaataatcaaataaagacatgtcaaggttagaagattctggacagctattggacataataagtaaactctgagtaaaaaacacatttgacttgtaaatgactgattgtggggattatgattgcaggtagcttgcattagatgcatgaagttgcatgttgtacagagtattggcatcattaatacaatggagtagaggggctcatacaaggatgtttgcttgcaaggatttccttatagatatagagtagttatcaacatggtcggtgtaaggcacatatttttcagcccatttgtggaaaagaaacatggcagtttcactgcatagaaatctactagaggaataatgaattaagtttgataccataacaaccaacaactggataagaccttatcaactaatttggagaccttatatagcagtcaagccaaaataataataaaggaaaatataataaatccccaaaacatcatgaaatccaactgattcaataataattgcgtcgattgttagcacggttcctgaagcatattcagtaaagatagccatcagaaagcatatctatgcatgatatgtagcaagattattaaaactaaataataactaacattagactgcagacaacagaatatttcaagaaataactgatggtttcaaacaaaataaatatttagctcataaatacaaagatggaacaaagaagccatatcaagttatcaactaatcaaatcaacaaggtgatagactgattgaacaatatgtcttaagcaaatctacttcttcattgtgaactccacttataattgtgaaattgtgattacgcgatcacctatcaaagggcaattttcaatatctggcagtacagtaactaaagtatgatagtctttatgcagtcattatatgccctgtgttgaagtcatgcgttaaacttatacaagctgaccgactggcagagttttgctaggcaaggttagcttaatccgctaacccaaattcgaaacatgggcaatccttcacttgctaaaacaggtagttaggtcagcattaaacatgccctgaaataagccattagccatgtagcttgaacaaagatttttctaaaataaataaaagttagttgctaaggttgttcattctcaaaaagctaaaaagagagaccagcgagccaataagccttataggtcggcttccgcttggagattgtataccgccccggcgccccggttggtttttgttggtttgctatccaatctccatatatgcaaagtatttagattttgctttagaattgggtagtggtttgaattttgatatcgtgtaggaattcatgtttccttttcctgatcaacgggtggtgcagatgattggtaggagtactaattgtaggtcgtagatgtgcatacctctttcctatgccaatagttatttataaggatttatgaatttgatcggccagtcgtccgtcgaaatcatggaggaggcaggcgatgcatctgcagcactggatcccaagtttgctcctctgctgctgttcggcggccacggcgacgccacgttcctgtacagcgtgccgacgagggcgctgctgccaatgccaacgccaacgagggtgggcgacggcggcgtcgacgacatgatgagatgccaccgctggtggaccacggcgcagggctggttgctcatggcgcgccgcggctcgccgtgcacttttttatgggaccctttcaccggccgccgtgtcgggctgcctcccgaccacgacggcaccgtccttcgcgccgaaggcagccatcgccggaggtgcctctgtcatgctgcggtcccatggacccgaccagctgcaccgtgctcgtcatcgaactcgcctacccggagctctggtattgccgccccgcgacaaccactgggtgaagctccatcagcaaccgtaccagtaccgcaaccctgcccaccgtgacgccatcatcaggtttttacgcaagtttacggcgatcgacggcaagttctacactgaactacacaccggcaatgtcggcgtcctcgagttcttgccggaggtggcgttcaccaagatcgctgtacacgacgacgataggagaccggcggtgtacaagaaacgtactacttgcttcgtggaatcaaacggggagctgcactccgttgtcttctctcacccgatcggatgtgaccggattgtcgcgcgtgtaggcgtttacaggttgagcattaatgcggcggcaacgcaggagcaaagatcagcagcatgggtgaaggtggattcgctaggtggcagagcgttcttcgttaagatagacagttttggagcgtcacttgatgcggagggaacaggcttgagagggaactgcgtctactactcggtgttcaatgggaaagtgttgtgtgtatacgacatggaacgaggaactacggctgtaatcgatcccggcacacatcttccgtatcaccagtcaccccaagtattgatgccaacatttcctagatatcatggcggagcaactcgaagtgttgaaagcatctatcaggttgggccaacaattcaggaaaatgcttatgaggtaaaagacactaaggtaagtaaggtgaagagggatgttcgatttttcgagggtggttgtacttgtttgccgattcctattcaaaataagttaataaatcagaagaagagtaagaggtctatggctgaaagatttccttgtcaaggggaaggtgcaagcagtcccgaaacgaagaactcataccgcggttgtggctttcctttggagccgctcaaatgtcttctgcgtatgaagaaataggagtgcactacatagaggatccaacttaccttttatgccaactcgatgagtgtttttttagttaactcattcattcaaaatatgcactaatgttagctcggctatgtcacgtctattaatttcattaagttttggtctctactatgtgattgggagctctttttctctgaaattttatgaaaccatcttcttttttcttttaggtgtttaacagctccccaatctgctttcttcctgagaaagcctcgttgtgtagtgcccgttccgtcgtagcgcctagctaacatcgtcagatcccaatcccccaatccatcgtcaagttcgaattccaacttcaagtcccctccaaatcaaatctctcgacagaagtctatttcgcctccctaaagttttgtgggccgagctccctccctcggcacatcttctccctcagcccatcccctcctctcgcacatgccgtgcgagtgcgctgagccgagccgagagagagccctctctctcattttcttgctctctctttgttctctctctccccgatttcccgccaacgacacccaagttgccgcgccgcctgttgccgcgcgtgcactgtggtggccgaccggccggtcgccgccgccgtcagccctgcctgttagagtatatggtagttagagtcatattaggatagaattggtttgtttggattccttccatatctgtaatccttccttatcttctccccatgtactcctgtatatattggctccctgagactcaatacaatatgtccaatattcacagtatcctctctccctatattatctaacatggtatcagagcagacgatctagtcgcctctctctcacgcttccgctcgtcgccctcgggagggtttcaatctcctggggcggccaccgtttttttttccttcgcgtcgtcaagtcgatgtcccgagagagatcgatctctcggacgcttgcgtcgtcatcaagcggcagtagcagagtctccggtcatcatcagtctgcacttcgtcctccacctccggtccgccgcctccaccgcccctacctccgatggccaccgtcggcttatcgacctccgccgggctccgcggccgacggacgaccttgtctccgcctcgaccgctgtcttcatcaagctccgccggggggatggaccgacgtcttcaccgcctctccgcctgccttctgcctcgtcgccggcaagacgctgctggtccggcgtctctggcacgggcgcgcggcccgacacctcgccgccaggatctgcaccattgtcgccgcttgcggcctcgacgcctccggactcagctccctcgtcgttgccgccggtcagcccctacgcgtccgcgtctatcttgcctctcgctccctgtattgtttggttgtccgtcactttgctgtgatcttacacgtgattagcaagggagaggagagagagagaagatggttgcagagagcttgttggctggctggctggctgtggagggaaccgattgtgcatgtgtcgctgctgctggtacagttgaggcagagaggttgctggacgtggacttggtctacggaccatttgagcacgtagggctggttgttactgtgctgcttgctgctgcatgtatctttttttttcccgatcagagatcgggtttgcgtcgtccaccgcctcgtcgatatctacgcgtctctgacatcggcatcgacttcgtcgtcctgccccgcgcatcttcggcttgatcacccgttcaagcgtccgactacaacgacttctgtaaccgatcgtcatcgagcatgcgtctacgccatcaagctctgggttgccgctgtgtcgcctccttgggccgcagtgccgctgcctatggtccacacctccattggctattgcaacgctgagaggcgcccttctcagcgtggcctcaccgccggtggacttctcgccgctgcatcgacatggagctgcagctgtgctgtcctctcggaccatagctttgccactttcgtcgtcttcatcgccgttcgcgcatcgacaacctcgtcgtccgcactggtcatagtcagccgctcggggtctccttcctctacttcaagcatcgccgccgcatctccaagctgccactgtcgccactctaggccggtggtgcagctacctctacatggctaccgatgtcgccgtccaggccgttggtcccgctatttcgccttctactttgtccagcatgactcatcgccagcgtcgccgtatcttcctcgactacacttcgctcttctccggcaactgcgtgctgctccggcaattctccctctacgccgttctcgcgctgcgactgtcccagaggccttctctgctagtctcctccgacattggcgtatgattcatggtggtctcctgtctcgcccgcgcggtattggcaacaccggcgcgcgcgtttgtcccgagttgtcccggggtctggcaagccctgtgtaacgtctcgtcctttacggttcgactacattggctcttcggcgtcatcttcctcaacgaccgccgcgattgtatcaccgtcttcgtctccagcgcgtcctcacgcaccattggtccacgatgccctcccgtccatccacgaccactctacgacgccccctgcgccttacggctcgactacctcgacatcatcgacttcccgacttcggctacatcgaccacggctactctacgcacggcttcatcaaccacggctctctcggctccttcgctttggttacatcgactatggcacaaagggctatcatctgtgttgagtactctttccggtttcttctccagtccaagtgtccgcgctgctcacgcttggactgcgggggatgttagagtatatggtagttagagtcatattaggataggattggtttgtttggattccttccatatatgtaattcttccttatcttctccccatgtactcctatatatatcggcccccctgaggctcaatacaatgtgtccaatattcgcagtatcctctctccctatactatctaacactgccgcgcctgtgccgtctgtgcccgcgctgccaccctgtagccgctccgctccacaccgcccctagccgtcatcgccggcgtcatccactccggccccgccctccgtgcgcgtgcgtccaagggatggaggtagagccctgcctcatcgctccttctccctccttcctttcccgttttggcaaggagtgccccccctttctttcttctttttcttctttttcctcccctcgccggcgtcatcctctgtcgccgatttggccgcgtgcgccgagcgccagccgagccatttgactgcccaaggtcggttctcccctcccaaaccgacatcgccatcccaatctctcttgttttcactctccaccgctgtcgcacaccattgtcgtctcgctgtcgccgtccgtcgctgagcgtgccggaggagctggcgcgttcgtggacgcgtgacgtgaactccgcgctcccgcttcatccccttcctcggccaaaacgatcacgtttcgcgccgtgtcctctcttcacggcgccctgtcccgtcgcggtatcccctccgttccccctcctcgctctccctcctccccgtagcacacccgatagctagtaggcgccaccccaagccccgccgccgctcggcatggtctcgccgccattgccgcccgtcgcttgccctcctcggctctgcttcgtccaatccgacgctaggaacgagtcccggtggtcgtgtgtctgctctagcttcaagaaatcgaaccctcgtcgtcacgtcgtgctttccctcttttgccgccgccgacgaacaccgccgcaatccgccgccgtcggaagggcgacacggcggagcgccagtgccggcacgtcgacgcgaagctcgggtggctcgaccacccgagcctatctaggacgagcacgagcatgtccaacgggagagacgaccagtccatctgcttccgcttctttttcgccggcctggctggtgttccacacgcgagagttcgtgcgtgcgtgcgtgcgtgtccgcgatggcctgcacggcgtaatataggtcggcttccgcttgtagtttttgttagtttgctatccaatctccaaatagatgcatactggagtactagtacaattaattttgatgtcgtgtaggaattcatgtttccttttcctgatctacaggccggtgcagattataattggtaggagttactgattgtaggtcttaggtgtgcatacttcttcgcttctttatctcttgtagacttgtactactattaaatcgcttctttatctcggatgatttggaacagaaatcacgagacaacacttgtaggatttctaaaacactgcacaaattcgtataccgaaagatcgatcggccagtcgtccgtcgaaatcatggaggaggcagtcaacgcatctgccgctctggatcccaagcttgctcctctgctgctgttcggccacggcgacgccacgttcctgtacagcgtgccgaagagagcgctgctgccaatgccaacgccaacgagggtgggcgacggcggcgtcgacgacatgatgagaggccaccgctggtggaccacggcgcagggctggttgctcatggcgcgccgcggctcgccgtgcacattcttatgggaccctttcaccggccgccgtgccgggctgccccccgaccacgacggcaccgtcctcgccgccgaaggcagccatcgccggaggtgcctcctgtcatgctgcggtcccatggacccgaccagctgcaccgtgctcgtcatcgacctcgcctacccggagctctggtattgccgccccggcgacaaccagtgggtgaagctccatcaacatccgtaccagtaccgcaaccctgcccaccgtgacgccatcatctggggattacgccagcttacggcgatcgacggcaagttctacaccgaagaactctctggcattgtcggcgtcctcgagttctcgccggaggtggcgttcaccaagatcgccgtacacgacgtcgataggagaccggcggtgtacaagaaacgtactactagcttcgtggaatcaaacggggagctgcactccgttgtcttctctcacccgatcggatgtgaccggattgtcgcgcgtgtaggcgtttacaggttgagcattaatccgacgacaacgcaggagcaaagatcagcagcgtgggtgaaggtggattcgctaggtggtagagcgttcttcgttgagattggcagttttggagcgtcatttgatgcagagggaacatgcttgagagggaattgtgtctactactcggggttcaatggaaaagtattgtgtgtatacgacatggaacgaggaactacggctgtaatcaatcccggcgcacatcttccgtatcaccagttgtagcgcccgttccgtcgtggcgcctagcgggaaaattatctcttaaaaaccctaattgcgaaatttgtttccttgctcgttgtgtagtgtccgtgccatctcagatctcaaatccccgatctatcatcgagttcaattccgaatccaaatccttccaaatcaaattcctccgcaaaagtctagtttgcctcccccggggtcgatnnnnnnnnnnnnnnnnnnnnnntgagtcgaacaaannnngcccatga

SEQ ID NO: 14032 - DNA, 6882 bp, Oryza sativa
  unsure (1)..(6882): unsure at all n locations
cggccnctttgattgtcagatcgcacagnaccncancaccccctccgctctgcccgcgcgcgtgcgcgtgagccgcccgcgccgagccgagccctcctcttcgctccctcgttgccgctccccgcgctcgttcgcgcgcgcgcccgcgtggttgccgcccgtgccgagccgtctacgccgtccgcgtcacccggtcccgctgccctgccgcctgcagccgcgccgccgctcggccccgcagccagcgcgcgtgcccgagccgcgccgctccatccgccgcgcctcccgttgcaagccgcgcgcgcgtgccgagtggccgaccgcctggtcgccgccgtcgtcagcgcctgcccacgcctgtcgcccgtgtcgccgctccactccaaaccgccccgccgtcatcgccgtcgtcatcgcctcggccccgccactccgcgcgcaagccgccaaggaacggaggcagagccctcctccctctgccgcgacgcccccgctcccctcctccttttcccaaagaagaaaggggcgagccccccctttctctccctcctttttccccttttcctcccgccggcgtcatcctccctccgccctgtcgccgattggacgcgagtgccgagcgccagctcgcgccttgaccgcccaagtcggtttccaaaccgacattgccgccctttaaggccccgggcgccctccctctcttctcctcccatcgcctccactccattgttgctgcccctctgtttcgctgtcgccgttcgtcgttgcgcgcgtcggaggaaccggcacaagcgaggacgcggaaggggactccgggcgctcgtcttcctcctcttccccggcccgaggccggagagattactctcgcgccgtcggcctctcgtcacagcgcccctcctcatctcggtagtgcctccctccgttctttctcctcgctccatctcccccccttagttttcggtagtagctcgagtagccttcccgtagctagccggcgccgccccgaccgttgccgtcgctcgctgtgtgctggccgccgtcgccgcccgagctccgtagcacccgctcgtcgccggcctcgctcggcgtagctccgcccaatccgacgctagcaacggattcccgtggccgcgtagatgctctcaccgccgggatttggcccctcgtgacctcgtcgccgtttcccccttttctttccgccgggtgccgccgccgcaatccgccgccgacggactccctccggcgaatccgagccgttagctcgctccctctcactctccctcgtcatcccggtgtacgccccgtcgcccctcatcatcgcaaggcgtccccgagaaaccgccaccgcccgccgtccattcgcggccgacgccttcgtcttcctcccgccagcccacgtggcagccacgtaggcgccacgtcggcgccagctcgaccgaggtcgggtcgggccgaccccggtcagcccctcccgtgcgcacgttctaccgcgagccgtgaggctgcgcgtgggcccgccgcatccgttcctccgcgaaccgcgcgcgtgcaccgcgtcccagccccgcccgcgcgcgcgcgccgcgtgctcgctccgcacggtgaacggagtcaccgacaagtgggtcccacccgggaccacgcgcggtgagcccggtccaccggctctctctctctcctccctcccgcgcgagcgcgcgccttgggccggccggcccatttagctcggccagaccgccccaattctctcgggccgcgccctagccgcccgagaaaagtctatattccctccctcttttcttttcttttattttcttttcaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggaccgcacttaatctgtttgtcccgtctgcaaggcagattggcggacctacctagtttgttgcatttgatccttcctttgttaattgttatatcatgtccccttgtatccatctagttgtgtctcgatattcgtgcaccctgtgcgagtatcgacggacgccttcaaacttaaaatttgaataacaacttgggtaaaacttgggttttacaaaagacttggaaaacccggcacctgggtcggtgcttgcgaactaaatgaatttccaaaaccgcggaccggggaacgtaccgggagtacggtttcccgctcttgcacttaaggaccgtttccttggaatttcatccaaacataagacaagtacgaccatatgggtggaatgggacacccctagctgagtaactagcttatcaggggagccttgatgccgagagacatgtggattcgccgaggtggtgtcggggaggactctgggcttcctggcacagtatggtctgggacctaacctgttgttggtctgggacccctctcgtcggcatatggtaaacctgtgtcggctttggaaatgccttgttatgaaagcttggaggtctcccgatgtggctgattcccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattacggttgtggaaaggggttcgatgtttgaaaaatctgcagctgatgggatcagctaggcccgggtggccgtttgaaagttgttggcccgggtggccgtttgaaaaactgttggccgggtgccaaccttgattcaattctaaagactgatacattgcacatactccgagcggacgagacgcactgtctcatccgtgtcgtttgagaagcactcacttagttgtttttagaaaagagttcaaataaaatcaattgcaaaaacaacagcctttcctcgaagcctgcattaaacacttatttcccatggcttgttgagtactcccgtactcacccttgctctatataaataatcctccccccccagttgctgaagaagatgaagcggaagctgctgatgagtagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgatattctgtctccctgtgataccagcactgtttcctgggactggtatcgaataacaggttaatttggagcgtcacgggctagttccggtcgggactagttcggggcgtgacaccagtcgcctcaagtattgatgccaacatttcctgcaggatgttacggcagaccaactcgaagtgttgaaagcatctatcaggtagggacaataattctgaaaaatgctaatgaggtaaaagacactaaggtaaataaggtaaagagggatgttcaatttttcgagggtggttgtacctatttgccgatttttattcagaatacgagagtgacaaagcagaaagataagttaataaatcagaagaagagtaagaggtccatggctggaatacctccttgtcgaggcgaaggggcaagcagccccaaaacgaaaaactcataccgtggttgtggctttcccttggaggcgctcaaacgtctcctgggtacgaagaagtaggagtgcactacatggaggatccaacttacctttttatgccaactcgatgagtgtgtttttagttaactcattcatttagaatatgcagtaatgttagctcggctatatgacgtctattaatttcattaagttttggccactactaagtgattgggagctctttttctctgtaactttatgaaaccaaaccttctcgttgcattaagagaatgatttggtaaattttctttgataaaataagttagaaaatattaaaattaattatgaccttttgtttttccaaatatttgttaatttggcaataatttattcaaattcagtaaaagaatgtgttaaaatttcaaaaattttcgtttggagtggtgcctaccgaaattttctagctttttagaaagaaaaaatcctgcttatacccggttttagaattgagggccgcaattgaaactcgacctcctccataagagacggaagtggacttttccaactgaaaagcatttcctgcctgaaaccggagagtgagagtcagagactcgttgttctaaaaaaaagttctgaaaaaaaagtgagagaccctcaatccctccccaaccggaacacccactccgacgagaacgacatggacgccggcggcgaggaggagaagcaggagcgccaccgggttgatggtgcttcgccttccatggtcgccctccgctccgacgtcctccacgccgtacggcaccgcaccgccgtctctctccctctctctctctccatccatcggccggctccccgcctgcacgccggtagctgacgtgttttggtttttcttttcttttctttttttatgcggggttggctgccggacgacgcgctgctggccgagacgcgcgccgcggatcgacgggtcgtgttactcttattgctcagaaaattaggtttgcccgttgctgttcttatggctgtaggcaactcaagtctatgtggggataaattttgtgacaactcaagtctttgctacgattcgtttgcctaaacgaacaggtgtaattgggcttgtagaaaagcaatatgccaatatagattcctaaggatcacaattcacaacttcccaaccaatataaaaatttctgcaccctcgtcaccaaggataaaacccaatgtgaactaatgtgaaggaaagtcgagatatagaacttcattagagcgtaaatagtatcctttggttccagacatcaacacatgcccttttagctggtcgcatatatcttccgtgctgctctccgcatttgttctgtatctaatgtttcagttactagcaagtttgataagaatcattgcttcctctgaaagtaattatttttcatgtatcaagaattgctgacgctgaaaagaatttgggtaaggttaaagtgcgtgaggcccatatagccaaatccttgtacttcataagggttggggagaaggtataaatctgtatatctctatactttaccctgtgacctggttgacaaagtacatgctcgaaatttagctacttcagtgacaggggacctcctgttgcaggtccttggagggaagtctcataatcaggacacttctgaattggtcacactggtatgaaagagtttcatctatcatgtcaagttaaatcagggaaatcttgtaaatcgcgtcttggaaaaactaaagatttgcagtcggagtggtccaaaaacaaatttcctttgtatgcttatgctgctgcttttatgttcctagtcatgcaagaatatgataaaagatcacatggtattgacttcctcaatcgggactttgttgtccgaggtaaattgatatacatgctcggtgtctgtatgaagtgcatggcaatgcatccggaagcatcagctgttgccccaggtcttcttgatatgatcagatctaggtatgccaagcctaaacaaacatttccctgttaaggaattttattggtaagttaccattttgacatcaaattttgttctacagagctgtttgacaacatcctgaagcatatgtcagaaggtctgtgttgtttgcagcttcttgcatattgatagcgctgcacctgttgtatgtctcatcagctcttatagaaggaaatcaggacattctacatacacatatgggttcttcatgttgcagaagctgatcctgatacagaatgcacatatcagtatgtattttggtcactattggggggggggggggggaattatagtacaataggctcagcacataatactaacagggttatttttcaaccaacaaagtacaggttttcagggtaaactttatatcaaattcatttgcgtcgcctttaattttatcctgaaggaagagtgctttcaccctgagatgattcaccatctgaaaaataaaaagctaataactcccaccttatgctttagtttcctgtgacatacttctttctatcattcctttaagtcttctacttcaaccagtgatccagctcttttcagtaatgtgtagagaaaattcggactcttttttttcaaaaaaaaaaacgtataatgagaaaccatttcagtacgctggaactcagtaacttctcacaatgtcatctaactcctccattggcatgtctgtctccttgcaggccattatgacctgtttgcaacttcgttctgagatcttcagacatcacaagcactgaatcggtggatcacagcatggccagcagctgcaggtctctgccttttaagcttgataccatcaatgtactggattagaaatataaatcgatcaatgtatttgggattcagagtgctacatttttcgtcatttatacatagaacatgaattcccaacatnnnttntntgnntgttnccagcggtntgtattactagggct

SEQ ID NO: 14033 - DNA, 11351 bp, Oryza sativa
  unsure (1)..(11351): unsure at all n locations
cgcgacgcaactaccataaatgaaatttagtagggcggccaaaaaaataagatctgaaacaaccaacgattgggtttttaataccgtcgtanaaaaganaaanaaaccccttccccccacgttggatccgcccctgattacagattttttttttaatctgagatttgaaatactagaattttcgtcagtcatacaaaagaacatgatcgtgttgaaattgtatggaagtcatcctgatccagcttgtgtgtgaaaattatacgaagcttctactctgtcaaaagaaagaaaaaaaataaactcctagctacgaatctagacatattgtaggtgggattggttttttttttaagggtagttgaaaatttacatgtggatggatcatgcagggggagggatccgtggggaccaccagccacaggatgggggcactcctcgagcgttggatcagccgcgagggacgaaccgacggaggagatacgtccgtgcagggggagcgatctgtggggaccaccagccacaggatgggggcactcctcgacgttggatcagccgtcgacgatccaggtatttaagcacaactatttgcgcttcgcagcacaaccacttttccgcatctctcctctctctctctctctcgggggtgtcaagagcgcagcggcgaaaggtgggaggtgagatctctctctcacttcatcctcccctcctcttctgtggtttcgtccgccgcctccatccctaaaccctacttctccgaaagcgccgtgagattcttctccctactcttcttcgatcttgctccattggtggtggtgatgtttgtttgcttggtgtttcgtgtcgcggtcctctcgttcttgtcttcgctgagtggcattgatcgagcggcaccgcgcgtcgaactcttgcttgaatctggaggcgtttcgtcgatccttttgtttttcgtttcgtgttcttggcttcttgtacccgtgatgttgacatgttgttgcctgatgcatttgaggcgtggttttcttagagttggatgaggaggttgacgagcaccgaagcttcatggtgatctcgttcgcctctcctcagaacacgttggtcttgatcttgccttccgtttctctatttctaccagtgcaagctcgagaaattaaaccacatcaattcgtttttccattggtggtggtgtttgtttgcttggtgtttcgtgtcgcggttctctcgttcttatcttcgctgagtggcattgatcgagcgacatccgaaatcttgcttgaatctggaggcgtctcgtcatccgaaacttgaacctctttaccgccctctgatcctctctattttttttcgtgttcttggcttcctgtacccgtgatgttgttgcttgatgcatttgaggcgtggttttttttggagtcggatgaggaggttgacgagcaccggaacttcatggtggtctccgttcgcctctctcccatcggaacttcatggaggttgatcttgatggttcctggcgcgaccagtgcgtgcgcgagaagttagacgccatgaattcgtttctcttctctgcttttttttttcgcttctgttttggtgtgttgcggaggtgtcactttctgaatttgtatcaaccaaattatttttgctgttcctgatgcaatacgttatacgcccgtcttccttacgactgatcaagtagcaccgcgccttgttctcttctcgtctcgaatcttaaggcgtttcggaatccgaattttctacgatttttcttggccgtgtttggtatcgcggttctctggttcgatcatgtcttcgctgtgtggcatttgatcgagcagcaaccgcgtctcgacctctctttgaatcttgaggcgtttcggcacccgaaacttggggcaaggttcacagcggtttgatcttttttttttccctcttgttcttggtttcccgtacccgtgcttttgttgctttgatggttttgaagtttgaggttgggtgtggttttcttcgagttggaggagaaggttgatgagcgccgaagcttcatggtgatctccgttcgcttctctccttggaacacgttggtcttgatcttgctgtgtgtgtctcaaagactacaccagtgcgtgcgcgaagaattcgtttgtcttctctgcttgtatttttcagtttgttctgttaattttggtgtgttgcgggagttcagtttctgagaatttattaaccagatgccgccatcggccttcttgttcttttggctgttcctgatgcaggatgctttttctctatgtgtctctctgacgtgttctcttggtttagtttctgtttggaaagaactccatgttctgttcatacaatgatttctgcatgtgtagcttggttaaactgcttgttgtttttttcccttttcgatgagaaatcttctgactctttgcatatcaaagaagctttcatctcttgaatcttagatttgggatccttctaagcccaacggttttggttctgcgagattgtacaatttcttcatgtttgttacctatattttacttctcggtgacgctgtcatgttgtattctccttgctgaattctactataagtgcacgctgctgtctctgtttttcttcttctgttcacttcatactctgtttcgaattattgaagttttaatacaccaaagaggtggccatatcgggaggaaatttattgtccttgtacaatacgccttttctgtttgtttcctcttcatttcactttggaatttggtgttatgatttgtgtcagaaaagcttatatggcgttcttacaaaaccttgtatgcattttgttcacagtaatattttattttaattcttccttgcttgattcttgtataagatataagattaatgtgtataattactgcagcattgcaactgaagattgatgatctcatgttatatgtctcaaaaatgcatttaggggccctgataaatagtgtcatatcatgttatgtctagttgactccttttcgtgtttttacgaaagctcttatgtatttaattgatctgtagtgttttgtaattgtattcactttactctttctccatatttgtcaataaagttattgtatatttgtattcatgttataaattttcagcaaaacaaaggtctgctatgggtaacagccttcctgtagaatcaaagttcactgatgaaaaagagaatgacagaattaagtatgttgtgtcgtctatgcaaggatggggtgagaaaatggaagatgctgtgagtaaacttgcagccttttgtatgacaaaaaaaaggatagttctgcaaaaatttcttactgatctgtaagtaattgtgtaaaatactgtgactgacatatgccctctatattctctagcatgcagctattctaaatcttgatgataccatgacgtcattctttggcgtttatgatggccatggaggtttgatcttcattctctctcttttttttttttttttggtttcaaatcctccaaatcgtcggcataactgtttacatcatgctttgtttgtctttgtatgtcatgtgtttatctgcgtgcatgttttgaaaactttactgtttatgctgaaacttttacctgtgaattttcaaataaatattaagctacagttctggataatgaaccaagtttgctaattagtactaatcacctatgtgcggtgtgctttctaggataacatgaactgcgtaaacagaatattaatttacgagggataaaacactgcatgggtgtgagttaatattaacagtcatgataattaaaaggatagccactgatgaacatgttggttaatttatgtgtggtgctatttttcttatgatacctatgaagtgctgatctgctgtgttcatcacattgttttgctttataagcttctatatgcacataggagtaatcttgagccaccattctgagttgtttattttctatctcaggagctgaagtagcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatttcattgttcctgtgtaatttctgcagcatggatgaggacctgcaactgtccgatgcttggagggagttagttattcctcgtaataatggatggatgtattttctcaaggctgcagcttgtacaagcatttgcaaggtatcttttaaaccctgaacgtcttttaatatccatatattgaaggtactcaaaactgtatttgttggacagtgcatattgtatctatgaaaaaggaaatggaagaatgtgtgtgatatcgagactattgttctttcttgagatgtactttggagttggaagagatatgtttaaccctaaccttgactaattgctcctattaaaaaaggttcagttagttacatatcaattgtctggtttactgcgttggaggccaacaggttcttaagttcacattgcaccttggttcttatcatactgtggtactaccctaaattgaggtattgtttgcggcatctcttctatggtaatctctttcatacactggtttggctttcagaaatgtttttctttgtctggtggctttggtgagctatttcttgcttgacttgtatttctaactatgttgggattccctattatgtcctccaattcatttcttctttttccaggcaacttatactgagccagcatatgaagggagcacagcatgtgtggttgtcatcagaggtaaccaattgattgttggacatgctggtgattctcgttgtgtactctcaagaaatggtcaggtatagtgactatttccttttcgaatttcttgttggtacctaatttgcatgttctcttattttggtgcctaacatttgtgcttgtttctgttgtgtcaaaaggccagtgcattatccgtcgatcataaaccagacagtgagtctgaaagagagagagttcagaatgcaggaggagtagctgttgggcatagttatcgtaaaataatggggaggtgggtaaccaagaaacaatggggctttactgattttaagggaagagtatcaatctcaagatcaattggtatagtcttgcctggatctgtttttcgtttattgcagataatagcaccgaaaaaaaacatattatgttgtgatttgctgatgtgttttacccacttacatttcaggggactttgcttgcaagaagaacgaacgtttacctcctgaagatcaaatgctgacatgtaatccggacatcctgactgtaagtgccactatgtttgtttagtatttggttgaatatgaagtttgtactgctgtgtggggtctgatggaaaatccccctttctgtgtcagatggacataactgatgacatggagtttcttgtgatagcaactgaaggcctctggtaaattttgaacaaaaaataactgacaataattattatttgatcattttgatgtcactagtactctttgtgatgctgttttctttctcctgctgatgcatatatagtttcatttatagttgcatacctactgtactatgttttttccatgcaggtgcaacatgacaaatcaaaatgtggttgatcacacacatgaccgtcttttggtgagtccttttcttttgctcagtttgtcttcttggcaggacaagagatctcctactgtaatagcaaaaatattttgtgtcaaattctaggaaatgacttcactcaggcaatataaagcatccgattttttaaaaaagaaaaaaacaagtgctaataagtacactgtcatctgctttgtgattgttcgattcttttgttgttaaaactgctgttccttttgccttgatcaatattgctgtgactaatatcttgcatgtttacgtcaaaaaaatatcttgcatgctcgattgtttcgttgttaaaactgttgttccttttgctgtggccaaatattgctgacttgctgtgaccaattaatatcgctatgcaggagggtgcagaagcgcgtgtcatctgtgaggagcttgttcagtttggcttgccatcgggcgacaacacgaccgtcatcctggttctgttcaagcccggcgcctaccctgctgttccgccggtcgacaccgacactgacactgacagccacaccggcgatgatgtcgacaacaacgaccccgccaacgaggttgatcccactgccaatgccgggtctgatgacagcaacaccagcgatgaggtcaaggtcgacgccactgccactgccgtcggcagcagcagtaccaccgccgtggctgccgacgaagccaccgtggtgtcgttgtcgactgcaaccatcaccattgtggacaactacttcttcattaacaccagcgaggaggttgatcccactgccaatgccgggtctgacgacagcaacaccggcgacgaggtcaaggtcgacgccactgccagttccggtctttccgattgggaacttatatattctgaattctgatcctgttagtggtagacgagtaatagcaccgacccgttgatagtagtagtttggttgtgctactttgctagactgagacaccttgaattaattgtttacgaatcatctctagcctttttagttctgaaggtgattgatctagtgatgcttttgttgatcttcattttgaatctctgtgcatggtagtggtttatgaactactagtagtatttttcccagtttccttttgaccaaagttttcttcattcttctagtctctgtgactgtgatactcaaaatcttttctcgggaatctgtaactaggattaaggcacgaaaattttctctcctttttttcaagagatatcctgaatttgcgacctctctcttccgccttccccgcgcggggggtaaaaaaaaacagaaagttagaaaaaattatgtataaaaaatttgaattcaaattcaaatttgaatcaggtatgtaaacttttgacttataaactttggatctataaagtttagatgtatagaaatactatatatagaaaatatttgaattcaaattcaaatttgaatcgggtatataaactttaggtctataaactttagatgtatagaaatactatatatgaaaaatatttgaatttaaattcaaatttaaatcagatctaattcaaatttaaatttgaatcggatatatgaactttaggtctatgaactttaggtgtataaactttagatgtatagaaatactatatataaaaatatttgaattcaaattcaaatttgaatcggatatataaacttttagcaaaaaaaactttagatatgtaaacttgaggtgtataaactttaggtgtataaatttactaaaataggaaagtaatatggtgaaaaaaaaaataaattaggtggagggagggagggagaggagggggaaatctaatcgccctgggcgatcgctcagtagcatttccgttccccgcgttcacttgcccacccgtccgcttgatcgtgcgggaaaccaacaggcaacagcgatgcaggagggagttctatgtattgggtactgttgaatttgattccaaaattgaatctcaaaattcaggtttccaattaaatatcccttcctatgaatccttgccatctacttctcccaattccaaaaatatcgaattcatattcacgctcccatcggatggcctaatcagtcaaagaaaaagccaaatgttaaattttcaaacttaattttaagatattttcaacgtagtttctttttcaccattggtttttaagtcataaaaacacgtatataaaagttttatctataaattcatttttatttcctaataagccgtaggaaaaaagccaaccgatggggacctcagtttaccttcttgactccttgttgaacccttgagttcaaatatccaatttgaattcaagtccaaatcaaaccagaccccaaatttcttcaaataatttcctggaaaatggtcaaacattttcccctctggtgggctgcctctcctttctttttagataatggaaatggattgcatctccggcttctgtcataagacacacagccataaatttaatagtaataaaaatgtaagataaaagtaaatcaaaatgagaaataaggtgatgggacaaatccccaactcccctttattattgactaatgttaaaccacataaaatattttagctagcaattcttatgaaactacgccacccatagtggaataagagacccttggctaccgattccaagagtgtagcaccattgcgcatagtatcctgctcctcttgtggtagcattgtagaccataagtggagccagtaggaagacatgaagataacctgcatagggttagataattgtttaccattaaaaactttatcattgcgacaacgccaaattgaccaacatacagcgctagctccaattagaatcatcttcttaatggacctagatacccctctaagccaattatcgaaaatgtttttggcgttacggggtggggggatattaaaaacaaaaaacacacatctccaaaaacaaactgagcaacatgacactcaaagaaaagatgttggattgtctcttgtgtatagcagaaagaacaatgtttgtctccgccccctccaattttcttttacccaggttatctttcgttagaaatactttcttgtgaagaaactacataaagaccttgatctccagtggaattttcaagtcccacagaattctctttttgatccgaacattacagttcatgatcgcgacatacatagatttgacggaaaattgaccattcttatagagcgaccatacaaagcagtccttttcatttgacagagttatattagctagcctgaggatcaaatcgttccactcgattagctagcctctcctttctatgtggaaaaagtacattgaaggtccctcgacttgtcatcgagttacaaaatcatccctcacccgtaaaatcagatatatgacatccttcaacttacaaaatcgttcattttagatcctttagtagttttgttctggttttatttgacatggcggctgagtcagcgtgggacccacgtgagccccacatttctggatgccacgtctcttcctcaccagtcaacgaggttttttcctatatgccattaagaaagatggtgcctgcttctgtgccactaaaaagtttaagcctccctctctgccatcgttaaactttatcgtgccctccacactattccgtctgtttttgttgtaacggtgggtaatggcgcagtaaaatgacttagttgccctttggtccaatatgctctctcctagcactctcctctctcccctcagatgcagcagcagcagccaaggagcggaggggagaagacggcggcactgcgacagcgacggggcgctgcgacgacgacgatgacgacgggggcagcgctgcgacggcggcggcggcggcattgctgcgacgacgacggtggcggcatcgctgcgcgacgaagacggcggcaacaacgctgcgacgacgacgacgacgaagacgggggcggcgctgcgacgacagcggcggcggcagtgctgcgcgacgacgggggcggcagcgctgcgacaacaacgacgacgaccaacacaactatggctgcgaggactattgatacttgctactggtgttcatgactgttgatgcttgctactagtaatgcttgctactagtgatgccaggaccagcacaacgacggccgacggcggcgaggactattgatgcttgctactagtgatgccagcgacctcgcctgatcagccgcgcggcacatccaggaagccatcagacccacccagctcgaccgaaaaaattcgcaagaaccacagctcacagccacaggaccaagtgtccgtcctaatttccgcgaagacgagtgcgagagattgcttactcgggccgccgaaggggatgggtccggggttgagcccggcggcgatgctcggcggcggctgaacgtggagcacgacgagcgcgccgtcagggcgaagccgaaggttgtcggccggaggtcctcgccgctcgtgttgacgccggcttgcatctgcgtcagcggcggaggcggagccgccaccgcaacgtggactggttcgttgaactccatgcggatccacggcatggtgaagctggaggagccggttggaccgaggttgaggaacagcgcaccgacgacgaggatcaggacgacgacgaccgggccgaggcgacggcggcgcggtgccccagctgggcggcggcctgaccgcctgagggagaagaggggaatcgagggagaagactgagtgaaagggcaagagcgacattttttctacccgggcccatatgtcagagctgccaaatagttaaatctaaacggaatagcaacggaacggtgtggagggcgcgataaaattcgacaatggtataaagggagggctcaaatattttagtggcacagggacatatagggccattttggtttgatgccaattcttgccctaccaattctttggtagttttgaatagtacatgttagcattttggattggagccaaattttgccaaatcaatagagtggagccaaatctgtactataaaaaatttgttagtgccaaaatgtgcctaaggtttggtactaccaatattttggtagggtttcaaaccaaacaagcccatactatctttcttaattgcacacggggaagagcctcccagtcaccacgtctcttcctctctcttctctagtcgtcctgtcgaggagcatagccgacaggggaggagggccgcgcccggtgggcgcgccggcgcccggggggggntntntnntttnnnnnnnnnnnntttttnttttnntntttntnttttttttttggtntnttnttttttnttattaaaaaaaacccccccttctttttttttttttaaaaaaataaattgtttaacttattatatagaaatttaacccaaaaaggagaaaaatttgtttagaatgaaaaaaacctttttcatatggttagcggccccattatttgacttatttgcaaatggaaaaatatttggtaacaaaacctttatatacgtgttcttagtgatctaaaacaaagaatggaaaattaactttgttaaaaaaacttaaaattaaactccaattataaattttaaaatttaaatttgggtgtcaaacatcaacctttactgaaaaaatgagggcgtcttttctcactttggaagcgcacctgagtcttttttattggtgaatc

SEQ ID NO: 14034 - DNA, 44922 bp, Oryza sativa
  unsure (1)..(44922): unsure at all n locations
agggggagaaggagggcaaaggngcgcaaaacaaaaaaagaggaaccaaagcggggcaaaaaaaaaacgggaaaaagccaaagagggccaaaaggaaggaacaaccaaaaaggcggggaggggggcaaaccaaacaggcccagnccngccngggggaaggcccccgggggagggcccgccggccgcccgggcgcncccccgcccnccgnggggcgcccggccgcgggcgcaanccggccggggggagggcccgcggccgggggggngnnnggnnnncnnnnnnnnnnnnnnnnnngggccggagcgcggcgaagagaagggttcgtgcgacggggagcggtcggaggccggcgaggaagaaggccctctcccggagcgcacgggagaatcgcgccttgactagcctcttcgcctccatcccactgctgcgcatgtcggcggcggcggcggcagcaggtcacgaaggcagcgaggatggagtcggcggacggggaggacggggagaagcgcggcggcggcgctcggtggcgaagatgggcggcagctgggggagatggagcagccatcttgtggctctgggcctctggcgtagactcaccatgtgcatcagtttggtcatcttgttcgtctttgtttgatggtgatggatcatccccttcaatcaagtatccctcctcatttgtagtctcgtttattgagtagcccctttcagctggatcagcagtgccaagatttgctaaacctgacgctaggcctgaaataggagtatcagcagattcccctgtatccatagacagaatctcatcaccagtatcaaacaggccttctctaaccaaagaagaatagatgtcatgaggattggcatctgcactttgcaagcttgcaaaaagtcctgtctgttcagagttatcttcttgtgctgatcttccactcggtgcttcacttgtccctgtcagcgtaacttggtcctagaatttcagatttattaactgaaaatttgttgaatttcagtcattagctggatcatttgctaaatttcagtcattcattgaaacttttgctgaatttcagagtcaccaacttggcacaatctctgaaacttttgctgaatttcagattctttgactgaaacttctgtatctcttttgctcttttttagattcgtttactttggcgtcattttctctggaactttgcctagtgttagagtaactaacttgatagcgccatttttttttctggaactttatctgaaatactaacttcttgttgcatttacctggaacaaccaaacaggttacatatctcagacagtgaaattggaagctctgggcattccagcatacagatcattttctttggttgagctcgaagcggcgactaatgacttctaagttgatggggagaggcggggaacgcggcggagacactgaagttgatgtggccctcccgggcgaggaacccgtgcgccgcggcgacaaggttgtcgtagctggcggcgacggtctcctgcacgcgcgcgtggggaagcggcacttgcgtgtctccgccggcgaccttcccttttcccacgttgcagctgccaccgcctctccgccagcgcgctcgcccgccaacgccgcctcgccctaccgacgccctccccttttcccgtgtctccgccaccgggtagccgccgccgccacatcaccggccggctgtcggacctcctcgcctcggcgacctcctccccaccaccggctggcctgccagagagaagagtgagtgagagagagagagagagaggaggaagggacaggccggcctgctgatgtggcttgctgacgtggcattctgacatataaggcccacactgactcagtcgccacgtcggatctagtttttactggtttataagttagggggtgtgttatatctggtttttcggttggtggatgattttgtaactggatgacaagttgagggaccttcggtgtactttttcctttctatgtcgacccagcccagcgctcggtcacggcccagcaaccgcacgcgtcgcgcatgtgccggtgcggacggggacggcgctcccgctccaccgccgcgccgctcgccgtttcccccgcgcgcgcgtcacccctctgtccgccgcgaccgttttgccgccaaaccagagcaagctcgccgcttttgccttcctcttctccgaccccggtgcccgtggcgccactccttggttcacgccgaggccgaacgaccgtcatctcgccacggcgccccttggcatcgttaagccatgtccttccctcttccactcatactaacaccgggtgctagaattcttctctccttcctgccgtagcttgtcgctcgcttgctctctctgtgccgccgccgccgccttgattgataggaacggcatcttgaatccttagccgcgctgaatcgatctctgtcagcggaaacatgcaaacttagtcactcagctgatgactaagtttagctgatgacgagggcacggctcctgacgacagcccgtagatgcatgattcatgattcaggaggaggtcaccggttcactacagttccactcaattttgatgtccaagacggagatgatgtgtgatgatgcactgcatctgcatgcgacggatgatactgatcatacacgaagctcgggtggctcgacccaggacgagcacgagcatgtccaacgggagagacgaccagtccggcagttgtcccagctgcgccgccgtcgtcgcagcggccgcctctgtgattggagattggagaatctcgagagttcgggcacgcgtgtgacctgcatggcgtgctgcgttctgtgctgcactgcttcttcggaaacgtgtttccaccggactcgcatcacatataggtcagcttccgcttgtaatagtttgtaccccacccggttggtttttgtcggttgcatagtaatgtggaggatccgtctctatgccgtgccaaaaaactgatttaccggcggtgcagattataattggtttgaattttgatgccgtacgtgtaggaattcatgtttccttttcctgatttacttacatgggcgctgcagatttaggcgtgcagatttcttcgtttctctttcctatatgccaatatatatatatactagttctcaaagcctctcggatgatttcgaacagaaatcacgagacaacacttaaatcgggctgccacaaactctcctcgtttataaagcatagcacagattgaccggccgtctcctacgaaggattaattaccgaaagatcgatcggccagccgtccgttgaaatcatggaggaggcagtcgacgcatctgccgctctggatcccaagcttgctcctctgctgctgttcggcggccacggcgacgccacgttcctctacagcgtgccgaagagagcgctgctggcgccaacgccaacgccaacgagggtgggcgacggcggcgtcgacgacatgatgagaggccaccgctggtgggccacggcgcagggctggttgctcatggcgcaccgcggctcgccgtgcactttcctatgggaccctttcaccggccgccgtgtcgggctgccccccgaccacgacggcaccgtcctcgccgccgaaggcagccatctccggaggtgcctcctctcatgctgcggtcccatggacccgaccagctgtgtcgtggtcgtcatcgacctcgccgacacggagctctggtattgccgccccggcgacaaccactgggtgaggctccatcagcatccgtaccagcacagcaacactgagcaccgtgacgtcatcatcaggtttttacgccagtttacggcgatcgacggcaagttctacagcgaactcctcatcggcgatgacgggcttgtcggcgtcctcgagttctcgccggagctgacgctcaccaagatcgccgtacacggcgtcgacgacgacaggagaccaacggtgtacaagaaacgcaccacttgcttcgtggaatcaaacggggagctgcactccgttgtcttctctcacccgatcggatgtgaccggattgtcgcgcgtgtaggcgtttacaggttgagcattaatctgacgacaacgcaggggcaaagatcagcagcgtgggtgaaggtggattcgctaggtggcagagcgttcttcgttaagataggcagttttggagcgtcacttgatacggagggaacgggcttgagagggaactgcgtctactactcggggttcaatgggaaagtgttgtgtgtatacgacatggaacgaggaactacggttgtaatcgatcccggcacaaatcttccgtatcaccagtcgcctcaagtattgatgccaacattttctggatatcatggcggaacaactcgaagtgttgaaaatatctatcaggtagggccaacaattatggaaaatgcttatgaggtaaaagacactaaggtgagtaaggtgaagagggttgttcgatttttcgaggatggttgtacctgtttgccgattcctattcagaatacgagagtgacaaagcagaaagataagttaataaatcagaagaagagtaagcggtctacggctggaagacctccttatcgaggcgaaggggcaagcagccctgaaacgaagaactcataccatggttgtggctttcccttggagccgctcaaacgtcttctaggtatgaagaagtaggagcgcactacatggaggatcgaacttgaatttttatgccaactcaatgagggctttttaattaactcattctttcagaatttgcagtaatgatagctcggctatatcatgtctattaatttcattaagttttgttctctactatgtgattgggagcactttttctttgaaactttatgaaaccttctcgcgttgcattaagagaatgatttggtaaattttctttgacaaaataagttataaaatattaaaattaattttgaatttttgctttttccaaatatttgtgaatttggtgtttatttattcaaatttagtaaaaaaaatgtgttaaaatttcaaaatattttgttcggaatggtgcctaccgaattttttttgctttccgaaaagaaaccctgcttatacctggttttagaattgggcgacgcgattgaaactctacctcgtacataagggacgtggagagaactttttcgaactgaaaagcatttcgtggctgaaaccggcccatggcctctttcagttcggctcggcagtcggcaacagcaagagagtgagagactcgttgttctcaaaaaaaaaaaatgttctgaaaaaagtgagagactcgtcagtgaccggcacgacatggacgccggcggcgaggaggcgaagcaggagcgccacctggttgctcgtgccggcccgcaagctcttcctcctctcccatcccgacgccgacgacgacctcgccggccatggtcgccctccgctccgacgtcctccacgccgtcaaatccgccgtctctctccatctatccatcggccggctccccgcctgcacgccgcggtcgagtcgctggccgccggactacgcgcgcgcggatcgacgaggaggtccgcaagctcgacgggaagtgagtgggttcttcctcccctcaattttggcatcatgttactcttattgcggtattgcccagaaaattaggtttgcccgttgctgttcttatagctgtaggctgtagcactctctatgtggggataaattttgtgacaactcaagtctttgctacgatacgttttcctcaacgaaccttaggttaggtaattaggttactttggggaacttgtcgatcacttgcatttgactggatatatgtaatttatgaattatgtttcagaatggggtcggtatgtattgtatgaggttcctcttgagagagtttgcataccaagtgcctaattctgtcttcagtatattgccagtgttcgtgtatcttgattccaggctcacagatgtgcatcaatgcatgctttggttcattgttacaagatgtaattgggcttgtagaaaagcaatatagattcctaaggatcacaattcacaacttcccaaccaatataaaagtaatttatgcaccctcctcaccaaggaaaaaaacccaatgtaaactaatgtgaaggaaaatcaagatatataacttcactagagcataaatagtataattgtggttccagtcatcaacacatccccttttagctggtcacatatatcttccgttctgctctccgcatttgttctgtatctaatgtttcagttactagcaagtttgacaagaatcattgcttcctctgaaagtaattttttttcatgtatcaaggattgctgacgctgaagagaatttgggtgggattgaagtgcgtgaggcccatctagctgaatccttgtacttcataagtgtcaggcagaaggtataaatctgtatttttctatactttaccctgtggtctggttgacatagtacatgctcgaaatttagctacttcagggacaggggacctcctgtcctgttgcaggtccttggagggaagtcttagaatcaggacacttctgaattgttcacactggtatgaaagaggaggttccatctagatcatgtcaagttaaatacttaaatcaggaaaatctcgtaaatggggtcttggaaaagctaaagatttgcagtcggagtggtcaaaaaatagatttcctttgtatgcttttggtttatgctgctgcttttatgctcccactcatgcaatgatatgataaaagatcacatggtaatatggtatcgatttgctcagtcgctactttgttgtcctaggtaaattgtatgcatgcttggcgtctgtatgaagtgcatgacaatgcatccggaagcatcagctgttgccacagctattcttgatacaataagatctgggtactccaagcctaaacagacatttcctgtgttaaggaactttattagttaggtacaattttgacattaacttttgtttcaacagagctgtttcacaacatcctgaagcatatgtcagaaggtctatgtgttgtttgcaacttcttgcaaattgatagcgctgcacctgatgtatgtctcatcagttcttatagaaagaaatcaggacattccaactggtttggaattgatatgcatatgggctcttcatgttgcagaagctgatcctgatacataatgcatatcagtaagtattctggtcactatggggggatatatctgttatggatcactagtttgtattttgttcgtcaacgtagagagcaattatggtattggctgagcgcacaatattaatagggtcatttttcaaccaacaaagaaatacaggtgttcagcgtaaacgttatacaatatctcattttcatctactttgattttagcctgaaagaagagcaattttactgcgagatgatttcactatctgaaaataaagagcaaataactcccacattatgtttggcccctttgtatcgcaggaatggaaaaacggaggaataggaaaaacgtaggattctgacaggaatgcaggtgtaaaacagaggattggaaaatacaggaaaaacacaggaataaccgtttgattggaccacaggaaaaacgcaagaatcggatgagagagatagactcaaagaaatttttccaagaggttggacctcttgctaacttttcttcaaaatctctataggattagccattccataggaattttgaaggatagtatgggattcaatcctttgtttcaaaggctttcataggaattttttccaaagggttgaaatcttttaaattttgaacacttttcctacaaatcaaaggcaaagggccttaatttcctgtaacgtacttactctatcattccttttttactcataaagagagcccatttcagtaagctccttttttactcataaagagagcccatttcagtagctggaaattcagtaacctctcacaattcaatctaactcctccattggcttgtttgtctctttgcaggccaacatgaccagtttgcagctctattccgagatcttcagaaatcacgagcactggaatcggtggatcacaattcataccaaggccaggccagcagcagcagcagcaggtctctgccttgtaagctttgataccatcatacattcgcgaacttgatgatcaatgtactggattagaaatataaattcgatcaatgtatgataatttgatcaacgaatatatagttttgtgataatttgatcagcttccctctcacacccctccctctctaatagttgggtcccactgatttttttaaaaaaatattgatttgattgtcacgtaggaacaaagccactccggcttctgcactatgtgaggttggtggcgtgggtggcggcgcggctgtcatgaagcggcagctcgcgtcggtggcgcggagagagaggcctatgcgtccagaaaaagagacagaaacgagactgtgggccccacatgtcagctgtgggatgtgcataccggacaccccagctatagttgcaaatgcaatgtgggtcatgcagggcgaaagaagaagggcgcgtgctccgtgggaaccaccagacacgggcggtgccctcctcgagcgttggatcagccgcgagagacgatccgacacccgagatgcgtccggttcaggtatttaagcgcgatgctttcttctccttgcgcttcgctgcacaaccacttttcggcatctctctcctctctctctctctctctctgtctctctcgcaacgtactcatctcaagagcagtagcggcgaaaggtgcgaggtgagttgtgagattctcctcctcctccatccctaaaccctacgtcctcccaaagcgccgtgagattcttctccctttccttcgatctcgctcttctggtggtgttctccctctcctcctggtggtgtggtttctgcgtgcttgggtgtttgggggcgtcgcggttttttctggttcgatcatgtctttcgctgttgtggcatttgatcgagcagcaaccgcgtcttgacctctctttgaatcttgaggcgtttcgtcatccgaaacttggggcaaggatcacagctgtttgatctttttttccctctcttgtaggcttcccgtaccgtgcttttgttgcttcgatggttttgaagtttgaggtggagtgtggttttctgagttggaggaggaggctgatgagcaccgaagcttcatggtgtattgatcttgctgtgtgtgtctcaaagtctctaccagtgcgtgcgcaaaaaattagaccacgtcaattcgtttctcttgtctgcttgtattttccagtttgttcagttaattttggtgtgttgcgggagttcagtttctgaaaatttattaaccagatgccgccttcggccttcttgttcttttcgctgttcctgatgcaggatgcttcttctctatgtgtctctctgacgtgttctcttggtttagtttctgtttggaaagaactccatgttctctctgacgtgttatcttggtttagtttctgtttggaaagaactccatgttctgttcatacaatgatttctgcatgtgtagcttggttaaactgcttgtttttttttccctttttgatgagaaatcttctgattctttgcatatcaaagaagctttcatctcttgaatcttagatttgggatccttctaagcccaacggttttggttctgcaagattgtacaatttcttcatgtttgttacctatattttacttctcagtgacgctgtcatgttgtattcttcttgctgaattctactataagtgcacgctgctgtctctgtttttcttcttctgttcacttcatactctgtttcgaattattgaagttttaatacaccgaagaggtggccataccgggaggaaattgattgtccttgtacaatacgccttttctgtttgtttcctcttcatttcactttggaatttggtgttatgatttgtgtcagtaaagcttatatggcgttcttacaaaaccttgtatgcattttgttcacagtaatattttattttaattattctttgcttgattcttgtataagatataagattaatgtgcaaaatactgcagcattgcaactgaagattgatactctcatgttatatgtctcaaaaatgcatttaggggccctgataaatagtgtcatatcatgttatgtctagttgactccttttcgtgtttttaccaaagctcttatgtatttaattgatctgtagtgttttgtaattgtattcactttactctttctccatatttgtcaataaagttattgtatattggtattcatgttataaattttcagcaaaacaaaggtctgctatgggtaacagccttcctgtagaatcaaagttcactgatgaaaaagagaatgacagaattaagtatgttgtgtcgtctatgcaaggatggggtgagaaaatggaagatgctgtgagtaaacttgcagccttttgtatgacaaaaaaaaggatagttctgcaaaaatttcttactgatctgtaagtaattgtgtaaaatactgtgactgacatatgccctctatattctctagcatgcagctattctaaatcttgatgataccatgacgtcattctttggtgtttatgatggccatggaggtttgatcttcattctcctttttttttggtttcaaatcctccatattgtcggcataactgtttacatcatgctttgtttgtctttgtgtgtcatgtgtttatctatgtgcatgtttcgagaactttactgtttatgctgaaacttttacctgtcaattttcaaataaatattaagctacagttctggataatgagccaagtttgctaattagtactaatcacctatgtgcggtgtgctttctaggataacatgaactgcgtaaacagaatattaatttacgagggataaaacactgcatgggtgtgagttaatattaacagtcatgataattaaaaggatagccactgatgaacatgttggttaatttatgtgtggtgctatttttcttatgatacctatgaagtgctgatctgctgtgttcatcacattgttttgctttataagcttctatatgcacataggagtaatcttgagccaccattctgagttgtttattttctatctcaggagctgaagtagcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatatcattgttcctgtgtaatttctgcagcatggatgaggacctgcaactgtccgatgcttggagggagttagttattcctcgtaataatggatggatgtattttatcaaggctggtgtctgtgctaacctttcgcctttcccgcaggtagtgatcctttaacccctaaacatcttataatatccatatgttgaagaagttactcaaaactgtatttgttggacagtgcttattgtatctatgaaaaaggaaatggaagaatgtgtgtgatatcgagactattgttctttcttgagatgtactttggagttggaagagatatgtttaaccctaacctcaactaattgcgcctgtaaaaaaaggtccagttagttacttatcagttgcctggtttggtgagttggacgcctgacaggttattaagttcttattgcaccttggttcttgtcatagtatggcactaccctaaactgaggtattgtttgcggcatctcttctatggttatctctttcatatacactggtttggctttcagaaatgcttttctttgtctggttgcttttgtgagctatttcttggttaacctgtatctctactatgttggaattctctattatgtcctttagtttctttcttctttttccaggcaacatatactgcgccatcatatgaagggagcacagcatgtgtggttgtcatcagaggtgaccaattgattgttgggcatgctggtgattctcgttgtgtactctcaagaaatggtcaggtatagtgactatttccttatcgaatttcttgttggtacctaatttgcatgctcacttattttcgtgcctaacatttgtgcttgtttctgttgtgtcaaaaggccagtgcattatccgtcgatcataaaccagacagtgagtctgaaagagagagagttcagaatgcaggaggagtagctgttgggtatagttatcgtaaaataatggggaggtgggtaaccaagaaacaatggggcttcactgattttaagggaagagtatcaatctcaagatcaattggtatagtcttgcctggatctgtttttcgtttattgcagataatagcaccgaaaaaaaaacatattatgttgtgatttgctgatgtgttgtacccacttacatttcaggggactttgcttgcaagaagaacgaacgtttacctcctgaagatcaaatgctgacatgtaatccggacatcctgactgtaagtgccactatgtttgtttagtatttggttgaatatgaagtttgtgctgctttgtggggtctgatggaaaatccccctttctgcgtcagatggacataactgatgacatggagtttcttgtgatagcaactgaaggcctctggtaaattttgaacaaaaaataactgacaataattattatttgatcattttgatgtcactagtactctttgtgatgctgttttctttctcctgctgatgcatatatagtttcatttatagttgcatacctactgtactatgttttttccatgcaggtgcaacatgacaaatcaaaatgtggttgatcacacacatgaccgtcttttggtgagtccttttcttttgctcagtttgtcttcttggcaggacaagagatctcctactgtaatagcaaaaatattttgtgtcaaattctaggaaatgacttcactcaggcaatataaagcatccgattttttaaaaaagaaaaaaacaagtgctaataagtacactgtcatctgctttgtgattgttcgattcttttgttgttaaaactgctgttccttttgccttgatcaatattgctgtgactaatatcttgcatgtttacgtcaaaaaaatatcttgcatgctcgattgtttcgttgttaaaactgttgttccttttgctgtggccaaatattgctgacttgctgtgaccaattaatatcgctatgcaggagggtgcagaagcgcgtgtcatctgtgaggagcttgttcagtttggcttgccatcgggcgacaacacgaccgtcatcctggttctgttcaagcccggcgccttccctgctgttccgccggtcgacaccgacactgacactgacagccacattgacgatgatgtcgaccccaccggcagcaacaatgccaccgcgtccgacaacaacgaccccgccaacgaggttgatcccactgccaatgccgggtctgacgacagcaacaccggcgacgaggtcaaggtcgacgccactgccactgccgtcggcagcagcagtaccactgccgtggctgctgacgagggcactggcaatcctcctcatggcgcactagttgacaccgacgacgaggacgggctgacctactcccaggacatggacttacccccggcgtcgacgtcccccccaaccttcccggacgaggacgacctcccccggtctaacccggacaagtcccccccgcacgtatcaatcttattcagagtttgagtccagatcaggaaaggccagaagctatagctatgattcggaaggagtagttcgtttccacttgatttttgtctagcaagtcgaagatgatgtgtgatgatgcatgcaggatgatacttatcgtaggtggtagtagcactgtgcattgataggagtagtttgtttctgctaccttgatgatgtgtgatgatgcatgcaggatgatacttatcataggtggtagtagcactgtgcattgataggagtagtttgtttctgctacctttggtttgtggtttttgcctgctgctttgcataggagattaagattttgcttgtcagactcagataacttcaattaactgtctacgaaatctcgctcactggtttttgagttgtgaaggtgattgatctagtgatgctttttgttgttgttcattttgaatatctgtacatactgctgggttatgacttgccccgtttctgaatacttagcttttaaccaaattttctcttcattcttctagttatcttgaatatgtaatcagtaatgtgcttggtttagcggggaagtctatttgtccctgaaggacaattccttctgctgcatgccacccaaaaactcatcaaaaagtttgaaaaaaagaaaaggacgagatagatcgaataaataatatcactccacaaatatgcaagcttaaatttgacacatataagtagaattagaactaagtaatttgattgtgaataatacgaaaaacttttttttatgtcaaagacaaaaagctagggcgaattctcattgaatctcggttgttcatgatagtgatgaccatccattcaaatcttcaggtagcacccccaaatcttcaacaaggcggaaagttcgtgtgttaaaattgttgttttttgttttgtatatgttgaatttgaacttacatgtctgttgagtaatatattactcctacatgttaatttatctttaaaatctttaatgaattttcggatgacatacatacataaataaaaccggagacaaatccacctctttggttaagttagctctgttgcctgctgagaccggctctgaatccggcccatggggaccgtatctgaatccggcccatgggctgttaggccgtagcgggccgcactcctctttcatcagttcggcaacagcaacagactcggcatcactcacccacccaacccagtacccaagccccaacctcgcctcgcctcgtctcgagccgacctaaccgcgaacccccaactccgacgagaacgacatggacgccggcggcgaggaggcgaagcaggagcgccacctggtgctggcccacaagctcttcctcctctcccaccccgacctcgacgacctcgccaaggtcgccctccgctccgacgccctcgacgccgtcaagtccgatggcatggcgccgctgttcgagtcgctggccgccgcgggcgtcctggagccggacgacgcgctgctcgccgagatgcgcgcgcggatcgacgaggaggtccgcaagctcgacgagaagtgagtggattcttcctctcttctgattttattttactagcaaatatgcccgtgcgttgcaacgggtgaaaaaacataatgataatatacatttttcatgcataaccatgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccctttttttggatcggacagatttttttttgcccggtttatttcgcccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcatggtttttttattttttttaccgcgtcacatataattcctttttctttatcggaaagttttttttcgcctttttttaccgcgtcgatggagtcagattcttttcagctttttccttttcttttatcggacaaattttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttcttttttttttttgctccacgatacatataattcatttttctttggaataggacagttttctttttatttttttaaactctttttaccgcgtcgatgtagtcggattcgtttcggtattttttccttttttttcctttttttttgtcggacatatttgtttttttttcgcccggttttttttcgccaggtttttttatcggacttttctttttttttttcgctcggtttttttctcccgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggactttttttttccctttttaagggatcgggtgtttttttgccagggaatcggacatctttttttttcctgtttttttcgctgtttttatttatttgtgacggacgatggaagcacctcttattttttaagtagtagtagatttttagccccccaaaaattaggccgccccttgctgtgttgcgtatgcgataagttttgcgataactcaggtgttgatatggtccgtttgccttagctaacctagcttactctgtgttgcgagatgtagatgctaaaactggtagatagcttgcatttgattcggtagttgtaatttatgaattatgtttagggccaattaattcacctctatgcaaatctatactacataataataaactttttccacatttttgttttagattcatgtacatattcatgattttgtacattttctctgcaatgtgtaatttagcatgtagagaagtaattgagattgctaaggatcacaatacgcaacttctcgagacaaaataccagtgtaaactaatgtgaaggaagaacggcatgttgaaatttgttagaaatagtttccttgagaagttgaggttccagtcaagatatgtccttttggtgatttgcatgtttcattgtttctactttctgatcttgctcttcgcatctgtatctaatatttcagttactagaagtttgataagaatcatttggttcctctggaagtaactaagtaattatgtttcatgtatgaagaattgctgatgctgaagagaatttgggtgagagcgaagtgcgtgaggcccatctggcgaaatccttgtacttcatgagggttggagagaaggtataaacttgtgtgcttctatactttacattaagtgtgtgcttgagatttagctatttgcattctttgaaatcaatattgcaggaaaaagcactggagcagcttaaagttactgaagggaaaactgtagctgttggccagaaaatggatcttgtgttctacactttgcaaataggccttttccacatggactttgatctcatctcaaaatccattgacaaggcaaagaagtaagttatagctttgattgtgcctttgtgaagttccattctgccatctatactggagcaatgacatctgactatttattgtgttgattgaagcctgtttgaggaaggaggcgactgggagagaaagaaccgattgaaagtatatgaaggcctatacttcatggcaacgagaaacttcaagaaagctgccagcttatttttagattccatctcaactttcacaacttacgagttgtttccatatgatacttttgtcttctatacagtcatcacaagcataatcacattggatcgtgtatctctaaaacaaaaggtaatttcacttcttacactctcttttctttttcttaattgactcactaacaagaaatatggcaggtggtagatgcaccagaaattttggcagtgattggcaaagtacctcatctatctgagtttctgaactccctttacaattgccagtacaagtcattttttgttgcattctgtaagtgtaaagtatcttgataagctgtctatagttttactgttacagtctgtacggctgggctatatgaatatatggtctaaacttcttttcagctggcatgacggagcagattaagttggatcgctatcttcagcctcatttccgctactatatgagggaagtgcggaccgttgtctattcacagtttttggagtcatacaagagtgtgacaatggaagcgatggccgcagcatttggtgtgactgttgatttcatagaccagtaagtgctgtcacccatccgcattagttttatgtttgtgattcctgtgtaggacaaaacattcttttctgttcctgtgctgtggagataatatctccctttcatttgttccagggaattgtcgcggttcattgcagctgggaagcttcactgcaagatcgataaggttgctggtgttctggagacaaaccgacctgacgctaggaatgccttctaccaagcgaccatcaagcaaggggacttcttgctgaaccgcatccagaaactgtcacgagtcattgacttgtaaattcaatggtctacgttggacgttggaggtgtgatccttctagatccctgcaaagctccccatggacataaaccgtactgaaattgctgttctacttgtactcctaggctcatgagaacatgatctttatctcggtttgattttattgcggacagcaaaaaggttttaaagagaacctccgtgtgcaatttcagtaagtgtgctttagatttgtagaacgagaagagtgcatgtctttctgagatgaatctgttcgttcatttcaagtcttgtggcgatgtctttttggggttccgcactgtttgatcttatgggtctctatatgcttgaaatagcctgacatgctagtctcaaaagagaactgcaaaatagaaccaagcgtaattccttttgttctgagcctgttttcagatgcaacatttcagaaaacagataaacagcattcggtcatacgcaatcgcgcgcacacactgtacagccactgtaactcatcagaaacgaggtcaatatacaacagtaattttcgccgttccataagtccataaaataccgatttctaatatcccaggagactctagctgcagatttagtaaggaagaacaaagcaagttactcagagtcacaggcaagctacacattgtttgttgcaaaaaaactcgaagtattgaggaactacacagagctaatctgggacagggaaatgagcacactggaaaattacagccggctgttcacttgacgatctctggtatgctgcgctttacaatcagctctccgtttctgcagatcagaaatggtaaccatgcaggcaggtcagaacgtctgtgtttgatggctatacaaaggcctagagattcacacaagcaaaatcacaggaagcagtaatgtagtttagtgtaggagcattgtctctctttacttactgatcccctgcttctggttctgcttctccttctgtttccgcttcctctcgtttcgcctcttcacccagggcttctcttcctccactggcgcttctgcctctgcgctgacagatcctgtaatctgcgcaaacgactctttggcgccagaggttacgtcgccgaagaagtccttcaccttgtcaaccacagttttgagctcttctttctttgggagctgggataatcaaaacattttactgttagtgacttgctacctttgctcaagacatgcttactgaaaacatggtcatttgtacatttactataagaaatgcctaccatcctcacttaactgcatagaagttcttttccaggacaacattttctgagctactatctagtactaggccaaaataatttgaaggttgtgctctagaaaatgtcagcctaggataaagcaagatacaagtctgaaatgtacattttcagagatttcagctctaatgttcatgagaaattgctactcctacataacttgcagagaattcgacagggagaggagataaaaggcgctagcgaaacgtacttcgatcacattacttgtcgtcagcgcagacctcaggttcccattctcctgctcacccaaatgagacaggtaaattgcaattctcaattttttcgagtgcaacaacatacaatcacgcacagaagatgaggactgagaaaattaccacaactttgtagccatatcgaaactcattgtcggtcttcagcaccctgtactgctcttttgctgtgtctattatgtcatcctcatccttcagaaatcaaatcatgaaacacgcacatttaaatcttctcttttctacaactcttcaaacacgattgtgtgacaatttgtgtaagcaaacagattgtgctgttaattactttgtagatgacagcggcaaggttcctggcgagcgtgtccttgtagatgtactttccgaggaagttgtccttcgccgcgagcatgatcttcgccgtcgtgccgccggtgacgatgttgagcgggtaccagaagtacacctgcagaaaccagaaaaaaaaacccacacaaatcttgatcacacgcacgcaaagcattgggatcaggaatggagaagaagaagaagaagaagaccaagaatcagggcagcacggacattggcggtgcggatgaagatgacaaggcgcgggttgccgtcgtcctcgatcttgggcagctgcggcatgcgctgctgctgggacggccggtccgaccaccccttccccctggcatccaccacaagcgccgcccgcctcgccggccttgccgccgcatgcagcttgctcctcggcgccgtcctcatcagcaggaagctccccccgccgctcgcctcgccgggcgacagctgccgcagccgcgcccgcgccggcgccggcgaagacgcgctcagcgacgacacgccgcccaccacctccattgaaacctcctattccggtctcgcgccgctgtgtggtgtacgtgttgtggccgccgacgaggacttgggagaagaagcagtggaggggaagaggagggaagataaagccgtggaggggagcttatctggtggtggtgagatggctgtggggtcgctgatgtgtgggcccgggtgggggttctggacccacttgtcagtgtgccagtgagtggaccgggattatgcggatagtttttgagatggtttcgtgctctcggcatacgtggcgtggttacggacagctgaaataaaggcacagtagcagtcgcgtggcttctcccggggacgccacgttgcacatggaacggcctcccagtttatatgttggaacacatcaaatttacaaaattcttgcaaaaagataagtttaacagattactcgttggattattgttactgccgattatatatttgatttatgaatgaattaatgttttaaaagtaaactttataaatggcttcgaacaagtgatctatagaaaacatatttaagagacctagagtaaataatctgtgacaataatccaataaagtagctaaaaagcccgtttaatccctaaaatttacttatatgaaaactatctgttctaaaaggaggcctaaaaggctaaaacggagtgtaaacaaagctagaaagatgtaattattatgtttaaatttaaatggtattatttgtagacaatgaaaagcatttttttccgaaataaaattttagaagtaagcaaatacacgtcatcgagaaattgaacttacgacgtttccaaacatctcatttcacatttcaattaaaaaaaacttacgtacagatgctaagctacaattacatgcaccaccttttttacgggcgaacaaggcgttcgtcggccaagagaaatttactaagatcaaattaatggttacaaagaggtttaccacaatcaacaacatcgttgatgaaacctcacacgtttgcaacggacttctgcttgtagcatcgaaatgccggcaattttttccccttccagatcaaccccttcttttttctgctacctgattctcttgactctcctagctaatcgtcgatcccctatatactatgaattaattaaaccccttacgatgatcacattaagactaagggcaccacaagtctgcaaggaagcaacaggtagtcaatggcgaatctgctcttcatctcgtcgtaacccggccacaatgacgccatctcatgcacgtcgtacatctcctccatgcagcgtgccaggtacacgacgctgtatcccgtcaccgcctccagcccgtcgtcctcccacggcagcggcggcggcagcccggcatctgccagggtggtggccgcgtaccgcgcgaggtacaccgccgacgccgccacgacggacggcgggatcctcaggctccggcggtcgagcagcgtgaggtcggcgaggtggtgcgccacggcgtgcacggcgtcgccgccggagtagccgtacctggcgaggaagtggtcggcgaaggtgtgcgcggtggggcgggccagcctgtacccgagcgcgtcgagcaggtcgagctccctgtcgagcacctcgctcctggcgatggcgagcccgccggcgccggcgccggcggcggcgtcgccggcgctcagcctctcctcggggaggtcgccctcgtacttggccgcgacgaagacggccgtggcgccgagcagcgcgagcaggcggtggctcaccgcctccaggggcctcaccgactggtagcggtcgacgtaggcgacggcgcggtggagcgtgccggcggcgaggccggcgtgcccccgggtgatcccctccatccacgccacgagcgacgcgcgcgtccacgggtcgacccggccgcgctgcaccgcggtcatgtagtccggcgacgaccgctcgccggcggccatctccatggcccggaggctggcgtacaggtcggcgtcgtacgtccacgccgcgcaggcgcatctctcgccggcgcagtagctcccgtccgtctcgtcgccagcagccgctcccccgggaccattgtcgtcgacggcggccgcgatctcccggagcatagcctcgacgtcggcgtcggcatcatccagatagagataatccatggcgcgctctgggcgcggagctaggccgcgagctcggtgatggattcttggaagatggaaagagagggagacgacgtgctcgctgcaaatttatagcgccacggatatgatgatgaacccgttgactccgacatgatcactgcgatgcgacgagctcaagagtccgaattggagttgacctggcccgcaagtccgacttgatcccgtactgggccgagggatacggcctgtgggccggcctgctccggccttgggctgcagctagctgggccggcgactccgtggagaccatctccgggcaaggaatttttttcatttttaatttttttcttttaatatttacagaaataatctatcggcgcaaaaaattacaaaaatagaccctgccgccctagtggtgggcggcaagctgacgtggcagacggcggctcgacggcgccgtctgcggccgtctgcgaaaattgcatttagccggcaaggggctaaatgcaattttcgcagcatttggctcgtacattttgcatctgggtcccttgccgccctactagacgtaccagccaaaaagtactaggcccgggctgtcttttttgcatgggggcccttgccgccctaacagagggcggcaatggttttcgtgcaaaaaaaaaccctccctcttccgtctgccgtcaccgcccgtccctccccgtttgccacgtcagcttgccgccctagtagagggcggcagggtctatttttgtaattttttgcgcccatggattatttctgtaaatattaaaagaaaaaaatttaaaaatgaaaaaaattctccgggcaagtggcagtaaaaagaaagaacctaacacgtgcatcaggaacatgcttagatctgcgagcacagtggtcagcttagccatgtggttcatgcactaatcggagtacataatacattagtacatgaatggtgattattctgtataatttactgttatatacagcgtagtactccgtactagcgagctggatattgagttcttgtttatgggttcgttgagacgtcagcgagattaggacgaagacgtttagtttatcataagaccatttaggtcatagaggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtattatagatctgacgatctagtttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgggtgatataccaactgctttgtaaaatatgatgagtgatatagcaaaatagctataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtataacatccgagtaagtaaactcataaaggatttaccaaccgcctgacaaatgaccataatatataatcagcctaagccataatattggtcaataaaaatgcacacttacgtggcaaaaagcaatgatattgtatccaatcaattgcttgataaacccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtaacaaatcttctgggtaatatagaccaagtgtagctcatatgaatagcttctgatctgaatgattatcccttatgggatactccaaaataaatataataattgaatcccgactggcgcaagtattcggttgatagcctttacggggaataataattggtccagtctttgagcatagaagatagactcatgactatgaatccatgtggaatgtatccggaacaagtcccaattggagatataatcctcacgcttgagttgatgagcccctgagcatatagcttgtcattttgtcatagtcaaaattgtctattggcaatagctgacgcagtcggcatggagatgaaatgaccaacatgaagacgaaattgctcatcagaagtaacggaagatgtcagtggtagtaaaaaacagtgacaccaatcaaaggtaatgaagttgcataaccatggaggcgaagaaacagtcggtgttgacaaaagcaaaccgacgatgaagacgtagacgcgcatcaacagtgatggcgaaatccactaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgttagtgacaataatccatcaaattaatgttatagctgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgaaaactgtagcctcttgtcgtcgaatagttattgcttgattgaagatatgtgttgaagatttccaagtagaaatcatgaatgttggagagcctcttattgtagtaaaataacatggcatcgcatgccgagatgtcgaggcatgatgacaaagacgtcgtggttggtgaagtagtaaaacttgcgaagtagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtagctgtataaaccagacgtagaggcgagggcactagtcagcagcagacgagacgaaaggcgatgaagatggtaaggccaatcaacactggcagaatcatgcagccatggaagtgaagaaaccagtcggcagccatggcaaacgtaggcagcttgtgttgaagatactgatgcctataagtagtgacagcgatgtagccagccgtgaagaagatagcatcagttggcgttataacaggccagccgtgcaagcgatgacaccagtcagcggcggatgcggcggccggtcggtgaagacgtagacgcccaacaacggcagcataataggccagccgtgcaggcggaagtaccagtcggcggcggacgaggcggccggtcggtgaagacgtagacgcccaacaacggcagcatactaggccagccgtgcaggcggaaacaccagtcggcggcggacgaggcggccggtcggtgaagacgtagacgcccaacaacggcgacataaagggcagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcgaggacatcggtcggcggcgacgaaggcaagccggtcggtgaagacgtaggcgcccaacaacggcggcataataggccagccgtgcaagcggaaacaccagtcggcggcggcgaaggcaagccggtcggtgaagacgtagacgcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactattcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcacccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtaggcatccaacaacggcagcataataggccagccgtgtaggcggaggcaccactcggcggcgacggaggcaggccggcgatgaagtcgtagacgcccaacagcggcggcataataggccagccgtgcaggcagagacaccagtcggcggcggacgaggcggccggtcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcaacggaggcaggccggcggtgaagtcgtggacgcccaacagcggcggcataatagaccagccgtgtaggcggaggcaccactcggcggcaacggaggcaggccggcggtgaagtcgtggacgcccaacagcagcggcataatagaccagccgtgtaggcggaggcaccactcggcggcaacggaggcaggccggcggtgaagtcgtggacgcccaacagcggcggcataatagaccagccgtgtaggcggaggcaccactcggcggcaacggaggcgagccggcggtgaagtcgtagacgcccatgaacggtggtgtgaccaaccgaccgtataggccaggacaccagtcggcggcgacggaggcaggccggcggtgtatatgacgatgcccatcaacggtggggtgaccaaccgaccgtataggcggggacaccagtcggcggcgacggaggcagaccggcggcgtagatgacgatgcccatcaacggtggtggccgacggtgaagtcgttgttgctatcagcaatggcggtggcgaggacaagccggcggagtggactcgcggccgatcgaccggaaagctgagacgcctcgagtccatgaccagcatcaatcgcctcaatagtgcggcgtagttatatgcgaacaacaacaaaaaatagcaagaaattaatctgagattaaaaatcaatatgataaacaatgataaaaatcagattgagtttccccctgactgatttggatcaagtcagagaagaggaggttgaagaagtggtcgacggaaaggaagtgaaaactcccaaagcgaaaacgaagtcggcgacccatgaaattgattccatcgcgcttgttgatgggaaactcgacgcaacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtattatagatctgacgatctagtttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacaagaggattaaaacgtggtgctttttagcgtattttgtgacgtcgctgatgaccattgttaaatcatcgaaacagaaaaaaaaaaagaacaaagagatggggatgatagatataccaccggccgcgccgttcgactcgtgaattgattttccagacgatgctcgatttgcggcgccatttggttgatgtcatgtcatggcctcatgggttggaaaaagtgaaaaactttgtcaccaacactaggtgtgtttaattcacacaaaaattaaaaatttggttgaaatttaaaccatgtgatgaaaaagtttaaagtttgaagaaaaaaattacaactaaacacggccacgtagagtactagagtaccagagtgaggatactcgggaaaactacaatccatagaaaaaactacaatccatcggcattccacagattgctttggtctcatctcagacttatcgcctgcatcttcaactcccttcaatccatagaaaaaaaaacaatatttagttatggatgttcaacttctaactatgtatctaagtatattttttttacgggacgggagtgtaaatctcagtatatcagcttcagcaaaaatataaaatttgaaatttatagagttcattttaggattttttatttgtcgtagttttattttctattaacttatataaagcgagtaaatgttactgatgcactatttctatcgctaaaacaagtgatacaaatattaaatgttaatgataaactatttctaccggttcattcatattttatttgaaacacagtatatattgatgaagttgccacgtagtccttgacaaaaatacattacaaattgataaagtcagtattgataaatacgagcatccatgttactccggataatatttatcgttttggacaaaggcatagtcttaaaaaaataattttgaccattatttttcattataatgtgtataaaaatattaacaaatatataattttattaaactactttttaagactaatttatacatatagtagccatatttgaaagataaatattttaaaaatgattcataataaaagatttgatctcaccctggtctaaaacgacaagtattatcaatccgaagggagtaaatatagagcttgaacctgacttggttctaccacagcgttacgcttcacggttcacattttttatatacttcctccgtttcacaatgtaagtcattctagcactctccacattgtgaaacggatggattatattagtagttcaatcaatcggattgacgctattttttttaaaaaaaataacttataagattggtgatttatactatgttggtagggtaacagtaagcgagcagggttggtgggtgtgggcgtgtggcaaagcagagaggcggctaagcgcgggtcaaagctgagaacaacgccgacgagagacgagtcgtccgcgagtataaaagcggcgggggaggagagtggaggggtggatggaaagcgggtgtgagtgaggaagatccccctataaatcgcacccggaaaagatcaccatccattgcccaattcgccgtcgtcgtcttcttcttccacctcgggaagtcaaatctcgtcgccactgctggttagtctccctcctcctcctcatccacactgcttagattcctctttggtggttgatcggttccgtagcagagttctgcgcgatcggtttttccattgctgatttcatttgccgtggaagggattgtgctacgctgcggccttaggatctcatcgcagccttcgcaggcaaattcctctgttctgtgcgccgtgtttgtgttcatgatctctgtgtttattctgcgtgtgctcctcgatttcctggcgccctgatgcgcttgctgtataggttcgttttaatcatttgaagctctcggaacagaatttgctttgcaagttgcagttctagtttatttcgggattattgggtggttgggctgttgtgtgttctagacttctagtgagtgcagtggttcagttgttgcatgtgttccagtttacccgtacaaaatgtaggggcaccgagttcaattgatttacatttgtagtcttgtagatacttttttttttctgtattagaatctcatagaagcatttgactagcataactacagtacctgtttgtgttttatgagaactttgactataagttggcaaacaatgggagtagttcgctgatgtaagttcagggtagctatattagtagtttagtactgatttcatgaaaccaactttaatcccattcattttgattttttttttctgaagcaaacattcattttgatttacactctgttgcaaattggctgttaggtactgacaggtgattcagttcaagaatccatcattcaaccaatagacctttttgttcatattagcatagattaaagttttggatagattataagttatttgtgaatacctcatattgagactaacagtacttttttttacattcttaggttttgtctccaaaggaagagaccatacagttcatcatgtcaggaggatctggtgattcttccccttcatcagggcgggctagcttcagttctttgtcaggtttgaaggacctagaactgtcttcagagtctggttgcttgtccattgtggtcctaggtgcttctggagaccttgctaagaagaaaacattcccagcgctgtttcacctctttcagcaggtaatttgattgtaactagtagcttcttacatagtttggtatactagcttcttccatagttgtcaaacttctgaaagagttgtagtgaaaaagaaataaaattgatgcattcgtgatgagttataattgctcagaaattctactgcagcactttataatgctatattgctattgcatgccatgtacataatgttttgtcaggttgacacacgtacaaagttctgaactgtaacctttggtgttgatagggatttctacaatctggagaagtccatatatttgggtatgcaagatcaaatatttcggatgatggattaagagaacgcattcgtgggtaagaaagatacatattagcaccaacatttaccataaaataatttaagaatttcatgtaaaaataaattgggatgttctgtatgaggaagtagtttctctgtttttaagtctgatgatatactagtgcctaaatagcattctcctgttatcgcagatacctcaaaggagcttcagatgaacatatttcacaatttttgcaattagtaagtcactgatatcatgaatagcttctttgcatttagatttcgtaacacgttgaattttctttgcagattaaatatgttagtggttcctacaatagcggggaaggatttgcatcattaaataacgccatttcagagaatgaaacttcgaagaacaacaaaccaggaagctcacgtagactattttatttggcattgcctccatcagtctacccctcagtatgcaaaatgataagatcatactgcatgaatccatgtgagtacttccccttttttacggattttgaaagctgctgcacttcctttggtgtagtgaagttatccacaacagagtttcaaaatataggaaatatatttggttgtatccactcttgtttgtactattttccttttgtcctctttatttaactaagtatttgccttgtggaactttgctactatttcaactttctaagcataccaattcctagcagtcgccgactcttttcctgacattgctttttcattgggacttttgaaacataaagttttggttttctggaagcaatttgggtgcaatgaatttgctcttagttattaattgagtcatgtgttggttcatagtaaattaaaaatcaaattaattatttttaagtttgatttttagaagttgtgctatactatgttgtagtttcatttcttttatgctagtcaccttctgtaactgtcatattgtgctttcagcttctcattctggctggacaagggttattgttgaaaagccctttgggaaggacttggagtctgcagaggaactcagtgcccagcttggagagctgtttaatgaacaacagctgtacagaattgaccactatttaggaaaagaattggtccaaaatctggtaagttgtatggcttcgtctagttagttgaacgatatattccatgctactataacatatttcaatatatttcagcttgtgcttcgctttgcaaaccgtttgttcctacctctttggaatcgtgataacattgctaatgtacaggtaatatgcttttctatgtagtcctttgtatttttatttgtcaactgtagttacatctatgacatcctctgttattggtataaagttgaatggattagttttggaaattctggaaagttttatcattatcatggtgcgaacaacatgtgcttgaacataataaatatatgctgcagattgtattcagagaggactttgggactgaaggacgtggagggtactttgatcaatatgggtatgttgggagtaactttattttgcatgaaagttccttttactgaaagtattttgttgtaagcacatatgcttgtgactgtggatatactataaaagtgtaaaatcactttgatatattgtaaatggtttatggttcccatagttcacatgaagtcattcgatcgtgtacagttgtccattagaaatatacaaattgcattttattattttcttctaggcattaaacttctttagtttttatgataatacagtatttgctagatttaaaataaatcaactgcattatggtgtttatgttatgagacaaataatcacctagaggacctcccgtgcatcgttattcgtcttcgctgatgtaaatatttgacctcgcttttgttgctgcagcatcattcgtgatatcattcagaaccatttgttgcaggtaaatatatttatttttggtatgcagcatagttttccatgcacttgccttttctaggggagttttatgtgcactttcacttcccaatgtgaatctacattagcatttgcttactgtggtctgtggggactgctgaacattttacttgaccattcagaatgattggtgctttattccatcaccattcttatgttataccacgaggaggcagagcagcaacctgtcatgcattataattcctcaaaagagaatattgctgtttccactttcacgacttgaggccccctttctgtattgatttcgctcttgtctgcaggtcttctgtttggtggctatggaaaagcctgtctctcttaagcctgagcacataagagatgaaaaagtcaaggtttttgcttctccttatacaattctactctaactgaaagtaggaaacctgtatggatctttttttttttttttgtcatccttcgttgcttacaatacttccttctgcgtttttataccacaatgtcaggttcttcagtcagtgacacctataaagcatgatgaggtggtccttgggcaatatgatggctacaaggatgactctacggtaccagatgactccaacacacctacttttgcatctcttgtattgagggtaaacaatgaaagatgggaaggtatatgttacaccttacaacatacagatatacagtattttgaagtcacttttaaacaaatatctgcattttccaactgaactgccttttttcgatacaagagtttcagctgttctgcatcactttgatcaaacatgggcatttggttccaagatttccattttccatatgcctacattgtcctagaaaaaatgaagctgcattgacatctatttctgaccctccagttaccattatcttatctttcagtgcagttaacatagtaataatcgtgcgctgcaggagttcctttcattctcaaggctggcaaagcactgaacaataggaaagcagagatacgtgtgcagttcaaggatgctcctggtgacatttttaaatgtatgcgctaaacaccttctcgtatccaaatgtgctgtgaaacttgtcatcaagtctgatcttgcaaaagtcacaacctattttaagaaactaagttatttgatttagaatatctgaatgctagtccaaaacaaactgaaaaatctgaatatctctgtcaagagttaatggataacggcagacaactctattggaaatataagatgttgcattatgcaagcactaaagagagtactaaacattccttcttgataatactgagaaataatgtaaaaatgtgctagtgctttggtatgaaaaagttacttcttataatgggttatgatgtgacaccttagtataagcaacacttcctttagaaaatagacaagaataagcatgagacggtttgctactttgctacattttagtatctaaaattgctataagctccctactttcaatttgacctgagtaccttactattggtttttgccgggtcaccttactaattggttgagtcactgtttctatgacttatgttgaccctgcttgtcagcctgtttgtgtttaatagatttggaagtgagctgtcattttcttattggtaataatactgtccaaaagacctggtatgaagtaaaaacttgttctgtttaactccttcagataactaattattgttttctataggcgcaagaatctggcagtaagttaaaatgtgtgcgtgtgtggtacctttacatgataacaaaacgtatttttgtctcatgagcagactagagaaatttcacataactgtgaatgtagttaaacatccgtaacctatttgaatcaatacagttctgtctgctattgttttgcttctgccaatggtgtctaaaactctgtttttatttcaccctgataaaggcaagaagcaaggaaggaatgaattcgttatacggttgcagccatcggaagccatgtatatgaaattaactgtatgtacaacttctgtaaacccatttatctgaagatatgtcagaattgtctattcatctttgcctgaagagaactccaaaaaaacaagtgttgtctgaacaaagtgcatgaactgttgcaggtcaagaaacccggactagaaatggcaaccgaacaaagcgagctggatctgtcatatgggctacgctaccaagacgtgaagatcccagaagcgtatgaacgcctcatcctggatacgtacgtcctgttccatccttcttcccccatttctttctgctacactaataacttcttcacttgcattgcgccttgttcccaacacatgccatatccaagatgaactatccgtgttggatgtagaggccgggtttttaatccattatatatatataaaggatgaaccatgatatcatcttccatttttttgacaggataagaggggatcagcagcactttgttcgccgagacgaactgaaggtttgtgctttgtgtaattgacgctgtgtgacttgcaatcggctcgcttgtgactgaatgaatacctgacgccgtgttggttttcaggctgcgtgggagatcttcactccgctgctgcacgacatcgacgacggcaaggtgaaggccctgccgtacaagccgggaacccggggacccccagaggccgacgagctgagcaagaggatgggctacgtgcagacccatggctacgtttggatacctccaaccctttcaaaattctagccgctatgtaccaatgcaggctctgtctagatgccggtttatcaggagctttgtaatattttttttaaaagaactcctactacttcgcctgtctagaacactgtaatgttggtgatcttggaataaaaagaagactatatatgctgcaagtaagcaagttacacatgttgtggttagagttggacctgttatgagtttgccacaagcaactatattataggggctactataccatggatcttgttcagacaggatgatatctataaagtatcagactctggtatcctatatgtactaggggtatcggctggtacttatcaggcaccaactgatgctcgtcggtaccagctaattaatacccattgatacttggtcggtactacagtggtactaggtaggtatcatgtgatacaagtgggtacaagggctggtaccacatagtaccacacaaatattaactatttgccacttttacaagtggcaattaaggatttgtcattggtcccatatgtcataggtatatgagagcctatatgtcatagatcgcgagtggcaaatgcttaattaccacatctttaaagtggcaaatatttaaatgcccgatcccgtcctgattatatagcaattggtgccaagaataatattctacgtactggtagcacatacaaaagacaaagataaataatgtatctataaaggcatcaaataagatacttgtacaatataaggtacataaggtagcagaaccatacatatgtatcgcttgataaatctattaacttattgaactaatagaaaaaggagcctccacgttcgctctcacaacctagaaattctcatattaattagagaaaaagaaaaacatagtctatatagaaatataatttacaaatagctgaaattcagaattaataaaatagagaatattaaagaataaactagagtccataccgatatacaatttagaactaatgaaaattcggaattaaaaaaaaataaaattaaaattaggttagtgtccatatagaaatacaatctagaaataaaaaaaatggaattaaaaaaaggaatattagaagacgagcgtagagtccatataggaatacaatttagaaataacttaaatttgataataaaaataattaataactatcacgtatatacaatacagcatgaatgttacacacattagtagtttggtaaagttagtacagaactaaaaatatgttgtcactttaatatattttaataataaattaagaatatatatatatatatatatatatatatatatatatatatatatatatatatataatttgcgcgggccaccatgctagttggaaaaaaaagaaaatttttcaagaaaaaaataaatgagaaatatcggtgtcacacaagtatcatatatttctcttaaaaaatcaaattgtttcaactcataaataagaaatttaaccaaaaaaaggagaaaaataggtaaagatgagaaagaacctatgtcatatggttagcggccccatcatttgacttatttgcaaatgaaaaatcatttgtgaacaaaacttttatatacgtgttcttagtgatctaaagcaaagactgaaaaataaacttcgatgaaaaaaccctaaaatcaactccaaattttaaattttaaattttaaatttggctgataaacatcagcattagtgaaaagatgaggccgtcgttgctcagctaggaaagcgacgtgagttacttattatgtcgtgatttacacgtagcaaaaaccattggcccaccgagcggaagaaccgtgcgtgacatgtgactcgcgtcgagaaaataggagaaggcatgccgttgggagcgctatatatgcatgggatcttattggtatctagcattcccggccgtatattatacgaaaatcctgttgggcgatcacccctccccacgtggctggcttcttttcctgacaccacattaatttcctattttaatagatttatacatctaaagtttatacacctcaagtttacacatataaagtttatacacctaaagaatagagacccaaaatttataagtcaaaagtttatatactcgattcaaatttgaatttgaattcaaatattttttatatatagtatttctatacatctaaactaatgtttttagacccaattttataagtcaaaagtttatatacccgattcaaatttgaatttgaattcaaatattaatttgaatttgaattcaaatattttttatatatagtatttctatacatctaaagtttatagacccaaagtttataagtcaaaagtttacatacccgattcaaatttgaatttgaattcaaatattaatttatagacccaaagtttataaatcaaaagtttgcatacatgtttcaaatttgaatttaaattcaaatatatttttaatatagtatttctatacatatttttttcaactttgttttttttatttttttaaaaatttatggtgtataggaagagaagaaggggatgaggaaggggagaggagcgtacaggggaatggggatcgatcactccaatcgattgatcgcctattagcgttccccatattatatcactgcttggaatggtagatcactgaaagtgaaaggaagttttttttaattattttctccctttgttgaagcagctgacttggagtagccgattttgttttccctcgtgcgaaatgtgagaggaagcttttttttttctttattatttttctccatttgttgaagcagatgacatgagggcaacaccaatgtataaaattgaagtgagcattagtgtcaggttttgggtcagaggtagtagttgtacgcaggcagcataatgtgtatgagattttaaggtggggtccaccaataaaatattctccaaccctcaaccattcataagtaaagatgctttcatcctgtactctctctgtctcgattgtgtaaacaacattatttattcccttgctatcggtagtaagcatactacccggtactacttatttactagttccacaatggctattaccaggttgtagaggagcattgaatgcctattacctggtttctcaacacattgtggatgccctaagtacaatggcgctcgggcgaggacgtcgaaattttccattattcacgtgagaattgagaggcaaaaacagaacggtagtacaagtgaaacagctagcaacagatgctttctgtgaagcttcctgcattcgagatgattttactgttgacagttctccgcgactgttactcttaactactagtacggagtagtacccttttggggggtaggtggtcaacgacgcaggacacaccgtcgtcggctagctagccgcctttcactttcattcctaggcattcatggaaagtttacccgttatttatttattctggattattaatattataattttaaaagtaaatttcacaaaactataaatacgttcgccaaattatcccaaaattggtgatgtatcaaaaaacactacgaatttaataacaaatttatcacaacattaactatacggtcaaagcgaagtatcacaaaactacatattttaggatttaaatccttagcactaataatgttatgtttcaattataaacatccaagttttgtgactaaattgactctaaacatgtagttttatgatagctttattattaaatttgtagttttacgatactccaacttaaatatgtagttatgtgataaatttggtattaaatatatagttttgtgataatttgatcaaagtatatacatatttttgtaaaatttactctaaatttaatcatacagtgaatacaatgattatttattgaattgtgtggttttgattaaaagaacgatctatcagtagagtattcacaatatgtcaaaaagtgagtagtaaggaagcttgttatctagtttacctttgtgagatactctaagtagtaaaaaggtagtagtatcatcttagtagtaacactaataacaggcgacaagcaataaataaatattaatactctcctctctctctctctcgtccattctttcttctcaatccagccatttctcttaaatgtgagatacaacttatccacacattatgataacaagaataactattacctggtttcgaagggttcaccctttatattggtgaagatatgtcaatgatgccctttatatcttgctaattattattgattttgaatttcagaagtaaatagatatataaaatactaaattgaaagtgaagataggtacaactttatatttatttaattcttaattttggaaataaaataaaagtccatgatgttctcaattgtatttttccgtctagaagaattcccaatgcaatctataatcgtgatgacatgattaacctaattaacggctttaatctgttttcagtatgggagtttccttaaagagcctaattagtacagatctctttattagaaccactgctttatcaaaacaatatttcacccatttcactctttttattagtttaattttggataagcacgaacaaataattttttattcaaactttttaaaaccataagccacacccttacatccttcgtactataaaaactaaatcctaacaatatatctggatacatattgtacccaggtacatagttaggattggacttttttaaagaacggactgagtacctaataagcaattgaacaacgaagtgaacgtagctccactggttgggttccttattgtggaatgtgtccaacggtttcaagttttaaatttaacacgagtgatcgtatttacgactaattattcttttagtggtagacgagatgaggcaccgtgatgacttcctcatctcaagatatactagtccagtatttcggatgtgctcataggaatagggtgtatatttgttcattcatagggtgtgcatttaaattgtgttttttaaaaaaaaaagaaataagccactgaacagattgtttaagtaactttctttaacctttatggattggattataaataatataatactccctccgtttcagcttgtaagacgttttgactttgatcaaagacaaattgttttaagtttgactaagtttataaacaaatatagtaatatttataatactaaattagtttcatcaaatcaatttgtaagacgttttggctttgatcaaagtcaaattgttttaagtttgactaagtttataaacaaatatagtaatatttataatactaaattagtttcatcaaatcaataaattgaatatattttcataataaattttttgtcttggttgaaaatgttactattttttttacaaacttagtcaaatttaaagtagtttaactttaaccaatgtcaaaacatcttataacatgaaacggagggagtacaactgttataaaaactaggaaggtagcccgcgcatacgcgcgggcatgttgtttaatcttgtttgaacttttattacgaatgtttatgtgtggatcatatttttgaaaaaaattttgtctctatttgaaatgtatgttcgttaataactggtttgggcgtattacttgaaaatgtatatcctcaaatttattagaaaaaatatgtcacaataatggagttagttcatatctatttgtattatgtgtgattctttcttttaaatttttggagtttcccaactttatataactttttttattgtgtatgttatagatgacttaaagtaacattttaattttactatatattaatgaaagatatttattattaaaaatatagctgatgatactacttcatctaattaaacatagacttatattaccaccgtcacataaatcgaaggagttaacttttatcccaaaataatagaagaatttatatgtactgagagaaagtgattttttttaaatactatcacgataatccaaagtacggtatcatactttgacaaatatctatagggtagtgcatgttagaacagtgtccgttttgttttcagcacctatgttcgtatcacatgagaaccttagttatgagctactgacaatcgttagccag

SEQ ID NO: 14035 - DNA, 6912 bp, Oryza sativa
gttgtatattcctcaaggtaatatttgacactttaaattatgatatgaaataaaaaatatcatagcattaattattatagaaattagtcttgtatgttaagatagacgaaataaagatcattgatggaatattttatatttataatataaatttagtttaactacgtatatttgcataaatttgtagagcaatatatttatcttcaaatagtagataatactaattcaaaaagaccatcgatctttttccaatgatacatatttttttattgtttttatagtaagtgattttgaaaatactatttcagaaaaccaccgtgagtagatttttcttggttccgaaggacagtaggtaaacctcgtttcttttcccaggtcatttgcacgtactgactgcttatatttcccgtatacatacatacatagagtaatatggtgttttcaaaataaaataaatataatctaatggtctaaaatattgggttaaaaatcgacggtgatatttgcttaaatttacagagtaatagcttttatatttaaatagtagaatactccatttttaaagataattgattttttcaatggtactatgtatgtatatttttttagctttattgttttctatagtaagtctgtgcatagtttttttttttataaacagtaggtaagattgattgttttttagtcttatgtatgtacgtacctatatggagtatatacttttggttttgttttctttttctggtgaacagtaaggtattagtttatttttaaataaaatacatctaatctaaccgaatggtccaaattattgggtccacttatttaagtgaaaaacgacgataagattatgtgatttctttctttttctagcctaacagttatatatttctcccgtttacgtagacatagtaataaggtattagtttttaaaataatatacatctaatctaatggttaaaatattagattcacccatttaagttaaaatcgacagttatatttgcttaaatttatagagtaataggttttatctttaaatagtagaaaaaaatctatcttaaaaataatagatttttaatggtagtacgtacgtagtttttttttggctttattgttttttttatagtaagtgtgtgtgtattttttttccttacgatgaacagtaggtaagattattgattgttttttagtctttacatactacgtacgtacctatatatggatatatggagtacatgtgctttgttttcttttttctggtgaacagtaaggtatttctttctttttaaatatataatacatctaatctaatctaatggtctaaattattgggtccaccgattaagtgaaaatcgacgatgtaattagacattgccacgtggcggtctaggagcgtttgtaggagtgccacgtggcggcttgagagcgtttataggaagtttaatggacttttatttagtatatatatataatagatagaagatagatagatataagtaaaccaaaacaaagaaaattcgtccctggccacctcacccggccatgacccacatacgcctcgatcgatcgaaattccgatgaagcttcttcccttccatcttgatgtcccggattcatccgcacctggtcagtaatatcgaattatcgatcatcatcccggtcgatcgatcgatagcaaccgccgatcagggtggtataaattctatacggctccgctagctagctagcttgcctcgcgctcgcttccaaaaattaattaaccacaaaattaattaagtagctagacaaccacagccgccgtggccggtgcgttctgatccaccgcgcgatggctgccgaggataacatcactggcagcggcagcggcaatggcagcagcagcaacgacgaccatgcgccgccgccgccgcagcagctcgccgttgcccgcggacggcggcgtgctgaaccgccgatgcgcctctccgcgctgtacctcatgctgttcggggcgaccgtgatcgttggcgccgcgggcgtcggggcgcccgtgacgccgctgccacggctgttcgcggcgctcgtggcctggctcgtcggctgcctctcgctgctcgtcccgctcccgccgcggtaacgacatggccggtcgcgagcgctggcgccacgccggccgggcgcgcgcgcataccaatcgcgcgttattggctatcgatgatcgatcgtttcctcgatatacgcacgatcattctatatcgtacgtaagccgcgcggtgaggtaccgtacgtttaaggagaggactatgggtcggacgtccggacgatgttgcactatacgttaaaaaatgttacaatgtttcattactcgaaaaaaaatatttcaacataaattgttctggatgtttcatctttcactaaataatgtttcaccgttttatcgaaaatgtttcaatcgaatgcaacactcaaagaacactgcctgcaacaacaaaaacacaatatgtgaaacatccaaagaaatcaaatgcaacatccacagtactgagaaacatctaaaaagacaaattgcaacatcacgaatacactatgtgcaaaaaaaaaaaaaaaaaacgtgtgtgcaacaatcatgcgcagcatcctcctcacctcttcctcctcctcgtcccacacctccgacaggtgcggcctcctcagcgttgaggaggacgaggaggcgccggtcggagcaaagccgatccggcgaccggctgcttcctcctcggcggaagccaccgcgaaggccggggcctttctggcgtcgtcctcatccgagcgctgccgccgaagcccactcacgatggagacgagctcggcgtccacgtcgtcctcggagaaggtgaacccgaagtcctgcaacttcagctccaacgacatgctccgccgccgccgccgccacctcctccccgaccgccgcaacgccgccctcctccgctccagcactgccgctgccgccgccgcctcccccggccgccgcaacgtcgccctcctccgctccggcaccgtcgccgcctcgtcgctctgcatacactcgcttcctctcgttgctaggtgagagagaaaaggggaatggtggagagaagaagacagagaaagggggaaagtgggtggggagagaagataggggagagtgctggcatcggacgcccgatttaaagcgttttcgtacgttttctcctccacggaatttcagctctcgatcgactaagtaattaacccgctatatatcaaatgccgcgtaaaggtacaagcttggcgaaaatttaaactctgtgaaaggaataggtatgttaattgtctaaaagaataggtttatgctcaaaatttaactatttaatttgctggcttgtcgggtgttttgggttaggcaacaggggggtaattcttaatttggacctggcaaagggcgccaaactaacaataatacaagatcacaattaagacggagaaaaagtgctttaagtaactttacctaaaaaaacgttttaaacccaatagagcgtgggaagaaggtggagttgcgagttcatgattctaccttaaatcttaacacccacaaaatagggctttatgtgtatctctgttctctagttagtttactagacaaaagttatacttttctctactgctgtaaagagtagagtcgtcattctcttctccaaccatattagccaccacataagaaaacaatgtttccacgaaaaaataatcaaaaattaataaaacggagagatttttttttttttagaaactgagagataaaactgaaaccaataaaaccattcacccatagttctcctaaccccgttgcaaaagcacgggtatgaaaaagagctcctagggtatgtgctatatcattctcctgcgtgatagttatgaaaagattgaactatggaatgggcaaaattttattttagtacaatggctactctccattctagtgcaaatcagagttttcatagacatgtcgtttttccccttccaaaaactgagggctttttggtgtatttctgcggtgtctgttggctcttaatttattaagtattttcgccgacatcaacgttagtctgcagctataaattaaaactctatatttaattaaaaaaaaagttggaccgtatcttctttagtttgtttcttcttcagtttgatctttaagttctatcgatgtaacgagcaagatattctatgtatgccattaacaaaaattaatggcttgttcctatatatttttcaaagatggcttgggttgacttagcaatacaaggctacatggcttatcgttattcttacagtgcgatgatcagtggcaaagccaatgcccaaccaccatgggcagttgcccagcacatgataagagggcggacaagctgcatcgttgtggtgttttgaacggctgttttgaacgatgccggtggctagccgtacagtggagtttgcagaactggatttttttttattttagttcttttaaaaaaaacttatttataaataggtatatggaaaaacttattttagaaatacacccttttctcagcgttagggtcattggcgctgacaaatgtcttgacgctaatgacattggtgccaacactcttacctcttatcccttgggaagctaagtcactaatgtgaggggtcgatgccaataacattgtgccgaggatctatttgtaaaaaaattcagaaaaattgaaatataaatgattttttataaatagatcctcaatatcaatgaattaacaccaaatacctttttgcaagaaaaatcggttgaatgccattggtgacgaccgcagtgacttagcttcgcttccgtaggaggcgagggtgtggtcggccttgacgtctgggtcactagcaccagaaaaatgtccgttcttggaataagactttttgaagggtccaaaaatatttttttaaaaaagactaaaatgtaaaaaggtgcaggtttgggcaagttgtaaaagaatttactccgtctatgccgagacgtcctcctccgttgccgccgacacttttgtttaaaccccacgggatatatttatattaaagtagagggaaacgctgtacaatagccatgaaggctaggaggttacaacgaaaagagtaaaaagaaagcggttattggggggggggtgtgaacccaaaaaggaggcgtgcggattattattacgaaaatagatgcacaacggagacgaattttacgtggaaaaccattgtggtaaaaaaccacgagcatcaaaccggcaattatcagtattgatgagttgattacaaatgtagaggaataacaatagtaacgtcacccttttttacagcttacaacaagagtgtatgtgtgtgtgtgtgtatatatatatatatatatatatatatatatatatatatatatatatatatatatatatatatatatatatctactactacttataaaaaataaaaaataaaagaaatttccatcgtccgtttgggaaaaaaaaagcgagaaaaacaaaaaagaggaaagaaacatcaatcggcaaaaaaaaaaagtccgacacctctgttagaaaaaaaaggagagaaaaaacaaaaaacgaagagaaaaaaaaatggacgtccgactcccctgtggagaaaaaaaaaagagaaaaaacttctaccgtgaaaaaaaagaaaaaaaacgtcgactccttgagaaaagctacgactaccaaaaaaaaattatcgtccgtaatcttctcttccacttatactactttactttttaaaaatatataatataaaaattgaagatgtttttgccggtactttgatacgtcattcatgtataggtcggtttttaaatttgttcgcttttagaaatacagatccgtatttgagtcagtttttaagtttgttcgcttttaaaaatatataaggaatcctataagaaatcatttttaaaaagttgcatgttaatttgagacgatcgaactcctaattgcgattgcagctcatgattttctaacaaaatatatatccaagcgaaattaaaacgatgaatttcatcttaactaaaccatatctatataactaatataaatattcgtatttttcctttcgtcacatctaatttcatgttaactaaaccatatctatataactaatataaatattcgtatttttcctttcgtcacatctaattttcgtcctgttcgtacgcaatccgtctcagttagcaatagccatggaaaaaattgcaaaaaaaaaaaaacggtggccgccaacgccaccactgccgctggagggagaagagaggcggcggagggagccaccgctgcaggatccgccaccgctgacggattcacccgcggacgaagccgacgccgtcgtcgctatcgacgccgccgttgagagggcgccatcgccgtcgaggccgacggggagagggagagggggagtgggagggacaaccgtcgccgctgtctccggcgcaccccgtcgtcgctgcgccgtgccagagagagatggtgccggtggcgggggaggcggccggcatgggagaggggaagaggcgggagatggggagagggagcggggccccctgagagaagtgaaagaaaatcgaagacagtgagggcgacggacaggagaaggagaagacaacatgaacacggacacagggcgcacagagcgtgagggtaaaattaggacccggaccgataataacattcacatgagtaggcacacatcagaggacgtaaaccgtgagcggacgaaagcgcaggcgcacgcgagcgaaagcaagagaaatacatgcgagcacactgtcagacacgtaataggactctaatgagctccgcgaggcaaacacatattacagtcgagccgacggggagcgcaaaacacgtgaggagaaacaaacct

SEQ ID NO: 14036 - DNA, 18345 bp, Oryza sativa
  unsure (1)..(18345): unsure at all n locations
ccgggcattagaactactctggnacagcagctcatcaacatcggctctagataatttagagctagtagttggctacactattagagcaagtttaatagtatagcccactactagctctaattcatctatagccgatgtaatagccaattcatacaatagttgcttactatactattaatacctggtcccacctgtcatacacacattgcgtcttggagtccgtgctgcagctagctacagatctgtagcccgctactgctcttctctctcattggttatctcattaaaatatgtttattgctggctaatagcctgctattgtacctgctcttaaacttgctcttatagccctttaggagggcggtaaggggttgcctgcaaaatgaccggtcaccctacatgtggccattagaatgtaccaacagacgtgtgctacatcataaaaaacgttctctggaagggcgatttaaaaaaaatcctccaaggaggcgttaggggtgtagatttgtaaaactttgagcaaaaaattatttttgtaaatattttaataataaaatttaaaatttaaaaaattcaagtacaataccattgctggtgacctggattgccaagcaattttctgcagctggacctatcttgggccaagattagtccgatctggaaactgaacatggctctgcaggccgctgtgccagactaggccgaggcaagatggcctttacaaatcgagcgcataatgctggtagccagaaggggggcaaagcccagctttgcaatggcagtagcaacagtggtacaatgcaacacttctatattttagatcctcctgtcaatattagaacaagttcttaaaactttgatcaccttcatattaaaatcagtttatgaaatatgataacttcatgatattatgatattatgatagtagtatctttcaagaaaaatctatgcatatcttttttaagatcaattttgctacatggcattgtgacttcacggtttttacgtttgccacaggataacttcatgaagggcagctcgagatggagatagatagatgggaaatttgacagtgggctcatgggactttctgagctttcatatgatttctttcttctattcaattaaataaactagctgggaggcccgcgcaattgcgcggctagcatctgtacaaaattatatattttttacatatgattttacttacattttgtcaaatagttatctcgttgtcttaagactttggactgaaccttatcatcccgatgtttctacttttatagtttatataaaagtcacgtcagtcgctatcacttactcctttggcacatctccattatttgcttgctcgatctaccattgtttctatttattctccttgaaaacttaaaaattataccttatactcccttcgttttttaatagatgacgccgttgactttttctcacatgtttgactattcgtcttattcaaaaaatttatgcaaatatataagatataaatcacacttaaagtactatgagtgataaaacaactcataacaaaataaattataattacgtaaatttttttaataagacgaatggtcaaacatgtgagaaaaggtcaacggcgtcatctattaaaaaacggaggtagtggtttttagagtttgttggcttgttaggtttcatttttacaatatttagatgtctcgtcaaacactgctactgtagtcctctatgctctacggttcgtccactgcctctctttattaatattaatattgagattttaaaagtcgaacataattatctagaagtcccgtcaaacgatgccactgtactcctctacagccggtctattgcctcctctctttattaacattgagattttaaaaattgaacataattatctagaagtcccgccaaaccttcagcggctttgccaatgtactcttctatggttcgcccgttgcttcccctctttgttattattgatattttaaagattatacatgattattattggggtttgtttttttactttctagaagtcctgccaaatcatcagtggcaaagccactgtactcttctacggctcgcccgctgcctcccctcaaccattgtgaacattctacttaatgacatgtctatgttcctcctcttaatcttaattgggattctatttggagttttgtttataatttttagatgtcccatcaaccatcatctcttactactctacaggcatggttgctttctcatttttattatcgttnntgtcaattgttggtattctagattgtccttttttttaaaaaaattccatatttttcattctagcattttttatttataaattgtattcctgcatgaactcttccataatttttagaagtcctgttaaacaccgccactgtacttctctatggggcagccactgcctcctctctttattatcattggggttttaaaaaacaaacataattatcgtgttggttcagcttttactttctagaagttctgccaaaccgtcaatggcttagccaatgtactcatctacggctcgcctggtgcctcccctccttattgtttttgatattttaaaaattgtacacgattatcattgggtttattttttttactttctataagtccaaccaactgctataaccatactatccgccgtccctccttttaatcttcattgggattctatttggtttgtttttaatttttagaattctcattaaccgtcaccactctacttctttataggcatgaccatgatcaaactatttagattttttttaatccgagaatttgtaagtctcgagagcaaacttagagacttttttttacattactttattaagataatagatagaatattttatttgtatataattatatcaatcaatatacaccattaaaatctagatcctttaaatacttcacttttttttaattaatatggtgatttccgtccgcttctcagctctgccccattctcggagtatgagctataacatatggaccctaaatatagagaaagctattgggaatcttgttacttagaatttatttttttctaaaaaacataccgtctctaaagattatgcgatagagcaaaacttaaatatggttgaaggagttcggatgcccagttgttttatctcccctacatatgattttgtacaggacgtgtcagttgtgcatatttattatttctaatttagctatgcagacatgacgtgtttgtctcctgtcagtaaattaagtttcctaatttgattttgatttcaaaggctgctgcgtagcacgcatcaaaatctaactccacgctctttcacgtgtccgattcataaaaacagaatcaaagagtcaagcttttacatatattgtgattaaatctcaacccttgtagtctagatatgttaggatctaacggtgtagattttttctttttccccgattaatgtgggaatttctagcatccacctgtcttctttcaaagctgttttaataatataatagatagatagatagatagatagatagatagatattctatggcaaaatttgctacaggatatcaaaaaacatgtaatgtaattagctgtagaacatcgaaaaacctgactcagctataggacacttcaaaaatgatataatttgctaaaagactctaaagccattattttattatttcttggatcaaatggagagaggaattttttagaagacggcaatgccctcagacctctctccttcctcgatcttgtctgcaggtaaaaaagagaaagaaaaagaaacaagccgtcgttgcacatggcccacacaacaacatactccctccgtcccaaaataagtgcagttttgcactattcacgttcaacgtttggccgttcgtcttatttaaaatttttttatgattagtatttttattgctattagatgataaaacatgaataatactttacgtgtaactaaatatttttaaatttttcataaacttttcaaataagacggacggtcaaacgttaggcacggatatccacggctgcacttattttgggacggaggtaatacaacggtgtttcggtgtcctccatggaggaccaccgtggcgagggcaatgatggcggcattcacatgatctctgatgatcgcctaaaacaccctattgataaattgagaacaacacagattttgccaccaatccagcttagaattcaggatggagggagggcacatcaggatggtgttgatcatgatgaggctgaagaggaggaagaggggcctaagctggagcacgacaagcatgagagacactgcatggctggttccgccgcaacttccaatctcgggtcagaaggccgagggggcaaaaggccgaagattttggtcgtctgctcaccccaagcgccctctccacctcatccagtggggggcggtggctcagcgggtggtggatggcaacgaatctgccggcgacgagaggagacgaggagatggacacgatgaagaggtggggtgaggcttgctcgctcctctggaggtttttcatggggtagctcgcgaggactatgccgtacctcatggcagtgcgtgggcgcatccctcctcgtcgttcaacatcgacgcatgatgccgtctccagtgctctgccacggacctgtcctctgcatagcgccatctacgttgtcgccgcaagtgctagatggggggagcgattcggctctaaagggcaaactcgtattttctatgttgtttctccatttgacctaaaaataataaaataatagcttcaatgtcctctagcaaattacaccttttttagagtgtcctagagctaaatcatggttttacgatatctcacagctaattacatatttttttggtgtcccgtagcaaattttgctttttctcggagagatttatacgtggttggctgttttacccacaaaaatcctcatttttttttcacaaaatatacgttctccagcgcaaaaaaaaatatcgtgtgaagagatttacacgtggttgactgttttactgagctcctctttgaaaaaaagtctatttgtccaccctcatctctttgggttatctttgacatggcttgactaagtctattcctcatcttttggaccgtaccttaggaaaaagtatactttaactcccccaactatcgcccgagtatgattcatgtcatttaaccacaaaaccaggtatatcgacttctccaagtattaaaaccggtgcaaacaatgccacttgatggttttggaggtggttttgtctggcgtgacgcctacgtgacggtcttgaccaagtctttgtcctatatggcattagaataaaaaataaaaaaaatgtggaacccatatgtcattcacacaaataaagtattgtgggacccacatgtcatcctccctttccttcccttcttcctgctccctccctctctctcccttatctctctctctctctctccccaagcctttctcttcaccttgggcggagcggcggtgtggacggtggtagggagcggcggcggcggctgccaaccgaagcacgagctcttccccgaagcacgaagcacgagatcctccccgaagcattgtttgcaccggttttgatagctggaggagtcgatatgcccggttttgtggttggaggacatgaatcatactcgtgcgatagttgaggaagtcaaagtataattttccctgtgccttatatgtccgtaataagtctattttggctcccttatcgttggaccgggccaggtcgggcagcccatcgtgacgaggcagaggcctaggcacagcccaaaggtcaggctgtgccatgcttgggctagaccagaaccccgtgctatgggtcaggccgtcgggcctcgagtcttttggctaactatagatgaggaacaaggtgagcaagcacttaaccatttcattaaaattgagatctttattatttgcatggaaatgagctgaagaattgtgatctttgtgtttgcatggatatgaattgaagaaggataatattatattcttggagttcccaaaaggacggtccaatggccgatgaaggcattctttgatgctcggtttactaagttaataaggtatagtctcctgcttaatctgagttaacaaggtgaaccgcaagtgctacaaagtttcatattatgaaaaatttccagtttccatgttcttcgctttgctaaatgaaatactccatccatccctaaatatttgacgccgttgactttttaaaacatgtttgaccgttcgtcttattcataaactttttgtgaaatatgtaaaactatatgtatacataaaagtatactccctccgtcccaaaaaaacaaatctaggattggatgtgacatattatagtacaacgaatctggacagagatatgtctagattcgtagtactaggatatgttacatccagtactatgttggtttttatgggacagagagtatttaacaatgtatcaaatgataggaaaagaattaatcattactttttttttaaaataagacgaacggtcaaacatgtttaaaaaaatcaacggcgtcaaatatttaggaacggagtattatatagagtaaaatgcactagtggtccttaaacttgtcatgaggtttcacttagatccacaaacttgcaaagtgcacatcgaggtccctaaacttggtttatcgtatcattctggtccaaagcgtcgtttgaccgtggtcttgcctatgtggcacaccacgtggatgatgacatggtgtttttttttccttttccccattttctttttcctcctcctcttttatcttcttcctccactggagccacgtcgagctcccccgtgccgaccgccgccgtcgtcacgtagcgttgctgctgtcgaaggaagaggctgaagaagagagaaatgaaagaggaagaagggagaaaaaagaaaaaataataataatgtgccatgtcgttgtctacatggcatgccacgtaggcaagatcacggtcaaatgagactttggaccgggatgatataataaaccaagtttagagacctcgatacatactttgtaagttcgtcgacctaaatgaaagctgcttacaagttcaagaaccaccggtgtgttttactctattatatattacaactttaatggagcagtttgttgccaacaaatgctaggtatgcacaaatattcattcgatctgttttcagtattgtgtcgcccctctgcaactacgtgacttctaatttcagcatgattttctttcaaaatgtaaatcatatgaatatttacttgtttcttagtttcttttttcaaaatatatcagggagatataagataattattaatatgttagattatgcactctctgttgctatgaaactacaccaccattggtcagacgtatcaaggatttctaatatctgtttcctaagcaaaggagaaaacaaaaatcattaatgttttcattcctatcaccgtatgattatttctacacttgattattttgatatctttcattcttgtatgctctttgcacctgatccatgtagagaaaaatctggtaggactaattgatatgcacctattcaaagaggttaatatggattgtggccaagccacatactcgcactgaccctgctgtaaaacggcaaaaaaaaaaaaatcttatccttgacgattggcttgaacaataattaagaatgttatacctgctttcaggtaagtggtctgttatttttgaaatgaacaagcggttaacgggacaagtgatgatcaagttctcgctccaaaaaaaaaaaaaagaagaagaagaagaagtgatgatcaagtgtggtgtgcaagattttgtcacgctgtggaaagaaaatgagaaagttgacattgttgattcactgagaggtgtgttattgtagtattcgtgcgtgtatttttgtccactcttaagaatgattcttgatccatgcatatacttttttttcttttttttttaaccttgatggaaggaacgttgaatgatttgttggtttttgcgtcatggaatgaattttgtgcattaactgattagctaagttacttgttgatcatacaaggaattaagggtgtgttcgctattcctggatcccaaccggatccctccgcacgaaaaatggagcgatctattagcgcgtgattaattaagtattagctaatttttttttcaaaaatagattaatttgatttttctaaaacaactttcctatagaaacttttttttaaaaaaatacactatttagcagtttgaaaagtgtacgtgcggaaaacgagaaagatgagttgggaaaaatggtatccgaacacaccctatgtgtgggtatcgacgtattgatgtttttaaaaaatcccatatcacgatatcaatgtatccatatcgtcgtagcagtatcgcgtatccgtgcatcaccaatggcggatacaaagggtggtccgggtggtcccgggaccaccaaaaaaagggcgatggaaccccctattaattataaaaaaaagaaaatagcgacaattgaaaagaaagaaaagaaagcgacataatccatattccctaatgccgacgcgctattccctaatgatggctccagagaccccacacacgcgtatggaatcgatctgatcgacgcgatcacgactctctctgacgcgatctctctgacgcgatcacgactctctgtctctctcctcatcgccgccctagcccgtaggccgtagcaactgccctaggccctagcctggctagcgacgccgacgagccgacgagaggagagacgacgcgtcgacgccgcgacggcgcgaccacgcgagcagcccccacgcggccacggccacgccgccgcgcgcgacgccgtgaccggcgacctgctgctgtcctgctgtctgctgtctgtttaatagtgttcgtcagttcgtgtgccgctggacgccgccgcgaggagccgtcgtcgagccgatcagccgcccgcgccaacacaaggtaacaattttagttttaggttttctaattgtccacctttttcaatttttagttttaaaatcttaaactcttgtgcattgtgagattaaattgtagtattatattgtagattgttgattgttgaatcatgaagaaagatggagttatcgtatcgctttttctttaaagtggatgaagaggatataatgaacactttcatggccattagaagacgtagacccgataagaagaaaaagtaatatggtaattttctttaagctttcatagccgtacaagcttctttaaatcaaaattttacttaattactaattttatatattttaagatgttttgttaatatatcatggtaagtttttgataatttgatctattttattacttatagttacattgtatatattagtatcgttaggtttactgtgtttagaaaaaaaattttaggtcggaccacccatatcctaaattctagatccgccactctgcatcacaggtgaacatccattgactgatcgacgtttgccaataccggtcggaaatttgaagatcatattaacatgccgtgttgttgttgacattgcccaagtgcatgcccacgaaacttcgaggaagcttcgtagatttgccattcacggcgtaacggaacaccggaaattgtcttaaaaattgtcaccatccacatgcgtatccatcgtcggctggaacaccatggtcggctggaacaccatggtgctggaacaccatggtcggctggaacaaattcaacttcccgtatcctagttgactggaattgaaggtacaatttccaacattcgcttccaaacaaggcctataaagtcccatcccctcgacctctcgccattgtccacctgccacgtacggcccaacccgccaccgaattcgattgctccagtgaccatggacgacgctggcaacagcagcaaggaggcggaggcgcaggcgccggcgccggcgaaccaggcccctgccaccgccgccgccgccgcccggggcgcgattcatcgcgggccgatgctgcgcctcgccgcgatgcagctgatgctgttcgcggcgtacgagatcgtcagctcgtacgccgcgccgccagtggcgcttccccgcctcttcgcggcgttcgtcgcctggctcgtcggctgcctctcgctgtttgtcgcgccgccctgaagggctgcacgtttcatcggaggttgaaagcatagccatcaggtattcaggattaatctatcagcatcaatcatcagcggtagtgtggtgtaacggggctcgttttttgttttttttttcttctttatgtggagtgggagtatgacgttctgcaggtttatttatgttgaccactcgttgtttattcggacttgtttgtccgtttcagcagtaggctactgttaggctgcctgtatcagatttctctgcacatgagagcaggtaaaatagcatgctattagccagctataaatatattttaatgagataaaagataagagagaagagcagcgggctacagatctgtagccagttacagcacggactccaagacgcagtgtgtatatgacaggtgggaccgtatattaatagtatagtaaacaactattgtatgaattgactattagatcggctatagatgaattggagcaggtagtgggctatactattaaacttgctctgacgcggcttaatttttttacctcaaagcgtttgatctaaatgcttttttattggtcagtgtgagtgtgacagtttatccggctacgacgcagcgtcgcaggctcgcagcgctgagcagcagcagcagagcccagtgttttggccgagaccgagcgtccccggccaaaacagtacgagcaaagctgatgctaactagtactacgagcaaagtgtgacagtttatccggctataattctgtcacgagcaaaaataaaattgctactccctacgtttcacaatataaatcattctagcattttacacattcatactgatattatatgtctagattcattaacatcaatataaatataggaaatactagaatgatttacattgtaaaacggaggaagtatacgagagcataagaaacaagaccaagcaggagggcgatctagatcaccatgccattttctgcaactggacatgctttggaccaagcttgtccgatctggaaatagacaaaggctatagatgttgttgggtcagagactcaggccgaagccagataaaccgagccccgaaagcccacataaacaggggggcaaaggcagtagtagcagcggtattaaactgtagtacgctaccgttatgtgcaatcggttttgttaaatcatattcaacccgcaaagacagaaacatgcaaatcaagcaactaatgtatatcaagaacaactggttggatgagcttgcagcatcatgcaatttattatggcacattcctcacatcagactgaaaaactgattcagtgattccacaagcagaatagttctacacaaccaaaactgaacttcaaaacatatgggacagtatcaggtatatctacactgagcttcgatatctccgcatcccgtttcccagaaaccatcatcactagttcactcagtcttcaattatcctttttttaaaaaaagttcactcaatcttgattctcgatcagcttcttgactatgcttttaagagctggtgcactagcactgcacttctgatcgacgaagcatgacctcccttcctcagccgccttgcatagctgtggatccatgggcaccttgccaaggaaaggtactcccatttcgttgcacattttctccgcaccacccttgctgctatcaaacacctcgctgcatgcaaccattgtcaaaagctcaggagctttctccttgatatagttcagcgcccattctgtagcatccatctcgcctccctcaccttgcttcacgaatctgaaatctgagagaacctgccgcaagccactcatgttctccacaacacctaagatcggcacaccaaccttcttgcagaaatttatttccttccgcacatcgattagagagacctgctggggagtggtcacgattattgcaccatcaattcctgtggcttgaaggtactgaacgattgaaatatgttcatctgatgtccctggaggagcatcaaccacaagatagtcaatctccccccaatcgacatccttcaagaactgtttgatgagtccgttcttgcgaggtcctctccatataacagcatcatctgggttgggcagcatgaaaccaattgacatgacaccaaggttggactccacatagactggtgaccaaccaaggttgctttgatgaatatcctgaccttcaaggcctaacatttttgggatgctagggccacatatatctatatcaagaaggccaacctggcagtccatttcagcaagggcaaatgagagctgggctgaaaatgtactcttccctacacctcctttcccagacagaaccagtatcttgtgttttactgtagccatccgttcaacaataccaaccaagtctacaaacacaatcaggcaatacaatcaataattatttcactgtgtggacgaaagcagcagtaattaatattgtctatgaataacaatcggtcatggctaaaattaggaatgcgagaagtacgtaggaaagaaacaccaattatattcatgaaagaatttacttgttcaactacaatttttgtaacatgaacttgtcttcctaggtgctcaatcacatgagttcctttttttaagtggcaatactgctgtgaaatattttcatggataagtggatatcactagatgtgttctccgtattgggtttccaacaaagttttttctttaacattcttgatgcactccattttttgtatgttaaacatttaagtatttccgagtgccattctatttagaaaaggaggcagctgtgtttcaactttcaggtgggacaccagatcatgcacttccatttctttccctctttaatgttacactcacaagtaaaatgtacttcctgacagtacattagatttggaaaatcagtaaggaccacatatttcttcatgggtttgggattgggtttggctccagtgtagtaataaactaatgatcatcatgctttcaatgtcagccccaagccttgctacctccatcactcacgttgcttctgtttttttaaccatctgaactatctacctaagaacctacaaggtgtttggttgtactgttatatatgcaataaggtagaacaatagatttatgaaatcacataaaaaacactgaagacatatcattgtggtatatggcatcttcatgcccaatataaaacatcagaactgacagaacaaagctggttggtaaatatcaaaggtaaaaactatccataaggcatagaacacaatcaacatgatccagctttggagctggtagattagagcattgggcctcaaacccacatcgcacacacccaacaaaaccatacaatgagatgaggagcataataaatactttcatcccgctcctatgaaaaaattttggatgttgactactaacaaccccaattttcttccttcagcttcaactgctcaacttattcataccagtgctcttgtaagatgtatcaacagcgaggaataggtatctgtgtgcctattaattttaattcatccatctcttttccccaaaattcacaaaacaagacacaacaacccgaaatctgataattttaagagaggcccaaactgaaaacactgcagctatgtggcacgaactaaattaactctaaactatgatatatgcagggaaatagcaaacaggtatcgcacaccccagaaagaacgatcacatggaaaaattttgccagaacacggtacaacaacaattggtcaagttaccaggatcagggcccttgggggcggtggcgcaaatctgctggttggggcatccggcgcaggcatccgccttccccgcctcctccgactgcgtcccagggcaatctgcagaatcaaacacttatcgttagggttgcgcatagcagacacccatccctttttccattgcaaggcgatcgaaacccacaccaaaccgaacggaaacaggggggaaaggtagcaatcgagtcttacgctcgttggcgtccgccgggacgtcgctcttgccgccatcgccgccgccgccgccgccgttctccatctccctcgccgcctccaactccgcctctcgagttctcgttactttctcgcgaggtttgctgcctggtttggggacttgaagcctagagagcgacggaaatgaggagaaaaggagtatttgtgagagagaagggagaggctggtcaaagaggatatggagcgtccgattgtgatcgaacggtccagataccggttgtcaaggacaagtttgcatctcgtattctcgttgcatatccgtcgcgcgcgctctctctctctgtggattatttttttccgtgattttttttcccgtggttgactttattcctaattaaaatataatggatgatttcatattttagaaaaaaaaaacgaggtgatccaaagatattttaactactctagaagagcaaataatggacccatcgtagtagttggcaaagtatgattcgaccataaatactctcttgtttttcaaaatccaaaataaaatacagtcacaccgtgaaactataattgggtctagaaaataccaagacttttaggatctgcttggaagattagcccagagctaattttgaaaggtaatatttagtcaggaattggtaggctaaacattagcctagggtggtatgtttggatccatgggctaatttaaggctaaaaggtggagagagagtagaaagagaggagagagaaggagagagagaggtgctttttgatggtccccacataaaattagccccattagcacctcttggaggggctaatgttttgagggaggctaattcacattagctcaaaattagctcacctgtttggatccttgagggctaatttgaggctaaaaggtgaaggataaacattagcccatgaaaccaaacagagccttatgctttaggattggttgtgttcgggctaattggggcaaagaagataaacaactttcttgatctggtcaaatccatcatttccccaagcatatttttagaattaaacttttcacggacatggacccatcaacatgacttggccacaaagtactttctttattctccacaatcaaactcacaatatatatataggccctgtttagttccttaaatttttttcccaaaaacatcacatcgaatctttggacatatacatggagcattaaatatagattaaaacaaaaactatttgtacaattaggggaaaaatcgcgagatgaatttttttagcctaattagtctatgattaactatacgtgctacagtaacctacatgtgctaatgacggattaattagtctcaaacgattcgtctcgctgtttctagccgagttatgaaattagtttttttttattcgtgcccgaaaacccctttcgacatccagtcaaacattcgatgtgatatccaaaaattttattttcgcgaactaaacaggcccataaacaggttgtgaaaccgatagacatgataattgggtcccacgaaatattaccaaaccatcaattagtatactcaaatatagaacatttttaaatattatcacatctgttctaaaatatagtaacataatactaaataggacatattaatactacgaatttgaaccgataatgtgtcacatttaattatatgtctttctctggtcatataatcatcctccccagactttaattttcactataagagctagttgatgtcgttcctggtatctaaaggggataaggcggcaccatcagctgcttaactttgacttccagtctcccaccacttcagcttgaagaagtaaacatgactgataatctggcatgtgcataagcgagtctgtatagattaatgatagataccctaacggcaactgtatggttgaaaaagacataaatattagagaattatctaatatcaaataattagaaggagcgaggttttgaatttagattgtttagcccaccatctagccggcgagcatttctccgttatggttgaaaaagaaacagaagagggaaactacgattcgatatgatgagacgcagacactaatcaaaccagactacaagataaaagtacggaatactatactggtacagcactagtgtagtaacaacgacacaaatgacacgattcgttgtacatgtactaatcgtactgagctctgcaaaagcgtgagaggctcagagccacggcgcgaacagagtgatgcacccaacgagccaaatcagcagctcggcgagcagccgaggccatggcacccggtcccccgcgcccgcggacgcgccgacggcggcgatgatcatcgtggcgccggacaccatcagcaggaacgcggcgcgagtggtggctgcgcctcccccgcggcagtcggcgtgcggtggctctggctcttcgccgaaggcgatctcctcgggatccatttgccttggctcgagatcggccgtcgatgatatgttttctactgtatttgcctttgtgccagagcgtgtgcaatatatgttccagatcgagctccgttggcagtggcaacgaccatttttatatacgcatcgagggcaatataggtgggaacacagaatgggcccccggttgaaacgataagtcaatttgtagtataaagtccatgcgagctgtgtgcatttggccgcttcttgtgttgcgttaaccttttctagtcaatttcttcactgtttctagcttactggctggtttgacgctggtacgttactttgaaataagtattctgttatacctgcaccaatgcgcggtgaaatcactgacaggtcggtccgatacagcacatcgacccacttatcagtgataactccaggtcgtgtagagctcgcagttcgtacgtgtaggaacgtaattgcgtacggaggggaggaacgtgggctggattttttacattttgatccttttgaaaaacttatttcgtaaatagacccctaaaaaaacttatcccagaaatggtcctttttggggcgccagagtggctggcgccgtcatccagcctctctggcgccgtcctcctgccaccgtggtgcacgcgaaccgacgtggcaggaggagggcgccagcataccatgctggcgccgccccagggaggagggcgccagcatggctggcgccgccgcctccattcctgtttctctgtatggagttgcaacggtgtcatttttattttatttttttggatgttttttcacactcaggatcatgatacaaccaaaaaaaaaattaaactcgaactaccacttagctaagtctgaaaatatctagcataccacttagtctactttgcaccttcactaaaattagaccataaccatagctcctttagtaaaatcctttgatcagcatgttaaacataatgcactctaccaccatatgaaattacttaatctaattcaaaatataaccacatgaaatgagatatataagttaaacagtacatatagatgcaatttttttatttttattttattttttttttgatatttttttcacacttaggagaacataggaaccaaccgtataaaaaataaactcaaacggacaaaatatgtgacatgtagaattttccaaaactctaccgaaacggacaaaatatgacatctattaaaataggcgtaactttctcatacggactcggaatcaggcaaataatatatgcacggacatctacagaaaaagttacatccgattctcccccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcctgtgagtttctaagtgtgaaaaaaatatcaaaaaaataaataaaaataaaaaagttgcacatctctctcctctgcactagttcggagagaggagaggagaggaaaaattctacatgtcacatattacgtctatttgagttcaatttttctatggttggttcttgtgtgtccctaagcgtgcaaaaaatatcaaacaaataaaacaaaaataaaaaatttcgggggggggcgccagccatgatgagctacatgcagtcgaagtcaactcaaccggcgcggg

SEQ ID NO: 14037 - DNA, 943 bp, Oryza sativa
  unsure (1)..(943): unsure at all n locations
caccattcgcggccaacggaggcagcccggcggtaaagtcgtaaacgcccaacagcgcgggcataataggccagccgtgtaggggaggcaccagtctgcggcgacggaggcaggccgccggtgaagtcgtgaacgcccatgaacggtggtgtgaccaaccgaccgtataggcggggacaccagtcggcggcgacgaaggcaggccgccggtgaagtcgtagacgcccaccagcggcggcataataggccagccgtgtaggcggaggcaccagtctgcggcgacggaggcaggccggcggtgaagtcgtgaacgcccatgaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgtagatgacgatgcccatcaacggtggtgtgaccaaccgaccgtataggcggggacaccagtcggcggcgacggaggcagaccggcggcgtagatgacgatgcccatcaacggtggtggccgacggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaccaatgataaaaatcagattgagtttccccctgactgatttggatcaagtcagagaagaggaggttgaagaagtggtcgacggaaaggaagtgaaaactcccaatgatggnctagtagatgtgtagtcagggnntcatccca

SEQ ID NO: 14038 - DNA, 20932 bp, Oryza sativa
  unsure (1)..(20932): unsure at all n locations
cagggccttggnntttcgcctacnatatggtacagtagttcatcaacatttactcagattcactggaagtgttatgttggtacttggagatgaaaatgatgcgttctaccatgaacagaattgccacaaaaccgaaacaagtaaacacacaaaaagatgcagacaagagcacatcattgttcatttctcgagtttgacaagcttctaaatagcatggaaaaattaaaaactgaaaatcacctaagctagagcaatgtgcaacacaaatcaattatccaggcacagacacccgataaggtgtgactgctggaagaagataattaggttgtatccatagtaatgcccatcattactcaaacaactgttcagaagggggaaaaagacatgcatcttgcattttctacctcaagaaaggagtttatataaaaaaaagcacgaatattacggaaggacctaatatcaaataattagaaggagtgaggcttcgaacccaggtcgtctagcccaccagtccaccaccttgtggagctaaccggaagatccctaggcgtttctcaataaaggagtttatatggacatggcaatgaaaatttacaaaggtactgagttactgactactgcaatggtgtgatcaactagaaagaacataaacatacttaccaaaaacaaaatgaagttcaattagtgtcctatctgcatcatatcagtgtcctattgtgtgcaaaatatgatatggtggaatagatgcaattcttccacaaataaacaaagatggaaagcaaccatacccacttcaaatagctggtggtgacaaggttggtggaaaaccagcgtacatgtccggagatatgatggcatatgtagtcccacaaaaccactcaagcttgaatgtcctgagattcagtgaaaacagagtttctttggcctaaagtcatgaggaaacccttgtaggagtaagtatcccccagcaacacccaagatgttatagttaaaattttcatgtagtggtataatctccttcatgcaccactgaagcgcgccctcatcatcattttccaagatgtcataccataggaaatagtataaggcattgtcattgcagagagtaaagagccccagcttcccttccagagcctccacaatgaccatccgacgtgatgagggcccaggtgggaggtcgatagagctgaactcgaagctgcgggcatcgagcacaagcaacttgttcacccaatgcatcacccagcagaagcatccgtgcgcgtagtaccgtccggacaactaggctcaccggatggaaacggattgctagtccccctggtcaaatctctccagccatcgaactccacagcatgccattgcccagaacacctagagtaggtgaaggcgaccagtttggcctcgcactgagccaagcagatcaccctgaacattgtgtcctcttcatcttcagtagcaggacaaaggaagggctcgaaattcacaatctctgattgatttactactgaggctaggtcatcggggatgggtgggagcagcaggtagcgccggtacaaggggtcgcagacagcgaattccctgaccaaggcgcggtggtcgggagccgggtcgctgcgttccgggatggcggagaggaggtacctgccgtcggagaagtggcggagacaccagcggtcgcgggaggggaggaaggagcaagagaagtcggccgcgtcggggtcggcgagggcgcgggccgcggcggccgacggatggggcggctgcgccgcgaggaatcccgcggcgaggatgccgaggacgggaggcgggtggaggcggcggaagcggcggaggaaggcgtggccggtgatgaggcggcggaaggaggcgaaggccgtggatgcgcgagcgaggtccgcggcggtggggaggcggacgaagacctcctcgaggagctcgtcggtgaggtccagctgcgccggcgggggaggttggaggcggtgcggcggctgccacgccggcgacgccatggcggtgggttttgtacttattttttattaaatatcctagcgctcaagggcccgcgtgtcattggcaaacgaatcaaatgatcatgcatccctggaacgagaggagccggccgcaaaacgaaacagttattattgcataattaattaagtattaattatttttttaaaatagattaatacatttttttaaaacaactttcatatagtatttttacaaaaatattaattgtttagcagtttgaaaagcgtgcgcgcgaaaaacgagagacgtgaattggaaaaactaggggcctgtttggtttccagggacttattccaagtccatgtcacatcggatgtttggatactaatttggagtattaaacatacactaattacaaaacacattccatatccttggactaattcattggactaattcacaagacgaatcttttgagtctaattatgtcatgattttgacaatgtgatgctacagtaaactttttataattatagattaattaggcttaaaaaattcgtctcgcggattagctctcatttatgaaattagtttttttattagtctatatttaatactccaaattagcatccaaacatccgatgtgacatgggctaaaaagttttagccccatctaaacacccctaggataagaactcaaccaattgtcattgctcttatgagatgtcctcacaaatacaaactgcagcaattctttaaaaaaaaacatgttacaagtgtagactctcgcaaccgggtgaccgcacaaggcgcaacacgagtcatccacatgcatggctacgtgggtgggacattgggacgccgccacagcggaataaaaaacgtgtgcgcggaaaacgagataagtgagttggaaaaactaggataagaactctgccaattatccttgctcttatgagatgtcttcacaaattcaaactgcagcaattcttttaaaaaaaacatgttaaaatgtagactcttgcaaccgtgtgaccacacaaggcgcaacacgagtcatccacatgcacggctacgtgggtgggacattgggacgccgccacggcgggagccagaggcctccgcttcgcccgctgccccgcggttcgcgggcgaacttggactcctgtatggctgctactacgctactacaagtaacggctccattgtttcgcttattcaaggaacaagctagacagcatatttgtaaacgaaaagtaatttgtaataaaacttttatatacgtattcttaataatctaaaagcaaaggctaaaaaataggcttcaatgaaaaaaccctataattagctttaaatttaatgttgaaaattaaaattttagctgataagtataagcataagcgacaatatgaagccgtaaactgcaacgcactggactaaatatgggcagcttggtctacttcaaactgtaggagtatgattttatactctgccgctacttaagtagcgcactgtgcacctggagcaataggttaccagctcgtccgaacacttgctccagtgcagccacagtgaaaaaccaacgaagcaccagcgcatttccaagggcaaaagcttggtaacaaagatccttgaatacatagtacttgcggcgttcaacaaaacaggaaggccaatcggtgttcgatatcatgatatgcatatcatcaaaaaaatgccgacgaaacagatagctaccctaacactagagagtactaccttgcaccagctgcatggcacaaaagagaggctcatagtcgactaaccactgaaacgaagacgtactgctgttgcctgcaatataaacgttcactttcagactatctggaaaatcattatgctggaagttgagcatacacttcagttcaaaggtgtggcaaacatgttggaacaagcattactgcataaccatgtcaacaaagtactacaaacatgaatattcaagtcatcacaactattcacctatataaattgcatgtaatgtaagagtactcggactttctacaatattatcttacgtttcttgtctgatagattcttgtgactgtggtatcttaattttgattttcaaatatcttttctcatagatcaaataattaagcatgatgcagtgttatacgttgcaaaaaaaatattaatgtcatataacacctaattcaatgctatctttgaatatctgattgtgcccaaatttgcagttccagttagttgaacctactatgcaatcataaaaatgatagctacacatgatggaaggaattaatcgttttccatccaagcagcaacagagttgatactatagatagcaaacaagttgctgtggcaattgctgacgtgtattctgtagtcatctgtagtaacgagttgtttttggtttggatagaaccccatctttacacttcacttaagcaacatgatagttgaagtcagggctcatgataagcaactttcttatttaaaaaagggctcatcattacttaaaccgtcattctcatttctaaacagaacagtgaaaaacaggcagtgtttactactagtcttctataaaaatatcagcacactgccttatgtggccatatgaaaagggaatgaacctaccaaaaatatgaacatttaactaggaaatggaagtaaaagatgcttattgagtgacccttatcgtttgaaggatttaatcaaaattgtattagttgcctgttggatgggaagaacggatgattgattcaatgtcaatgagggattattgctaaattgtttgtgattgggtgatgcacaaaatgagttagcagggatactgtgctaaggcatgtaatatcttaacattgtcacaggctacaattccatgtgtggcaaagtcagcagaaacaagaatgctgctactcaggaatgctgccgctttgtttntgatgactttgccccaaaacaaattgtagcctgcgacattgtcaagctgtgtgatgttgagtgctgggcatagtgatcccctcagtactctgcaagatacatgacttatggccatgatgctatttgcaagcaacaaccaggacaatagctataagcccacagcaaaaaatgaacagaagttgaataccataagcccacaacaacaatgaacggaagttcaataaccacagaagcttaactacaaaaatgaataatcacataactcccagatactcgaataaccagacctggaagtatttcgtagctagtaaactagtagttgaaatcaattttgcatgtgaatgtaacccctccctggggaaaatgtttcaaacccctaaggggatgttccctcattgcgaaaaagtaatgtaaatagttatgaaaagttatggaaaaattagacaacgttacacaatagatacaaaccatcccacagtgtttgagaaaaaacaaaagatctgcattgtcctgcacaattcgcagcaaaatttatctttttttttcgtttttcactgatatatagaagtttggcatgattcttttttgtgtacagtgctatataacacaataatttatgtagttactcctacatcattttcagaattttgaaaagattgcaagttttggagtggcatatatcaaaattttcctttcataactatatacttcctccgtttcatattataagactttctagcattgcccacattcatatagatgttaatgaatctagacatgaatgtgggcaatgctagaaaatcttataatatgaaacggagggagtacattacatctaaggaatatatatgtgaataaggtgacatcccctctagagattagagtcctagttccccctccctggtgaacagcctcagaacactctttgaccaggacacaaaagcttacaatgtagaaagtatgtagaaagtatggtcacgttgttcagtacttaacagttaacacagaaagaaaggatgtagctttttaacactaccaaaaatctattctggagaagagttacatatagcactaattacttagtattaactgtcaagccaggaaaggaaaaaaaaggctaaatatttgactatattaaagagggattgttgatgcagttgcattaagtcgtttcctagaacagaagatctataaagacattgtaaacctctagtattaccatcataacacaaattttcacagttcttgcaaaaagctgagcaggaaaagagcaagcttaccgcttcatatgcttggtgatgatagagatggtgggtagccgacatacaggaatggcagagaagttcgaacacccctgatcaccctccggacaaactcaagtttcttgcaacttggatttgtactgaactccagcaaataacatccgctcacacaaataggagaaacttgtaagcacaattccttgccagtcacacctagcacgcgaaatccatcccgagaaggcattaaaattgcactctcaaaactccacttgctggcaactcttccttcattttgcatggttgtagaatagagctcgagtgcataaatgtcgatgcaattacagaaagcaaacatcccaatcttgccttctcctgcctctacgatggcgcattccacaatgtcacgaccaggcgggctcgatgggagcttgacaatggagaaattcatcttacacatgtcgagcacaagcagattccctgagtcacccatcatccagtagaagcagccgtatgcgtagctgcggcgcaacagggagcggcaagcggggcgcgagaaggcagggctcagatcgccccagcagggagatgcagtggctcgccactgtccagtgactgaagagaagacaaaggccacaagcttatctgggcactgcgcaatccagatcaccttgaatgacgtctcagccaccgccgccgcggcgcgctcctcttcgccgatcggagcgaagaaggtatcgaatctgccgttgggagccacgccgcggcgcggtcgccggcggacggaggcggctaggtcttcaggaatctgggggagcagcgagtaccgccggaacagggggtcgcacacggcgaggatcctcagggcggcgccgccttccccgccgtcgcggtcgagcaggaagcggccgtcgaggacgtcacggacgacccagctgagcggggacgggaggaacgagaagccgaagtcggcggcgcggagcacggctcgggcggcgggcgcggacgggtggggcggctcggcggggtggaagccgccgggcgaggcgcagaacccgaggagcgacggcgggtggagcgcgcgcgcgcggcggagaaaggccgggtcggtggcgacgcggcggaaggaggcgcaggcggcggaggcgcggccgaggtcggcgagggacgggaggcggatcaggacctccgcgaggaggtcgtcggggagggccaactcctgggtgtcgtcgagccgacggtgcccggaccgccgcgccggcgaggccatcgcgacgctgcccaccgccggtttcggtttcttgtggccgtttgggttcttccactccagtactccccacgaggccacacgatctccacgaaaatagtcgaaactttgcgttgcgagtagagatggtaatgggacccgatattcaagtattcaacacccgataggtttttactgctgctcatattctaactcttatcataacataaaacttcttttagatcttaagctgaaattattatttgatttcttgattatgtaatgtggttgtataattttttcttactcgtatttgaacgctaatgttaataacattgttacaaaagaaaatatcgacggtttatacttctaatatggttgattacaatacaaaactataaatgctacaggtcaattatatgggtatgggtacccgatactcgcacgggtgtgggtatggtgacgattttttacccgcaacaggtgtgcgtgtgcgtatttcagtgagaatatttagccatcgtgggtgtgggtggggcaagagaaactgatggatatgcacccgttgccatctctagttatgaggaggcagtggtggcgccgtgcaccgagagcccgtgacaactatacgtggggaaatttaactatttggcatggccaattatctaaatgctttttttaatttactcttaatattttcttttaccactctaaagatatactttcttaactacttaccacttttgcccatgtaacatgccaatgtgtaacgatctgggtaaaatatgatgtgggacccacttgtcagtctctcccctctcttcatctccctccaacgtgacgtgctatcggcggccttagtcgcacacgggccatggcgaaggaaggagcagcaccgccacgaggacaccatccgccagtgcccccgaggtcccgccaccgctccgcttgtttctcttttagcgcttgctgcttgcgatacagtaacagttgtgttattgagtgggagaaggcagatgccatcacaaggagatcgtctgccgaaatccccgaggtttggcggctggaggacacccccgcatgcgaattaaatgggcgtgtgggccgcataggtcgccgccagttttacccggcagatgcggtttacttgatgcacatgcacgcgcgacagccggtggctccacacgactaaatagacaaactcgcgtgcatcaacaatgagatgcttgcctctgctactacattgcaactagtaatacgcctatgctaatgctacggcaataacatgataataatacaaatcatacaatttaaaatatataacgcacgtgttttttaaacttagataccaaagtataaagaatgacataatataaatatcagttcttgagccttatgacccaaacctaggagatcattaagcagggcagcttagctcggtctactttaaactgacataattattgttgacaagtggtgataaagtatggctagaaaccaaccatcattgcaactagttttgtactctcccatactcgtaaaggaagtcgtttagaacaatgtttaagtcaaaccttaggaatataaattatgaataactctcaagttgttaagtttgaaaatacaaaaattatatgaatatatttgtcttgaaaaatactttcataaaattatacatatatcacttttgaataaatatttttatagaaacaataagtcaaagttatgttttggagaccgtgtcgctttccaaaatgattttctttacgagcaaggagagagtacttccattagagtaggtacaatagcaggctataagctagctataaccacatatcgagaagaaaagagaagagagagaagaaagcgggctacagatttatagccagctgcagcacggactccaaaacgttatgtgcgtatgagaggtaggactgagtattaatggtgtagtatatttttatagttaactattgtatgaatgagctactccctccgtttctaaatgtttgacaccgttaactttttagcccatgtttgaccattcgttttattcaaaaatttacgaaatatataaaactatatgtatacatgaaagtatatttaacaataaatcaaatgatagaaaaaaaataattacttaatttttttaataagacgaatggtcgaacatgtttaaaaaagtcaacggcgtcaaatatttagaaacggatggagtattagattagctatagatgatttgaagtcagtagttggctatactattaaacttgctcttagatgtcagtttaaagtagatcaaggtaagctaccctgctcaatgaccaccgcctaggtttggtccatcagttgttacattgtacttccttcattctaaaagaaaatcaagctatgaaataatctggattacattcattgtaagggggtcacattccgttattttgtgttttttacggaaggagcagcagcagaggcaagcaccacacggttgatgtatggtgagtttgtctattcgtgtcgtgtactcgtgtggactgcggagccaccggaccatttcattcgtgcgcgcgcgtcctccaacccaaaacccagccattccggaaagagttgggccttttgagagcacgaccatcggcagcccacatcccacagttagagtaagggtaacagtacagctgacctattggctattgttagccttcttttagtctattcatatactctctcagtttcaaaatgtttgacaccgttgacttacatgtttgaccgttcgtcttatttaaaattttttatgaaatatataaaactatatgtgtacatgaaagtatatttaacaatgaatcaaatgatatgaaaagaataaataattacttaaattttttgaataagacgaatggtcaaacacgtactaaaaagtcaacggtgtcaaatattttgaaatgaagggagtaatagttagagcatcaccaatagtccacctatctgattcccaaaactaattttgagatattttagtctaaaaaacagctccaacagatcccttactctcctgccaaagttttggaactcccttctcccgattcctcgctcggcttatgtaggggagagttttctcgcgaatatcgctcccaatctcgcactcccgcctctctcctctcgttcccgcgcgaaggcgaaatgctcccgcctggcgattctccgcgcccgcgcccgcctgcgcctctcccggcggcgtcgcgtcgcccgtcagcgcctctcccggcagcggcgcctcgcccgccggcgcctgtacctgcagcccctcgcggcggcatcacgatcggcggcgtcgcggccggcgacgtcacggccggcggcgtcgcgcccgccggcggctcgtccggcggcagctgtttcctcctcttccctgattccgccgccaccacgtttttatctgccgccgtacgggatgaactggccggcctctcctctgtgccccccggtgatggctccctccattgtagggtttgcgcctccaagtcctacccatccgcctcgtcaacccagtgagcagatcgacgaagaagtgcaggaggtgaccatcccagacgccgatgggacggatcctgtcgaggtcgactcggccagtgttgatttgggccacggattatctgctagtgaagaggagttcaaccgtggaagctactttggtgtgcccgtgactaattttgtcagtgctcaaggtaattgatagctaataccgtatgcttgttcatgaaattgtccttgtgtgaattacattgaaatgctctatcgcctgagttcttgttgcaagtaatcactggtattgtttagtattacaaagtgtggcatccatgtattatattagaatgattggtgatgacaaactagtgcaaatttcttggaatgtacatgctgtatagaaaaattaatgcaatttttttaaatgtttgatcagaactacaaatacaaatcattttgctatgacatttttgggagttaatttgccaagaatgctgattgatgaaaatgtagcaatctgccaaatgaccttcactttgtgtctgtcaaactaatattcatactctcacaaaatttctttagttctccagcagtttggttgcagctatcactgtggctaaaataatttcatactgtcattgtggctaatataacttcatgctctcagaaaatgaaaatttcagtgtgtcatcgtttaccacacatgcatctgcatatgtttggcaatgcaattacatggtgcctattgttcatgaaattctattgtatatttctaatcgaagtacatattgagtaatgtgatgaattaattgccatgaacaggaagcatggaggatgggtattttacaaacttgatgaatgagggtggcaatactttcaattggagtgctgaaggtagccaacccgattacccgaagatccagtgcatcaaggtggggaaggggaagcatctgcgagacctaaccaaaaaaggtccaagaattttagtatgcaggaggatgtcttgttggtgtcagcatgggtcaatgttagtatggatgctattcaaggtgccgatcaatctcggagtgcgtactggaaccgtatttgtgatttttttcatgcaaacaaatactttagttcagatcgctcccaaaattcgctcatgcatcgttggtccactatacaagagtgtctcaatacgtttgctggttgtgtaagtcgtatcgagaatagacctcaaagtggtgccaatgctgaggacaaggtgaaaattaatctattttatatgttattgttagtaatcatttatttgttaactttttagcctaactttgttttgcaattcttttttcagcttttgcaggctgggctgttgtatacgaaggaagacgaaaaaaacaggacttttcagttcatgcattgctacaaatatttgaaggatcagccaaagtggattgattggtgaattcacaaggcaggtcaaaataatgcaaataagaagcagaagaccaatgtgcagtctacacctgctacgtctgcaccttcaggtcctcagaactgtgtccctcaagagaaagaggaccctattgcagttgatgctgtgcagccttcgggaagacctgcagggaggaagaaagagagaaaaacagcgtcaacgctcagatcaatccaaaattgatgctttggatcatttatgggctaagaagaaagaggccgatgctgagaaggagcgccaaagagaggagaggtacagagctgcacttgcacttgaacaacaacggattaatttggagaaagaaaagttggattttaagaggatgatagaagaagatagacttctgaggctagatacaagtgcgatgtcaatcgaggagcaagagtactataaaagtgtcaagactagtattttaagtcgtcgttcggcttcaacataaatttagcttaaattccatcaattagcaattaaatgttcgatgaggtcctcttgtagctgattgtgaactgccttgtctttaattttttcgtaatttgcgaggaactcgttaaattcagccgtacgttcatgggaaccatccgcctgttgtcccatctcatcataatgtaaatcttcctggtcatcacgctcatcctcaacaatcatgttatttaagattacacaacatctcataatttgacgtatagtcaacggatcccaaaaacgaactggcccacggacaatagcaaagcgagcttgcaacaccccaaatgcctgttcaacgtccttcctaacggattcttgtgcttttgaaaatattttctcttatttccttgtggcatctggatgctcttcaccagtgttgctcatgaaggataaatagcatctacaagataataccccatagtgtagttgtgtccgttaatggtgtaattaactttaggagcaacaatggagatcgttggagcacattaatatcattatgagttccaggtaacccaaagaacgcatgccaaatccatcgatcatgcgaggcaacagcttctaaaactgaggtaggaactccctctttccctttatattgaccatgccaggcagtcgggcagttcttccactcccagtgcatacaatctaaagaacccagcatacctggaaatcctctacgttctccaactgcaagtaacctagctatatcgttctcatttggtgtcctcatgtactcctccccaaaaacttcatcaagtacagctacgataaaccttctaaaactctcaataacggtactacctccaatacgaacatattcatcaactgcatctgcagctattccataacacaacatacgtgacactgctgttaccttttgcaaacatgatagcccaatgataccagccgcatttctcttctgaacaaaataatcatcatgcgcttcaacagcattcattatgcgtaaaaagagcgtccttttcattctaaacctgaaaaataattagcaattaaaattaatacatgcatcactaattcaaatcaagattaaaaaaaaatacaattcactattacccacctgcgtctaaattgaacatgaaggtatgtaggctcttctgagaaatagtcattgtatagtctccaatgaccagccaatctctcccgattaatcactgcatgtccaaagacagaccctcctcgctttggttcttcattgttatcatcgaaaattgtttcgaccgcctcaaaaataaattcatcgtcgtcatccgacgaagactcatcatccaatagcatcttaacgagactgcctggaggactcatctctttctttaacacgacgagggtgtgtagggagaggcggccaagcgagtagatcaagggagagatgggcagcaccagtgggggatatagaggagggggagatggcagggatggtgtagggatcggcgatgagcacggcgcgcgtggagagatcggccggcggcgtagcggcagggagcgcgcagtggagaatcggccggctattgcgtgtgggagatactgagatagtgatctctttctgtgcgcgcgtgggaggggaaaaacgaaaatttctgttggtagttcaacagaaggacccacttttagttttcggggattaaatttaggctatctgttggagggaggagtttttttacttcctattttcagtttaggaaacctaaaaacaaatttttggggggagattataggaggactgttggtgatactcttagctctttacaattaatacatgttccacttgtctctctcacagagtttcttagttctagtatccaagctggctgtaagtttacaacccgcttcccctctctctcctctcttctcttctccacgtcatcatttagccgatttatagcctactgttatactcgctcttaagaacgtgcgctgccgccgccgccgccaccgagcaacacaaacgtttcgtcgactattttcgtggagatcgctcgtgtcctccgccgcgcaaggcgcaacgcaacgcaacgcaacgtttcgactattttcgtggagaacgtggcctcgtggggataataaagcggaaggaaggagtgaaggacccaaacgtccacaccacaatccccgccgttcctcggaaacctaattaacccggccgccggtgggtagctactagctagccttagcgtcgcgatggcctcgccgccggcgcaccgtcagctcgacgccctccccgacgacctcctggcggaggtcctgatccgcctcccgtccctcgccgacctcggccgcgcctgcgcgtcctgcgcctccttccgccgcgtcgtcaccgaccgggccttcctccgccgcgcgcgcgcgctccatccgccgtcgctcctcgggttctgcggcgcctcacccggcgccggcgggttccacttccaccccgccgagccgccccacccgtccgcccccgcggcccgcggcgtgctccgcgccgccgacttcggcttctcgttcctcccttcccctgatcccctcggctgggtcgtccgtgacgtcctcggcggccgcttcctgctcgaccgcgacgtcgtggaagaaggcgccgccgccgcctcgaggatcctcgccgtgtgcgaccccttgttccggcggcacttgcttctcccccagattcctcaagacctagccgccgcctccgccctccgtcaatcgcgccgcggcgataccttcttcgctccgatcggtgaagaagagtgcgtggcggcggtggctgagacgtcattcaaggtgatctggattgcggagtgcgcagataaactcgtcgccttcgtcttctcttcagtcaccgggcaatggcgagccactgcatctgtctgctggggagatctgagccctgcattctcgcgccccgcttgccgctccatgtcgcggcgcagctacgcatacggctgcttctactggatgatgggtgactcagtgaagaatctgcttgtgctcgacatgcgtaggatggatttctcagttctcgagctcccatcgagcgcgcctggccatgacattgtggaatgcgccatcgtagaggaaggagaaggcaagattgggatgttcgctttccgtaattacatcgcaggctatgcactccagatctattctgcaaagatgcaaaatgaagggaaagctgctgccggcaaatggagttttgagactgccatggtcgtgcctttcgacgaattcggcatcctgggtgcgaccagcagggagttgttcttgaaagttcctccgagtttcgcgcgcgggtgctattcgctggagttcagcacaaacccaagttgcaagtatcttgagtctgtccgtagggtgatcagtggtgttccaccttcgctgtcattcctgtatgttggctacccgccatctctatcatcaccaagcatatgaagcggtaagcttgctcttttcctggccatatctttttgcaagaactatgaaaattaatttgtgttatgaggggattactagaggtttacaatgtcttttttgacctttcattctaaggaacgtactactgcaactgcatcaacaatccctctttaatatagtctatgtttagccctttttattcagcctattcatacgcagtttgggccgggttcccgcagcaaaccgatcaaacccagggatacccccggtttagacggtttaatttggtttcagccgtttaaggggtttgaacgcgcgcgcgagggtttcttccagcgatagttaaaatcggccatcatgcccatcaatcaacatcacactatcgagcccttatttcattatttgtgttagtatctcttaatgttggaatgctgccattctgtttctatactgactttgccacaccgaattgtagcctgtgatgttgttaagctatatacatgccttaattagcacggtatccctgctaacttattttgtgcatcacccaatcacaaatgatccatcaattatctcattggcattgagcaaatcatctattcttcccatccaacagccaactaatacaaatttccccgcaaaaaaaaaactaatacaaatttgattaaacacgataagggtcatccaataagcatatttacttccatttcctggttaaatgttcatatttgtggtagtttgttcccttttcatatgaccacataagctagtgtgctgatattttttttatatggataaccctcttgctgtgtactagtagcagatcagggttgtgttcttaagaccctgtttagatgggactaaaacttttaagtccctatcacatcggatgtttggacactaattataaatattaaacgtaaactattaataaaacccatccataatcttagactaattcgcaagacgaatctattaagtctaattaatccatgattagcctatgtgatgctacagtaaacattctctaattatggattaattaggcttaaaaaatttgtctcataaattagctttcgtttatgtaattagttttgtaagtagtctatatttaatactctaaattagtgtctaaatacatagattaaagttaagtccctggatccaaataccacctaagtctactttacgaacttcacatccttcttttttcactgcacactttttaaacaactaaacaatgcactttgttaaaaaaaatctataagaaagttattttaaaaacatattagttcatttttaaagttttttaagctaatactacctccgttttttaatagataacgctgttgactttttctcacatgtttggccattcgtctcattcaaaaaatttacgtaattataatttatttgttatgagttgctttatcactcatagtactttaagtgtgatttatatcttatacatttgcataaaatttttgaataagacgaatggtcaaacatgtgagaaaaagtcaacggcgtcatctattgaaaaacggagggagtaatttaataatgtactaatgtatgctttgttttacgtgccggagatcctcccaaacacaccctgttgtagtacacactgccagtttttcgctattctgttgagaaaagagaacgacagtttaagtaatgatgagcccttttctgaaattagaaagttgctttgtcgtgataaagttgctttcttttttttctaagttactcctataatatatgtaaattacttttaagctttattgaatttacttttatgggtctaagaagtaatttagtgaaatctaaaagtaatttagatatattataaaagtaatttttaatttttcattaaaatataatcatgtaagatcttgttataaagattcaattcttacgaacacaacggtataatcgaatcgtagatcgggtgattagtttaagagaaaattatttttgaagcctgcgtagcgtagagcatcgtatgggcttccaatttggactcctcgggatgatgccacgtccatgaatcaccaggccatgtatggacgcaccagtgcttgtgggatcagacggctgatgagcgtgtcgcgcgataaggcaaaacagagagcgcgcgcgaattagattttgcctactcgaatatatcataacacaaaacattattaaaaatacatatttaatattatgtattataaaactatagatttaatattaaagttatcatagaactacatatttaaaagagtaaatttcacaaaactacatgttctatggtttaagatgcagaaaaccacacatattttgacacttggcacttaagtacatatattttgttagtttagtttcacaaaaccatactatcgatgaatggattcacccgtgagatgatgtgattgttccatctaggatgaggacgtggcatcctattaatttcatggccgcgtcagcttcccgccctcactgacgagctcttggaggagatcttcttctgtatcggctctcccgcggacctcgcccgcgcctcctccgcctacgtctccttccgccgactcatcgccggccgccacttcctccgctgctaccgctccgtctaccacccgcctctcctcctcgggttcgtccacctcggcggcttcgagcccgcccagccgccgcacccctccgctcccatcgctcgcgctctcgccgccgctgccgacttccccaccgctccgaagccagctccccaccgctccgaagcccacgtttttaagattgttcgcttttggaaatacatatctgtgtttgagttggattttaagctcgtttgcttttggaactacaaaagaagtcgtataagaaaatctcttttaaaaaactccacatgctaacttaagatgaaagtcggactccgaattacaattcatgtatttttaaaaaaaatctaagcaaattcttatagtgaattttaacataactaaaccgtataacaataataaaattaaaatagcattcacccgttgcaatgcacggacatttttctagtaatattgaaaggatggagtagttagaagttagttcttttatggaacggagagagtagattttaagaactcatcccgattcaagccaagtagacaaacatcagaatacttaagaactcatcccgattcaagccaagtaagtagacaaacatcagaatacttaaaaaaaatggtagaggcgatatgtgaatgtcgaagatgactagcgtcatcggtgcatacagccgagtaatttcaaactgctgaaacagtacagaccttgcacaattgtttgcttaatatcttgtgcacataaatatccaagtcatacaaagtttcaataaccataacaataaccataacagatactccatctgttccaaaatggagtaacttagaaccataacacacacctagagtaggatataacctagctcggaagggcttgtccagaattgttgttccaggataggtcaaatcctatcatccaattataggttgagttattttggaacgaagggagtatgcaattattagcttaaatatcttgtacacataaatatcaaagctatacaaagtttcaataaccatagcagatatgcaataagggcccctttgaatcaaaggatttatgtaggattttcatatgattcaaatcctatagaaaatttttctatttgtccatttgattcaaaggattgaagctttccaaatcccatgaaattcctatggaatggcacattgcatgtggattttggaggaaatatagcaagagctccaacctcttgaaaaatttcctttgagtctatctctcatccgattcctgtgtttttcctgcgctccaatcaaacgaccattcctgtgttttgcaatcctctgttttacacttcaattcctatcagaatcctgtgtttttcctattcctccatttttttaaccctgtgattcaaaggggccctaaaactggaaactccacagcagctatcattctaccaaaagaatacgatattgctttgcagttcaatataacaatgagaatatgaaaatctggcataccatctcaattcattcaccaatctcacggctcacgctaagcactatagctcgaagaactgcaatgtttcactagtggagaaattgtttttagtcccggttcgtaaccctcctatagtcccggtttttataccgggactatgaatccgggactaaagatccctatctttagtcccggttcaaatacccgagactaaagatcgatctttagtcccagttggtgtgggactaaattagagattaaatagtaagtaaataaaaaaaaactattgcccactcccatctttagtcccgggtattaggtgggatgcgtaccatcccaaatacacaaatcaatcatatacactacagattatacatcccaaatcaaagaaacgtcccaaatatacaaatcatacacaaatcatgtacatcttagatccataccatgagattcaaaaaaaaattatacatctcaatccatacaatgaaccacagatttttcatctcaatctacacatggatcacaaattctttgaaaatgatgnnctacttgcagtgnaagctaatcacgcccatg

SEQ ID NO: 14039 - DNA, 2421 bp, Oryza sativa
  unsure (1)..(2421): unsure at all n locations
attaatcccggggggggggggggtttttttttttaaaggttttttccaccatccgggtcttaatgttcctgaaggggcctgtcaacaccgtaccagcatgtaanccgggagaaagatcaatctttagtcccggttggtgttaccacccgggactaaagatcacgtagttcccgttctacttataaaccgggactaaaaaccatctttagtattggtttttagtgcatccgagactattgtggtttttggtcgaccgggcaaagatggtttctccactagtgtttctttcaccgtgaacactgaatctgacacaaataacccaagaaattagatattgaataagacctttcagaccagattgcacatattcaagacttatgaaccagaaaggaacaaactactattaataggctacatgtaacacttcataaattgatcaggggaggaaaaaacatgttatgttagatagctgagatagttattagtaattcaaaataaatctataaaatgaatgaaaaacccaccttcagaactcattttagcccttaccaattgattatatcaaatctcacattctcaacttaattgaaacatgtcacgacaaacactcaccactacgtgttcattattgtggtttgcaatatatagaagttggaacacctagctatgtgtttgtcattgtggtttgcaatatataagttggaacacctagctagagtactagacaaaaaagctgaatattataattattaaataaccaccaaacacaggtcatacaaaattagtagcttcatgttgaagggcaaaataaatcagccataagtatatcgaactcctaatcaaagcaactaaaaggaagagaaatgataacttagggctacttgaattccacgataagcactaagcagttcgtagcaggatcatctccttcatttgccccattatcttaatcggtcttgtacaatataattgcgcaacaaacaagcaaatctctctaatgtcctttcctttatatattttccccataccacacaaatgtttcatactataatcgctatgataactgtttaaacaaggagcagatattgcaataataaatcaagcatcatccacgcagatatatatcataagccacgagataactatgccgaaaaataaagacataatcaggatacaacaggaaatttaccatctcatattatttctggcgacaacgaaggcgggaagttggtatatatgtcagtacgtaaactgtagtacttcagaacacacaccggctcaagctgcaaggtcttgacatccagtgaaaagcattccaaatctggctcctctggtgtatcttcttcgccttcccctcgcgacctggctaacagcaagtgcttctccatcgcacctctaatgtaataccggtagccatgatccagtgggattatcttctccatctgctcgcgacgagtcgccccttcttttccccaaatgctgtagtggagatcaaacgtgccaccaacgctcccccggagagcaaagatcccagtcatgccttcccctgcctcaacaatggcggtcggtcccccaaggcagactggtgggggttcagcaatggagaatttcatcagtcgtgtgtcgagcaccagcaacatggtcctcaaaatcccccagcagaagcagccgcacgcgtatcggcggctggagaacactcgacccggtgacgaaaacactaggctcggtgacgacgacgacggcggcggcgacagaccggcgccattgaacagatcggtggtgctcggggaggcaccggctagccattgaccggtgctcgaattgaagacgaaggcgataatcttggccttgcactgcgccatccagatcaccttgaatgaggtatcgtcctcctcctcttcgatgtggggagcgaggaagggctcgcaccagcggtccaggtggacgcggacagggcggtccaccgaagcggcgaggtcgtcggggatcgggggaaggaggaggaatcgccggcgcagggggtcgcacacggcgatctccgtgaagaccaacggcttctcgctgcctccggtctcggccttggtatctcggtcgacgaggacgcggccgccgcggacgtcgcggaccatccagctgccggctggggaggggaggaaggagagggcgaantccgcggcgtcggccaccgccctggcgacgggagcggatgggtggggagggagcgccgggtggaagcccctgtggtcgaggaagccgaccaagggcggtgcgtggagggaagcgaagcggcggaagaaggagccgtcggtggtgaccagaccgcggaaggagactcatgccgcggaggcgcggacgaggttccttcgggtgggtaggcggaggaagatctccccgatgaggtcgttggggagcgcccccccc

SEQ ID NO: 14040 - DNA, 14911 bp, Oryza sativa
  unsure (1)..(14911): unsure at all n locations
cgatggctgatnngtgaatgtgcacgntgcncannanccatnggngcagccgccagccgggggaaggaggtttaggacggggattactaattcgcgcgtacgcgccggttcagttactcgcgcgcacttccacgtgttcagctgcagaacgaaccctgtcgcgatcccatcgttaatcacggagattagcgttaatcacggtaattagatttaatcacacgctacagtaatttcacaatacaacaataaaaattcgagtcgaaagttttcaaaatctaatttgaaagttttcaaaattgatttgaaagttttcaaaatctaatttaaaattttttaaatattgacttgaaagttttcaaatttaagttgaaagtatttaaattttgagatgaaaactttgaattttgagttaaaagtttttaaaatttgagttgaaagttttgaatttcaatatgaaagtttttgattttgagatgaaaattttgaattttatgttggaagttttccaattttgagtggagagtttcaaattttgagaagaaagcatttaaattttaagttgaaaattttcaactttcaagttaaaagttttaaattttggatatgactttttttagaaggttttaaattttatttgaaaatttaaatattatgtataagtttttgaaatttgtagtaataaaaagaaaacaacctttatgcgaaaagaaaaaaagaatggtcaccataattcagatcgtgattagtcaaaacctgattacgctaatccaatcttatctgcgcatgtgaacgtgtgcgtgtccccacctactgaccttcctgcactgcgacactgcgcaatcgtgtagtgggctgggccggaaccgcgcgcgacttcgttcgctggcgcagacgcgcgcaataggaaattcggtttaggacttatggatcccagtcccagggagggtggttggtttggtttgtggagtaaaaaggctttgtgttcgctatctcatatcccaaccggaacagtaacgcacgaaaaatagagaggtttattagcgcgtgattaattaagtattagctaatttttttaaaaaaagaattaatttgatttttttaaacaactttcgtatagaattttttcgcaaaaaaaccaaaaacgcattgtttagcggtttgaaaaatgtacgcgcagaaaacgaggcagaggggttgagaaaaggggcatccgaacacactcttgactcaaagctaacctttgctccatgggactgagtcactgaccaagtaaaaaaaaagtctatttggttcacacatatcttgcccttgtttgaattagagatggcaattttgcccgcgagtccagatatccacggatacccagcccgattggtatggacatgggtgtaatattttgtcggtgggcacgcccgtccgaaacccgagaacatcgtgggcaataattgggtattgttttttgtccgcggatagtccatacccgactcatacatatatatgacctaattttggcctatctcttattccttatatccatttatttggcccatttggcccactaactatggacatatatatactcaactaatagaaaccctaacctattccaatcccctctcctattccggtattccccactcccctctcctattctaatccctatggcggcggcggcggcgcaggctagcgatgacggcacggattagcaacgacagcggcgacccaagcaagagacagcgcagtggcggcgcgggcaggcgacggcagggagcggcggcgcgagatggcgtcgtaacctcgcagggcgacggcggcggcggctcctcagggccacgatggcggcggtgacagcttagggcctcgatgacgagggcggtgagccggcgacggcggctcagggcgacaatgacgagccggtgacagcgaccgagggcgacgagccggcggcagcaggcgacaatgacgacgatcgagggcggcgaaccggcgacgggaggcggaaggcggaaggcatacccaatggatatccaccgggcatacccgtgcctgtcgggcatgggtatgggcacggagttttgcccattaatcctgttgggcagggttcgggcgggcaaggtcgggtgccgagtcgggcatgattttgctctactcgtgcccgacctgacccattgccgtccctagtttgaattgcttgtctcaaccgcaaaatcgagtataatgcctctcgtaactttaaagaccggtgcaaattaactcttttagcggtttgagaagcgtttttgctaatgttgtaattgtcttggtccaaaagtgctgtcagcctagtcatcaaagaaattaaaaatagaagtgggtcccacatgtaagggacagcagtaaaaatgaaaatatggtggagcccacttatcaactccacttctccttgttcttcctcccttctatttccccgcttcttcttctccttgtatctagtcgggttgagcagaaggcggagcaatgcgtgcaccaacagtcgcgcatgcgagtgcccacttgcggacacgcgagcgcccgcgaactagcattttcgagccccatgcgaaaacagcaccacgcacgccgcggcggaaaccatcggctgactggatccccgccgtgcgcgcgagcgcgcggacgctcgccaccagatatggatttttgttaatttcgcccacctgggccagccctttaaggaacatcgggctttacagttaactcggcccaataacgctctccatttttctctttagacaactacaaatacacacctactcctacatcctttggcacacgtttaatttcacatctatcactcaaaacaagtgcttggaagtcgaaacacccggtttttccggtttatatataaaattatttaatccttaaaatccctaaaaatattattgaaatagtgtgttccaaactgcttccttcatcttcatattctaagttggtttattatgagacgtaggcttatcatatactccctcaattctgtatcataagtcgttctgtttttttcatagtcaaactttttaagatttaatcagttttttaaaaatatttaacaacataggtaatcaaattagtttcattaaacatgacgttaaatatatttatttttattgaaaatgtcactgcatttctttataaacttaaaatgtttaactagtaaaatagtaaaaaatgacttataacgagaaaaagggagtattacccttaacttgggaccgagcatttctcacctatactacacaccagggtttgcgattccgagataactttccgttccaggctctgacggtatgatgattttcacgaaatccagtggaaagccagtatttttcgaacaaatttaagacggcttctactttcaagtttcaagccatgtcgaaatttcatatggcttctacttttgagccatatcgaaacatcggttttccgcgaaattcaaccggtttttatcggaatggtgaagcctgctacgtacaacgaaagtaccagcaaaatacaagctgtcaggttgcaagttgcaactcttttggctgttgcaagtgtagagtttcctaaaccgctagtaactgcgtgttattacgctttgtacggtaaatggtttgccacagttaccacgtggtaaatttacttatattaccgggacatggtaaccccggccgaggtggtttcccaacctgtttgcaaccgatcgatcggctctcggctttgcgccagctcgctcgcgtgatgcgtatccgtgcacgtgtaaggctcaaagcggaagccgcaacccaaagtgcgcgaggcccacttgccgctgcactacggatggtgcgcacaggccacaggcccacagcgaagcgaggcacttcgcgctcacggctaggatccaccggatggcgtcgctttccgcccccataattttccgttcgtggcgtgcggcacgcgcacgacatccctttgctttcctttgctttgcttcacccgtatcgcatcgcgctcgcccactcgtgctctcgcttgccgaccattatataccgtgcgaaagcaagcaacaccatggagtgaaaaaataaaataaatgggagaagcgttgcgttgggtgtgctactttctcttggttttaaagctgattgattaattacgtgcacctctcgttgcgcgttttgcggtgtgcaagagccaagaggctcagagcagtcacaatccatagtatccataaaaagtgtctatggtgtcatgtcaataagacatcataatagaaactacactttacaacttatggtttcttaaagtgggccattaataaatacatcatttctcttctctaccaatcatatttattcttcatctattatgaagacactattatctcccaatacaaaacttgatagtgttcagtgcataggttctcgtgttgaagttgtgtcttgcatgagacccaggccctgtttgatttcatgggctaatgtttagccctcaccttttagcctcaaattagctctcaagaatccaaacaggtgggctaattttaagctaatgtgaattagcccccctcaaaacattagcccctccaaggggtgctaatggggctaattttgtgcggggaccatcaaaaagcagctctttctctccttctctctcctctctctctccaccttttagccttgaattagcccatggatccaaacataccaccctagactaatgtttagcctaccaattcatgactaaacattagctcttaaaattagccctgggctaatcttccaaacagggccccagtttcttcctctattcactctctctctcttaattaatatagtaccacataagctaaaagtcctatatggcaatatagttaatgctatagacaccatcctaggtggagggttgtgactgcccttatgcttgagtcattacttccataataaaattggagtaagagcaattttaatagtatagctaactattagctttaaatcatctaaagtaatttaatagtcaatttatacaatagtttcctataaacatatattacattattaatatattgttccacctatcatacacacattgtgttttagagtctgtactgtagttcgctacaaatctgttatcttctcaatatgtgtttatagcttacttttataatctgttattgtacttcctctaatcacggtacgtaatatgccctgtctgaatatataagccccaagtgtcttccagcatgcaacacacctctatgttttgtatcaatagcttggtaggcaacatataggaagattttttttgggtgaaattttcaaataatcatggttttaattatagtaatatattgcactatgagttattaatggccgaatttcaactttgaaagcataaccctaaaaaattttaaagatcgtggcaaatcatatctcactttttacgggtcgatcatacagacaggaacttgtatcgctctgaaccatacattagacttcaatgatgcagtatcaaattaaagtcatctttttttttcttttcggggttggggggggggggagggggggttgaaccaataattcagtgtcaagatatgattggcagaatggaccttctaacaataaaactaataattaacaaggcaagctgcaaaagcaacatcctttggccgtgtttagttcctcctccaaattttttttgacgtatacggacacacatttaaagtattaaacatatactaataacaaaaaaaattacagattccgcctgtaaactgcgagacgaattttttaaaccaaattaatctgtcattagtaaatatttactgtagcaccacattgttaaatcatgacgtaattaggctcaaaagattcttctcgcaatttacatgcaaactatgtaattggttttttcgtccacatttaatgctttatgcatgtgttcaaatatttgatgtgaagaaattttgaaagttagaaagtaactaaacacagcccttgtagttttagtaatctacagaccaaaacagctttttcggtgaaaaatctaatacgcatactattaatcacatgaacatgcaaaaaaccacgaaacaaagatacctccaagatagaagaacattcatttccggttgatttggcagaagaactaacttcttgttcaggatacgcaagcaaaacatgtcggctgaacttaaaaaaaacaaacgtgcctttcatgacgcaaattctcaggtacacgtttggtgccccggagcgccggcgagccgatggataggaacgccgccacctactcccactgccacgtgggcccacatggcccaccaccagtctggccctggcgggtgggcttggccgcccgatccaaccactaataaaccacccaatcacgcgccattattattagcgatccccctcgtgttaattattcataattactactagtactaattacccggtttaaccaccgattgctaaggcagcccgacctacgcgtacccacgtattccccaccttatctcactgtctcgtgggccccgcagtggcagcctcgcgcgaaccacgctttcctatggcccacctgtcatgtaatcagttagttaaaaaattctaacgcgcacccgtgattaattattaatcaatcaattaattaattaatcgaattgtgttatatctcttcccttccctcccttcgcttctcctcctaatcggannnnnnnnnnnnnnnnnnnnnnnnaggcaaatacgaaacggaagcggctttagagagagaaaggagagagagagagagagagagggagagagaatggccgcggcggcgcgggaggaggaggaggcgtcgacggcggcgaggagccggcaggagagcgagggggaggaggaggaggtgatggcggtgctggacttcgacatgctgtgcgcctcggtggcgctggcggcggagaggaggaaggattcggccgcggcggcggcggccacggtggaggccggtggtggaggaggcggaggaggaggaggaggggtgcagaggatgtgggaaggggacgtggtgctggattgcttggaggacaggcgaatcgcgctcgaggccgcgtggtaggtggagctgtgactattttcctcctcgttttcgtgaatctgttgtttgattggaatctggtttttgctgggcgcgacggggaagcttgggatttagtgttttagcgggaatttttcatgtcgattgactgatttttgtgcggatttgggaaagaaaggtcgctgcctttgttcggaatgcataaaaaaaaaagaaggaaggggagcccggtgctggaaatcgcactattcaaatttgacagagcttcaaatccgattccttgtctctaatttggtgggcttttcccgttggagttgtaaggttcatggagatgaaggaggaaattttttgcttgaagtcttactttttctctctagtttcagtttcgattaatttgaattagaaaccagcgtcacagtttggtgaattttaactctgttgaaaaaaaaaatcttaggcacatctgtagttggaaactcggaatcaggcatatttgggatgataaattgtcagggaacattccccaaaaatgaggcatcctgcctattctgtggttctgatctaatttctgcaaaatatttcattttttcttttatgctgtacatttaaatatttaccattaaactttgcgtgagcgatgtttttgaagtcgtttgcttgcgaccatctgcagctgcccatgctacaggttcggcaagaacatgcggagagccaatcttggatcttgcttccttcaggtaaggataacactctcaccatcatatgtccatattcgtccatttctacctgtactttttctttgaaaagattctggtcaaaaactgctctcgaggtaaacatgtaaaaccacctgaggttacttgctattgctattgataggaactaggaaaacctcctatttggaacatgctttgagtcaattttagaatgtaccattaccactggtgaatattattacaccgaatagattttttcatcactgatgtattgcctattagggctgagaaaaaaatgtttgttgtgtacttgtgtattttgaactgtgcatttctgtatttttaccttcttgcttctttctttagtttacatgtaatctacaagccataggtttatgttgtaatttctcttgttataccactgacagtttcttgaaatgcgggcccttatcagcaaagtcgtcctttccatagtcctatccttgagttgttaatgcaggacatgtttgacttgtcaatgtgtgctacatttgcttacacaattatgtatgtctgtggcatgtcttaaacctagtcagcctgataagcatcatgctttttttatttcaaattgtgattcattctgtataggataagttctagtgagatgttctttacttatattatatggtactgtgaatcagactgcacgttggacttgccaatattttactcatttaatagccatttcagtcttgaaatactaaatataaattgctatctcagttcttatgtaaaaaatgttattggaatttattgcatcactctatattacatatgtgcatcaattttcttgaaattatcctttgttcataaatctgacagaagattaaaattgtttcaggccatggtttacttaatttctttagtggctattctggttagcctaatcgccttttctgtcacaaggcataatatatatttgtatatgggacttagctctgttctcttgatagcaatctatactggttacttccgaagaagaatcaggaagcagttcaatatcagggtacgtatttcttggcattaccatttttcatttaaagcattgaaacaggttgttattgtgcagcctagtattagtgcttaactgcttaatgcagttggttgtctcttcttttcatttgcatcacacagtatggctatgaatgcttaactcaaacaaatgaaaactaaatcctgctggtcttgatagtttggactttggaatacctgccatagttatgttgtcaacatacgggtagatataaatatgagcacttcaatttaggaattgccaagcacaaagtttggagaaaatccagccatctcattgactgtctttttttgtgattaagctgattgtgcaccttcgtttcttttccttgactttttttttcctgatacagggcactgatagcagtctagatgactgtgttctccatctcatttgtccttgctgtacgctatgccaggttatatatcttgaaacccctctgaagtcccagttcaacatgcgttacttgtttttttgacctattgatctaacagtttctagcattgaatgaacaggaggctcggacgttggagataaataatgtccagtgcggtgtctggcatgggcggggtgataccatttgtttaggaagcaacggtgaaggaaataaggcttttgctgctctacacaagtcctcttttgtgcctataaaatctcctgaggtgtgtggcatggacagaacatcaaatggtgctaatgagcatgaaccactcgtcccatcagatctaccagagcagtaggataatagcagttggcagttgtattgcatatacccttttgcacaaattcgaattgaaatggtgaaaattctcaagagaattggtggactgtccggcaagaaaataatctgtactgcaattacaggcctgtttgttgtatcaagcctgaaaatttgtattggcgctggcagcaaccatatgtgggtgataggtgcaagtgcaactgggttgttgtaaacttaggtgatagttctcatcgtgtatttggttttatttagtctcaagtcggtatctatattatatcatgatgctcaaggcttatgatgaatccaagtgtaaatttttctggctgttacatagtgtttcaacttccaactttcagggacaaattgacatgaatcaaatgaaatgtcatcaactgttgttaggtccttctcatgaatggaaacagaacgtgctcaatcctcaattgatgttggttttactgtcttgagtgatgtttcagctaaaaaattgctaattaacctcttggttaaacatattgttactcttattttcttcaagttataattagttttctaacataaaatacataaacaaaagggggggaaaaagcaaacatttaaatgccgaaaatttctgaggggattcaaacttctgcattcggctgtcagaaacaagtacaattgcactataactaatctgacttatgatttccatccacagtacacctgctggagttcccagcatgtcctggactttgtcatcactcaagactcaataagactagcagatgcactagactattagtacaaccagcaaaaggattattaaggctactaaataaaggttgcaaaacaaagctgcaataatgcagggccctgctgcctcctaaggctcctaagccaatgcaagatctttttattttattttttttttgcctttctcctccatgtgggatgagcttttgagttactataattctctgtctgggataaggattggaggacacctcactctaggcctttgcactagggtttcaccctttaccaaacaatcaatcatgcgtgggatgtgcttgtcttgtgctcgcactcgaacggctgcatatgtgtgtgcttgtcgtgtgtccacggcttgattgtacctttggttctaaagtcacctttgcttcctgatgtgaattatcaatcatcctattaactagtagcactttctcatgatcagcctaatgttaattagtctcacttttgctttctttcatagcagtaaattcaaaaaattgttaagacctgtggaattttataggaatttgaatcactcatgtgtaaatttcgtaaaattcctgcgttaaaaagatgccctaagttttagaacaaatgttacacaaaacatgcatgccaccaattccgctagaattctctacaattcatgaagagatgcgattcagatgaagaaattaatgttgcttgttccgcatcatgggcaaaaccacgacttgagtctaattagtccaggtatatattgcatctgaatacagctgtagatccaaccaagctgaattagttgactacctttcatttttgagataggacatgcttgacaaacctgcaagatgcttaggtatatttgtgactattgatcacgtgagaatcatgcatgtttggaacatctcaacccataagtaaacgatcatgctagttagctgtacggcatgcattccacgaggctgatccatctttacggttgatcatgctcatcaggtatattctaactttggcaatctataaataatcacatggatggatggatgctgaagctcagaaaacaacggctttagtttaatacttcgagggccatggcttttagggtttaacaatgcaatccaacctctgctccatttcttagtaacgaagctacggttataacagctataatgctgcctcctggtatcattgcccaagcaataaagcagcttttcagctatgaaaatggagatggccactttccaaaacctcatagctatcaacaaggactcagtgtgtatactattattttctttgtgtatgaaggcatgaagctacgtacgtactaggttcatgagaacccacatctaaccctgctttggactggcgtctgccggtgccaatttaaatccaaattagacataaatacatatatatatatatatatatatatatatattgtttaattgccttgttttttaaacatatatagtacaaacatgaaagctcatataagcgcgtgcatgtacactcaccccaataaacatatacatgcacacaatatcttcgaaaactggatcggtaaattttgaggttaacaaaatcaccacatacgtctcgccgtcgacgaatacatcatttactgctgaaaaagtaattagccataaatatgaaacacctgtgccaaatctagtcttgtaccgttacagcgaggcaaatttcacgtttatttttataagaggtgtgtagtcccatcttattcagatataacaagaaaatgtatagatcggactatcggagttatgtattatcagcaaacgaacctctcatcgttctctcctcggcttgtgaaaaaaatgaacgaagcaacaaaataatatttggataaaaattttacatcgatatttttctagcgatttaaaaactaatgctagaaaataaactacgatgaataaaactcaaaatctaacttttaaaattgaaattttggcggtagctgttaaatcaacaagctaacgatttaactcaacaatttactttcaagaatatattgatactcctaccactaggctggtagccgaaatacaacatgttccaaaatcatagagcatacaatcaacatcacatcattcggtgcgcgccacaataacataagtacatgattaaattaacaaaccaacttgtgaaaatagcaagatttattattttcctctagaaaaaggtagcaagatttaaaggggtctgtttatttatatttataataaaaagcctcccgttcaatattgtctggacaaatgaacaaaggggagaacatatgcccttttctttttccacacacacacacaaaaataagttgcctttcttttttctttcaacatgattttaccatgattagggactacctatcatttcgaataatccattatatatatctttgcaaaaaaaaaaagatatcacaaggcaaacacgaactatattttttagggaaaagtctgaattaccctcctgaactattgagtgagtacgaattaccccattcataccaaaaaccagatatctttcacccctaactattaaaaccagatgaattatcccactgactcgatccataatagttttgatcgtacatagtaatctggtctacaatttcttttaaattggtgggctcgacctgtcagtctctcatcctctcttctccctctcatcacttcctctctcttctccatcccctcacctccatctctctctatcaacagagaggcggcggaggagggcgagccgagtaggcggcgggcgagggtgggggcggaggcaacgacagcagcagagcgtcggagcgtcaagaggcggggtggacgagctcgatggcaaagacggttgtgggcggcgaccaccagaggatcttgatggggcacagcgatagggcgatgaagctcgagtgggagggaggaagatcttgatggcgaaggcggttgggggcggcaaagctctagtagcggggaggataggatctcgatggcagaggcgagcatcggacgcacgcgcctttgcacaacgacagggcggggcgtaactcgagcggcagaggcggaggagctcaagctagcggatgcctcccagctccccggctgccgcgaatgcctcccggctcccccacctccgggtatgcctccccgagagagagagagagagagatagagagagagagagagagagagagagaccaggggagagaaggcaggggaggggatatatagagggagagagatgacaagtgcgtccatggatttcctttctattttttagctgattggattgccacgctgacgccatgtgtgcaatctcaggtcaaaaccgcttcagaacaatgcttgggggtagggggttctttgtccggtattaatagtcgagggttaaagatatctagttttcgggtccatgagggtaatttgtactcactcaatagttcaaaggggtgatttggactctttttaataatgaaaatggtttacaactgtgacctctgtcgacatacagactatataacatacaagatgaatacaataatgatttaaagtgccaatcatttgtaagctgccccaaagttactcttacatataggagtaatatagactatttaggttcttgcattattgcaaagttggataaagttccatctcgatccactagcttaattagctaaccatggatacagcacgtacgcatgaaggaatttgttggcgcccgcaatggaaatgtgcatgcacgatgcatgcgttgctttttttctttgttcctctttttttttaaaaaaaataaaaaaatcgagaagaccatcagttgctttcttgacctctctatctctcactgtggtaaactcaagaaggaaactttgcgtcactgagacaagctaagatattattatatctccaaatctttcccttgggcaaaaatacatcgcactacaaggcaattatgtttgatcagtttgatactttgatgattgattatttgatttgtgtctggaattctataattacaacaactctcgaggtaaaaaatttgaaggaaattagtgttctttctcttcaaaaaaaaaggagaggaaaaaaaaaggatggatcacttcttgcagttccgcgccaagaacccctccttaaccaccttcctcttcgtcgtcgtctcctgatccgtcgccgacgacggccagtcatgctccggtgacgccgccgcgctctccgccgcctcgatggcacccaccggccgccaccgccgcgggaaaaggtagaacgccgccgagacgagcgccgtggctccgaccctgccgcagagcatcaccatcacgaggcacacgatcaccgcggccacgcccgccgccggccgcggcgtcctccccctcctctccggcgcgcgcctcgcagcaggcggagacagcgcgtccgacagcgacgacaaggagcgggagcgggagcaaggcgccgtcgtcgtcgtcgacgacgacgacgacgacgagcgcgccgagtccagcgacagcgcctgatgagctacttgcagacgaagacgnatgacaatcaaggccgt

SEQ ID NO: 14041 - DNA, 1110 bp, Oryza sativa
  unsure (1)..(1110): unsure at all n locations
agatgatcaccgaccgacagtagctcatcagcccatttggcctgctataggccatgaattcaccgctctccagtctccagtgctctcgagtctcgacgctcgcctctgatcccctcccccttcgatcgagccgtggatctcgccgccgccgacggcgccgccgccgtctgcgatgttctcgccggagcagccggtcgaccctacctcgctctatacggagaatattttgccacccgacgagctcctggaggagatcctcctccgcgtcggctcgcccgccgacctcgcgcgggtctccaccgcctgcgccgactttcgccgcatcgtcaccagccgctccttcctccgctgattccgctccttccaccacccgcctcccctgctggggctactctgcgacgacttctacccggccgaccccgccgccgccgcccgagccctcgcccatgccgccgacttcaccttctcgttcctccctacccctgaccactggtggcgctggatgcccctggactggcgggacggccgagtcctcgccgccctcgtccccatgaccaagatcatcacccacgaaggcgacgaaggggagttcgttccgttccccaggagggacgacgtcacggacctcgccgtctgcgaccccatatccaggcgttacgtcatcattcccgcgatccccggcgacctaataaccctccgtgagcagcgagattgcctgttcgatttcaacgcctttctcgctcccgccaccgaagagaaaatgggggattcttcgttcaaaggaactaaacagggcctacatctcctatacatgaccatatgtggatgcttctcctaaactcgcataattacatagtattagaatattgacagacatagcaattatattagcgcaataagatggcgtatgtttaagaactaggaaatacggacatgtctaaggacttgtttgttcaacctaagaaatattatatctaanatattcatgagtatttgaaataaatagatagattattgtgaaaaattataataaaatagaacccatttgggttgatctggaaatctccctaacggcgcttttttctttaatatgggggggctaaataaccn

SEQ ID NO: 14042 - DNA, 5185 bp, Oryza sativa
ggcctcgccgacctggtcacggagagttccttcatctacgcttacggtccctacacaagcaggctcccctcctgggacatttgggccacgacggctctcacccctcagagccgcccctcccctccgctgctgcagccgctcgagccctggctcagtccaccgatttcaccttctcgttcctcccgtccccctgccgatgagttcaacaggattgccgggatggccgcgtcctcctcgtacacagcctatccgaaagcccccccccccccccccccccacgttagcctttgtttttaacccctgcgtcagcagaatcctagatggaaagaggcgcaatttggttactagttaaaccgccgtgtcgtcgtattcttgttttgtgtggccaaaaatatggtgcctctcggacctcttgtatatatatttaggtgctaaatagttgtgtctatcatcgatgaaacgagtaattagtatgcataaatgtcaatggcttttcatgtaacgagttgcgttgttgatttctcatggattcagcaatttgctctctaatccaaacaagagggctataggatgggcctccgaatgggcgatcttagggggtgaaccgaaccctatccgccccactccatctcctaccctccgccttatcgttattggagcaagccgtgcgtcaagcggaaggagggtgacgacgggattgacttgcggcattttttgtttgcacgacatgtcgctgtaaaatctaggtgaggtgaggcagttggcatggcacgttggaggcggcggctccaccgcgccggagttgcccattgggccacctttaacatctgtctccaccgcttcccgtctcctccactgctaatgccatatggatatgaaaaacggaggttcagacaccacattgctagccaccatctactgacctggttccgccatccatcttcaatgttgtgcttaggaaagccaccgctgccaatagctaatcttacatgttatttttattaatatcataaaaaacttttgtagcaatgcacagagttttatctagttatttttaaagtgagtgtatttaccgttgaatgtctttacctacacaatagtacatgttacctcaaaccatgatagatagaaaaggtacagctcttgcatgcgccttggtctgtacatccggtgtgcggtgtgtgccaactgctagtgacaagttggcaatcttaaactttgcagagcttctctttggattccttcctcaatctctgaaacttttctacttattacaacagtgctgcgtctgtatgcgcgcgccggccatcgcgaacttcaacctcaacttcttcagagttcgtaataacttttttgcaagcattgaggttggcaaacacagtaataaaaagaaccaggagcaagtgatggatatgatgcattgttaccacttaccaccaccagacagagagagacaagcttggtagagcgtcctggcgtgcttggcatcagcgtaactgctgctgatgaaaggtgagactatgaaaggagtcaaatgtagtcacgctgcacgtacgtgtaccagtaatccgatgagatgaacaacgaggcagggttattgaatttctcggtcggatgttttctggcactgcacgtcggctgtcactctcggggcactgttattatagtgtgcaaaatatatctcaattgggccaaaaatacgacttctgtaatgggcgctatctctaacggacataaatagaagcccgacactaacaagagtcatcggtgactggcagtaaggccatatcaatcgggcctttgttgggcctagtaattatgcccgattgagacataggtagtaatctcaatcgggcctaactgtgagcccgtcactgatgagtgtcatcggtgacggactatagttatatgcaccttgcttatatctgtacgagtacatctacaacggtattaaatttaggctcaattgagatgacttcattctgacggcccatattgcccaggcatgtgatgggccgtcacagatgagagaatctgtactagtcaatgatgtttgttttcgtctagaggaacgcgctgaaagaataatactcaaatggatcgtttatgtggttcagttcccctttctttccaaatagattgttttctatctttataacatgttatttatgcctagcacattgatatctctatgtgaaaactaaatctcacaaagaaaccaggatatgccatgtcatctaacaagtattaaccgtcggatgcacttaaagacaaaataagtcgaatcaatctttacgattggatgaaacttaagtatagttgtaaaaaatgtactccctccgtccaaaaaataaaggcaaatcttagatttctgtgtccaactttaactgtccgtcttatatgaaatttttttataattcgtattttcattgttgttagatgataaaacatgattaatgttttatgcgtgacttatctttttaatttttttcataatttttttaaataagacggacggttaaacgttggacacggaaaccatggtttgttttttttgactaatcagtttcatatttagttcttcacgtacttgaactgattatttttcactgcaaaaatgcaggtacgaataattcagcaagcaaaattctggtaatcaccttgccgacagtgacagttgccatcgtagctgcaatttccctttgtatctggaatgtgcgtaagaagagaagtttggcgagatactccagacgtgagtcctctgcacataattttggcatatatattcttgttaacattcttataccaccagcgtccattaacatttcgtcaaattcatgcaaatttgccagctgatacaactgaggattttgaaagtgtcaagtcaggcctgttatctctggcatcgctgcaagtggcaaccgataacttccacaaaagcaagaagattggtgaggggggattcggtgaagtttatcaggtagtaggcccgtagtcgttacgtctacttctgaatcattgttgatttcttttgagaaaaaaatgttgatttgatggtgtgaattggcaatggtcaaaatataacttctaaattaatgactagaagtatgaatgcactactgctcaattgtgagtgagtcgcaaattttgtgtcctcttgaaacaaatggcgaagctcctgccccttgttttagaaaaaaaaactattagtgcagattatttatagtattttattaatagtgaaaatatattacatcctcgactttagccacataataattagctaacaagttctttaacttaaaaaagacataggtggtgagacaaatcctcaaatacctttgaaagaaaaccaatcgatatacttaaaaaacacaaattctagcaacaagtaagcctatatgtattaggccacacatagaaagtaaaagaccttcggtaactagctctaagaatatatagcatatccttgcgcataacatactgctccacccatcgtaataacatagaccaacatttgaaccagttggacagataacctgcattgcagagttagacaacattttttttgttattaagacttttatcattttctcaatgccaaattgacgaatttcaagcgtctaggcactcccgaagtgagttactaaatttttttggcacatcaggaggaggcatattgtaaggagaagaacacattgtcgtgcaaaatgagcaacatggcaatcaaaataggtgttgaattgtttcttgcacattgtagaaactatattgcttgtgtcctctccaattccttttagggaggttatgtttcattaagattacttttctataatttctataaagaaatcacatacaaactttgatttttatagtaacctttaaaattagttatgttatattattaggtttttaacccattacaaaattttgtatttctgtccatgtctccatgtataagttagtaagaaaataagatactaagctaaattatttagggactactgtccgggcaagaagtggccgtgaagaggatggccaaggactctcaccaggggctacaagagctgaaaaatgagctaattcttgtcgccaaacttcatcacaagaatcttgttcgtctcgttgggttttgcctcgaaaaaggggagagactgctcgtctatgagtatatgccaaacaaaagcctcgacacccttctttttggtactattagcattatctttgatcatttggtactcctgtaatcatttcactccaccaataatagtgacttttctaacatttggtgaaaaaagatacagagcaaaggaaacggttagactgggccacacgatttaagatcatagaaggtaccgctcggggactccaatatcttcaccaggactctcagaagaagatcgtccaccgtgatatgaaggcaagcaatattttgctagatgctgacatgaaccctaagattggggactttggcctcgccaagctcttcgagcaggaccaaactcgagaagtcacaagccgcattgctgggacattgtaattaagttgatggaatactttatatttttatgcttatattaactagcaaagtaatacaatcatcattgtggatgcagcggttacatgcctcctgagtacgtgatgtgcgggcagtactctacaaaatcagacgtgttcagtttcggcattctcgtaatagagatagtgacgggccaaagaaggaacagtgggccatatttctctgagcaaaatggtgtagatatattgagcatagtgagtatccccggtagttcacataggaattcatgatattgctttgcattgcaatatttgcgtatttgtgtatagccgcacatgtctatcgtaataactactgactgctgaagacatacatatttgtgactattgctaggtatggaggcactgggaagaggggacaacagcagagatgatcgaccattccttgggaagaaactacaatgaggctgaggtggtaaaatgcatcaacatcggactcctatgtgtccagcaaaaccctgtagatagacctacaatggcggatgtcatggttttgcttaacagcgacgctacttgctctcttggcgggttcctggaccttagggcaacattctttgattgatgggaagcctctggttactcaacagggttctcaacaaaattggtt

SEQ ID NO: 14043 - DNA, 30028 bp, Oryza sativa
  unsure (1)..(30028): unsure at all n locations
gcgagnnnnnnnnnnnnnnnnnnnnnnnnnnnnnnnntagtgaagagttttgagggactattactcctcgggggttaaatatagtttaactagttgataccccatgctttgctgcaagatgtgtaaatgaatacatgttatacaatatagaaatggtaaatgtatatgtttaaataatgtgaaaatgatgtggagataataatttgccattgcttgtatattgagttctaataatacagcaaaattgtaaatgatacgtaatgtttgcatgatatttaaaatagtctagataataattgctagtatgggtgatgatgtcgcacacttgcatgatgagttttaggagttaatgggcatcaattttatagtaagaaaggattaatgaaaagtgtccacattgggagattcctatcccattcaatctctcaggcagctcgctccatgcttttcgtctcaactccttctctcctctttatgtgttaaagattgggttcagagatagccctttccattgtgaaatcaaggtgttagattcaatctatatgatgaacaaatagtcaaaagtgagtgttttggaaattatggtgaatactgttttcgcgggtgaacagtgcagggtggcactaggttgccggtcagatcggcagattccgtggggagttggtttcggattgttttcgtggaatttctagagctcaacgggatttaccatttgtagtttataacatttatatttgaaagcatttaaagtataatacaaacattacaagtttcgaagatgtgaagtaaaataaataacatctccaatttatacaatggtaagtaagttatacatctagtaaaaggtcttgggaatagaaaatgataatcatatttgcatatggatctcttagaggaacaaccatgaaaatcgattttcacatatagttgtgggaccgtctacaaaattgacgatataaatgttggagatgttgaactaaaataataagcgatatctcttcctttatcaagaaactcaatttgagggatttttttatataccggtaaatattcgctaccgtattcgttccgtctcgtattcgctccgtatctgtattcgataatattcgatttcatttccgtatccgagttttcaattccgattctgattccgaaaaaaatatatgaagacgaatatgataaagttagtttctgttcgtttccgatccgttttcatccctagcggcggcggcggatggcgatgggcggatggggatttggcggcggcggccgaggggaccgcgagctgagcagaaggacttggggaaaagggggagaaagatgaggaagaagaaagggttgtagggactgacacgtgggacccactatcatagacttagaatagagagggtggatggagaggctgttggagtaaataacgagtttgacttaacaaattagatggagagttagccaaataaatatttggagagtcagatttggagagactattggagatgctataatagcatggttatttttgaccctctatcttgcccattccatttggctaacttgccaaaaagatctctctctatgttttcagtgtgctccaataacctctccatctcacactctccgaatttcgtggaccccacatattagtgtcttaagaactcatcttttcttcctcttctcttttatttcctcatccacccaccgacgaccactccttgtgacctccggccaacggccactccagagctagggacgacatagtccccgtgccacccacgccgctcggctcctacccccgtggcggcgacctgtgcagcctgctacatgctccatcagcatgacgatggcgtggtggacgtggccatctttgggggtgatgaggatggtggccagggtgggggaagaaggagggggggggtacatggcatccgtcgagttcccacacttgcctggcgctcgtgggtaggagggtaggccaatgctcagtgccttggggtccgtcgaagacgtcccactagcagtgggtaagctcgtgtaaatcgaaaccagctagcggagccgatttagatgatatagggataaacacccatctcgtaagcagaacggaagaatttcgggacaaacctacaagagaatttacactcttgcggtgaggacggacggctttcagctcaaaccaacgaagatagacaaaaactaggcttgaactaggtaaaaagtagatgcgatattgaaaaagtgattccattggttaattgtgttggagtagattgtgtgctcaattaaaccggccatagtccttataaagaggttagtcttgcctcctacaagatcttatccacgtttcattcgggataaagaccaattagaacttgaaaatcctcagcccaagtaagagaacccgagacccaatgaaattcaagtcggattaggactcagccggtctgaccagccacatgtcgtaggtcagaccggccccatgaaaaaaaaactggtcctttccaaattcagcaatattttcctatcccgtgcttaggtaccatatttggatgttaacatgtagctctggtggtgcccgtgatccggcacctctctgctatgtgctgtcattgttagcaggggccacggtggtggctaggttggtagacggccgatgcgagagagaagaagggagtagccatatagggaagcggaatgtgtgtgaggtcaccattgacaagtcatttaggccagtcaagtatggtcagcaaggagagggatttggctggccgaatggcttggcgttagttggagaggttgttggagcgcgtttttgttttgctagaattgttaaattttgatttagagagccatttggagagcctgttgaagactctcctattctttttgagctaaaatagtctatttatttgtattgttaacaaataatttgggtaaaggtatctaagcaatgttgcataaggaaatttttagagaatcatatttttagagaaattcatgcacactaataatctggggccataagctttttttttcaaaaaaataaacaggaccttaggatatcaatcacttggcaaagtgggaaaaaatgtgaagatgggaaaaggagacttactaacctgtatgcacctgaatttcctgaaatttgattgccttttatgttaagaaaagagcagttctctctgttttggtagacagatcttaagtacagcatcaagcaacataaatcatttgtgtgcatgaattgcatttgaccgtggtgtttaacagggaactgatcggtttaacaggaaattaaactgacaaaattgtctgtatctgcagcattgctatgcagaaatgtactcgattgctatctgttcccgacgtaggagtaggtttacatttgctattactcctacgacggtgctgctgtttcggtgtcatgcagcagcagcatcagcagcttccaagcagactgcaggcttgacgccattcttctgaatatttctgtccggaaaaatggcagccactttcaccattgctctttgccttcgttatttataacttttgagcggtcagacggcaggccatgggtacaatttacagggagcatacggtgaagtcagaagtccttctgcaagagcatgcaagggtcaaacaagaacagtagcacactgatgtggttttttttttctaaatatccattccgtttccgaaaaccagaaataatttactattcaaacttcgatggaaacaacacagtttagattccaacttttttcttcaaacttccgacttttccgtcacatcgaactttcctacacacacaaacttttaacttttctgtcacatcattccaatttcttcaaacttccaattttggcgtggaactaaacacagcctaaggcataatttagatgccagcactttcagtcgtagctagatgtctttcacgacattcctaattactcagaccaatgttgacaaccaatcctgctctgcccccttgggatgtctccttatcaatatgtcaaacaagcctgtatacagaatatattgtgttaaaatggtcaataaaaatactaccaaggctgaaggcaagaaatgttaagtgcttccttatggcagaggatgaggtcagtttatctagaaatgctagtgacgagatgcactaaaacacaatagggcaacatatactgtaaaaccattcctggcctatcttgttgatccttgttccttgacctagtattgtgcatgacaagaagcgtcaaagctaacaaaatgctagaggttatttataatgaatccagcataaatgaactcagttggtttatatatgtgaagctataggcaattactaaattatattcacaagaatggtcacattcagtttattttcatacataattgacatgtactccgcatggccagtgatctaaaagtgtgaatgttgttccaaactggaaatcagttagtaaaaaaaactaatatctagaacggcaattttttgaagaacattgcaaaccgtcactgcattcccaactccctgatctgactatctttccaaacagcataacacaattcggatgcagcaacaataagtcatcgattgtggggaattacggataactggaaatagataattcagatatgccaaaagtaactgcgtgcatgttaattggactgaaaacagaccgaccataaccaagatagaaaacatatatagtgcatagtttacagtcttaggcactaacaagttggcaaaccacaaataatcaacacggcgacaatggttaacgaaaaatgagataatataggcacggtgaaaagtaaatggtataggaacacccaggaaggtaaacacatataatcaccaaaagagttcacatggaaagagctaatctctcaggggacagcaaaacacaattatcaagattattaccatggtatgcgccaataagaccaccaaaggcaggcctttgtggcactagtggtacacataagtcatgggtgatcattggtctgatgcttcgggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttataatcttaccacatattcaaatacttgcttgtgacaaggatggtggaaaaccagtatatatccctgcattgcaaagtaggtatccaagtatcaaacctgtaaaccctctcaaactgcaacttttggggctctactgagaagtatccctgagctgcaccttagcatgtcctccaaagagtctatggacaaggagtgacgtgacatcctcgcaagattaagtatccctgagctgcacctaggatgctaaagctataatctaagggcaatgataaagagattgtattgtgcaaatccaagtgttgccccattggcaccatcagccgacaaatcgtactatatatcagttgatttcatctgcctccagaatggcagtttccaacctatctgcatcctttgggagtttttttcgtttttagatttttttttaatatttacagaattaatctatcgacaaaaaaattgcagaaatagcccctgccgccctaatggtgggcggcaagctgacgtggtagacggtgggtcgaccgcgccgtctgccgccgtcggccaaaattgcgattaggcccttgccgcccatacagagggcggcaaggggctaattgcaattttggccgcccataaagagcttgcgaccgtactttttcatctgcgtctcttgccgccccaatagagggcggcaagggacccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttagataggcctatcgcagtctgggtcgtagaaacattatatggacttaaacaaggagaattatgtaacatgaagaaatagtagtacaatttgaacatgatacgactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctgttagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcatgacattgtcgttcataaaccgcttttctctgtaagtattgctcattactttcggatgcgaaataccagcgaccttcttgtaaacaagtagttaggtcgagaacgagattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtagatatacacaaggatcgctacgccagtttggatcctcaacaccccggcgtctagccattgacgaaagccggtcggatttgtaatgaagcaagtggggaagagagtactgaatgtgactgagttctgaaagccagagtcccttgtcctggcgtagtgcacgagtcccttgtcgaccgcgtgcccgtgaccgccacagaacatcacccagccaaaaagccagagcaagtacgcctccaaacatcggctgtaggagtactcgtcggcctccgcctgtagctgctcaacctgcaagcagtcgataaaatgttaggcaccttaactgcggactaaatatgtaatacgattgtcatttcggtacaaaaacactcacggtgaactgaagcagtcacctcttcgtaggtccggtgttgcggtggtgtgccaacggcttgagcgggaggtgcggtgcgcgctgtactagtgcgaaacgtgccgtcagatcgtcctgccagtccacagccgtggtcactggcctaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctagctgggtccgcgtcaccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgttccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagagtacaagctatttaaatatagcaaacgttactaatggtacataacgatgacgtgcaatttaacatatatgtagagttcaataatataacataacattaccaggtagaaaacatgtatgcttggtaacgactgacactgtccaataatccttccatttccccttatacgcgtgcactctccagggacaaccatctttttccttaacacaccgaacttcatattgcgaccggttcgacttggcaaccctaaactctctatgaagtgacactgcaaaatgttttaccgcctccttcatatcttctgctctactataaatcgctccctgaataacctcattttctttgtactcccatctcacactatcctcttcagagacgatcagcccaaaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgtgttgcaatgcattttccaaataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtttatcaattcccctttctgatacaataaaatctgatagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctatgtagttaccgatatctacaatacacacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttcactggaattgaggagagaagaatgagggctgggggctgagcagcaggccttttataggcagcgaggcctgtcgcccggccagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggcggcagggtctatttttgtaattttttttggccgatagattatttctgtaaatattttttaaaaaaaatctaaaaccgaaaaaaattccatcctttggtatagatagctaaatgggacacccagcatggcccggatactcttcgtgctgtgctgggccagcccacaggttgtacctacggcctaggcacgacccaataagatgtgggccttgccgtgccggcccgaaaccacgaccagcccatcgtgctagaataagcctattttgcatcgcctatctgtttgggacgtgtcttttatggctggaatatgtcctccatatgatttaatagcatactccctccgtctcaaaataaatcaatctcgtacgagttggtttattttgggacggagagagttcgtttgaaagggcctcattgacttgacttgcaaccaaatagttcaagaatagtagtacgtcataaggctaaaagcgggaacaagattactctaacaaactatagataacagttgaacaaactactgatagtggggtttgaaacagcagttcaagttcaagatgacttagagaaaaactgcttataaactgcactaacagattccatcaactttcatcagaaatttttaccagattctattggacaaacctgcaaagctccactagccactagtcaagtataatacagcttacatcagaaagagcctcctgacttgcaaccaaatagccaagaatgcatcatcataagggctaaaacttaaaagtggaacaatactacagaaacaaactagattactgttgaaaaattacatagatgccaccactatcagttgtagcttgatgtagtcaacggcgttcctgagcaatgagagcaatattgataaccagtgctgctctgtcccctttcgatgtccctatcatcatgccaaaaagcctgtatacagaattatgtagtattacaattaccgagagattccatcaaaacaagaaacccacataatggccaaatcattttgaaaaacaatcacacagaatttatgttcctcaacatagaatccacatcataatagctgatccccaaggccagtaaaacacaaatagcaatgcaattctaataagcttaccatattcatagacttgacggtgataaggatggcggaaaaccggtatatatctttgcagcggtaattggacgttccaacacgcaaatcctcttgagaaccaatgttttgggctccagtgagaaatataatgtatctggcctgccctccttcaaagagcattcgaaccagtccagtagcctcccttccaagagcaagtatccgtcagctgcatctatgatgcgaaacatatactccatgggcaagggcaaggggattattttgtcaaaattcaatggtggcccattggcagcatcagcttcgacttgcctaattgtataacagagctgagttcttgtagtgaagcctaagtctgtcctgagagagaaaactccaaccatatcttcctctgcctcctccagaatggcaatgtttgacatgtgttcatccctctcgaggtcaatggtgaagaacaccatctcacaagtgtcaagaacgagcaacttgtccatctccttcagcacccagtacaagcggcaatgtgcatagtagcgcggggccaagaagaaatctgcctgaaccagcaccgacgagttcacatccgcggcgaagatgctcccactgtcgaattgaaagcttacgccattcttcggagcgtgaagagaagacgaacacaaacaacttgcttttgcactgcgctgtagccaccaccctgaacgacgaatccgccatctcctcttcggtggcgggagcgaggaaggcgttgaaatcgaacaggcaatctcgctgctcaccggaggttattaggtcgccggggatcgcggggatgatgacgtaacgcctggatatggggtcgcagacggcgaggtccgtgacgtcgtccctcctggggaacggaacgaactccccttcgtcgccttcgtgggtgatgatcttggtcatggggacgagggcggcgaggactcggccgtcccgccagtccaggggcatccagcgccaccagtggtcaggggtagggaggaacgagaaggtgaagtcggcggcatgggcgagggctcgggcggcggcggcggggtcggccgggtagaagtcgtcgcagagtagccccagcaggggaggcgggtggtggaaggagcggaatcagcggaggaaggagcggctggtgacgatgcggcggaaggcggcgcaggcggtggagacccgcgcgaggtcggcgggcgagccgacgcggaggaggatctcctccaggagctcgtcgggtggcaaaatattctccgtatagagcgaggtagggtcgaccggctgctccggcgaggacatcggaggcggcggcggcggcggcggcggcggcgagatcgacggctcgatcgaagggggaggggatcagaggcgagcgtcgagactcgagagcactggagactggagagcggtgaattcatggcctatagcaggccaaatgggcggcccggcccagcacggcacgggcccgctggtggtaactgtagcgggccgtgccgttccggcccacgtgccaaggcctcagcccaagcacggcccaaggaggtgccgggccggcccgtcaatgtccgctactgcacagtagcgcatacaatcctcaccggtcaatttgtggccgtgtagtgggatttttgtaaacagccccctatttttggcgttttgcagaacacctcgttttgcgtttaccgctaggtaaatcgccttaaatcagctcgatcttgaaacacagtgaactttagtttccctgcatacagctttatagcaagctaccacatcaaatatcagtgaatcatattctaaatgtgagacctcacgccccaaagtacacttcagttcacactatcaatgttcagaaacaatatcacaatatgacaattaagaatttgccagtgggttaaagaactcaacagaatttatccgagcaattgcataaggttagaaagaagtttatgctcaagatgacagacaaaacatggttccaaacatttaatagattccatccaccttaatttcacaggattctattggacaaacctgaaaagctccaaaagccacgatctgcctgacttgacttgcaaccaaatacaaaaatacatcacaagggctaaaagtggaataggactacctaaacaaactagacaacgtttgaacaaactaatactgatagatgccaccaccgtcagttgtagcttcatgtctaccaagatattccttcctggctcctgagcactccttctcattgaaccaaacaagcctacatacagtcatacagaaaaaaaccagatattcatcatgccggaggataacgtgattatactctataaatgatagctactccctccttcccataaaaaaccaattctagctaggattggttttttttttttttgggaccaagggtgtacatggtacatgcaaaaccagatacaaaaaccatgatggccaattcattttgaaaaaaatcactttgaatgtattttcagataaaacatgacatagactataaatctggtaagcaaagccacagacctaaaagtaagtccaatgttcccattcctggtctatcttgttgattgcttgttccttgacctaggttgtgcttgtgtatgacaagaagcatcgaagctaacaaaatggtaaaagtcagttatattggttccagtataactgaacccactattggttcatatatgtgaggctatgggtaatcattaaattatattcatatgatatatcacattcatatctttttatacatatctgccatgtaggtagcaatggtctgcaatctaatagtgccagtgctgttccataccagaaaccattttgtgcaaaactaagtttgctgctaatttgtagagcaacactgcaaatcatcacggctgcattccctactcccaagtatgactagccattcaagcaccaccacgaaacaactcggatgaagacacaactataataaatggctaaggggcagaagaaatgaattggggcaattgtggagatctagggatgagctaatttggatatgcccagagtaaccacactgcacgaataggttccatttatgtcagaacgactataaaacggggaaaaaattgcatgtagctcagagccttagataagagttaaatgtgctttctgaagtttcaatgatcacatttcttatttcttcaatttaaaaaacctttcaaacaacagataatagtttcggtgagcctgcaactctaggaaattgtcaaacaatatacaatcaaaatggtgacaatggttaagaatgcacaagcacatatgaggtcattttggcacagcaaaaaccagcaatccgggaacaaccaggaaggtaaacactttatcaacattgaatccacatcacaagagctgatccccaaggccagacttggcaagatgttactgatgctataataaaaagcttaccatattcagtattcagacttggcagtgacaaggatggtgggaaactggtatatatctttgcagtgacatttggtctactcattccgcaaaccttctcgagaagcattgttttgggctccaatgtgaaatatagcatatctgtatcatcctcctccgtagtgcgtctggacgagtgtagtcgccgcccttgcaagagcaagtatcctgggttgcatttataatgtgatagcaatgatccaagggcaagggcaaggggattgtcttgtctaagttcaacggtggactatcggcaaaatcagcatcgattcgcctagtcccataacagaggtgagttcttccggataagtctcccttcaggcagaatgctccaatcatgtcttcctctgtctccagaatagcaaagtctcgatcccactggaagttgatggtgaagaacgccatcttggatgtgtcaagcacgagcaacatatccaccagatgcatcacccagtagacgaagtgcgcgtagtaacgcgggaaaaaccatagatgcgcctgagctgtcgacgacaaccagggatcggcggtcaagagagaccaactgacagatctggagctgtgccattcctcggtgagtgaagagaagacgaagatgaccaccttgctttcgtagttcgccctcgccaccactctgaatgacgtcgtgcccaccatctcctcctcctccttggcggcgggagcgaggaaggtctcgaaaacgaggaggccctcctgctcaccggaggtgatcaggtcgtcggggattggggggaggatgacgtaacgcctggatacggggtcacagacggcgagatccgccatgttcctggtgtcgaacgggacgagttccccttcaccggcgtcgtcgttgtcggataggctgcgttcgaggaggacgcggccatcccggcaatcctgttgaatccagcggcagggggacgggaggaacgagaaggtgaagtcggcggcctgagcgagggctcgggcggcggcggcggcgaaggggtggggcggctcggcggggtggaagccgtcgtggccgagtagtcccaggaggggagccggcttgtggagggagcggtagcggcggaggaaggagcggccggtgacgaggcggcggaggcccgtgcgaggtcggcgggcgaggcgatgcggaggaagatctcctcgaggagctcgtcggcgagttgaggtaggtcgtagatcggctcctgctccggcgaggacatcgtgtcggcggccgccggtggtcggggcggcgagagcagtagggggactgggcaggagtgaggcggatgggcaagtgatgtacggagtagttaatatgacccagataaacccagataaagcccccaacttaaaaaaaaaagttaaaacaacttataatactccctcgggccctaaatacaatactagtatgtgaatctaaccaaaatcccttatactccctccatctactccatttatttttaatagtcatattttcaaatctaaaaaatttacttttgataggcatattttaattcaaccacctatcttcttaatgactttctcagatttaatacgtgactttctattcttccacacaagattggctacatgagaaatgtaaatattaatgaattgcttatttacgaggaataactagtagcatatttaaatggatgataagtagaattacttattgttgatcattgtgtcaagataaaatattactatcaaaagaagagggagtatttagggacggagggtgtattccattgagtaaggtcctagggcctcatcgtttggcttttttttaataagccaaaacggcttattagagaataaaaatgaatttttaggtaaaacttttactccctccgtcccaaaataagtgcagttttgcactattcacgttcaacgtttgaccgttcgtcttatttgaaaattttttatgattagtatttttattgctattagatgataaaacatgaatagtactttatgtgtgactaaatattttcaaatttttcacaaatttttcaaataagacggacggtcaaacgttgggcacggatatctacggctgcacttattttgggacggaggtaatatatatgtgttctcggtgatttaaaagccaatgctgaaaaagaaactacgttgaaaatatctcaaaatcaatgtcaaaattaagtttgaaaattcaaattttggctttttctttggctgaataggccatccgatgggagctttaatgtttattaatcaataattgttttgtgataaattaaattttattagatgacaactactccctccatctacttttgatagtcatatttcatcttggcacacagaccaaggataagtaagtctatttatcatccatttaaacatgctactagtcatttctcgtaaacaagcgattcattaatatttataatcctcaatgctcatgtagccaattttatgtgaaagaatgaagagtcacgcattaaatccgagaaagtcattaagatgataagttgttggattaaaatatgtctatcaaaaataaaattttcagatttagaaatattactatcaaaaatagatgaagggagtacatcattagattaacacttggatttcttttgtatgattatgactttatatcaatattatagtgtataaaaaatttaaagtcacatatattaattttagaccgtgttaaatttagccatgtcttattaggtgggagagtgatcgaggcggtacatggggctaaagcaaccataaaagtctacaagatgcacctatatagtcgtatttatatagaccagaccgtgtttagatacaaactttttcttcaaacttctaacttttccatcacatcaaaactttacacacataaacttccaacttttctatcacatcgttccaatttcaaccaaactttcaattttgacgtgaactaaacacacccataccataataacatcacaagaattggagaaaacagaaaaccttatcatacccccatggatttagaaatgaagtctcagccatacatcatcacaaaataagttaacggagtaagtacctccaaggatgccaattcacgagtacacagagtgagaagatgacccaacaacgatccttcggaaataatctacgattccaccaatacctcaaactgtgtaagcacccgttcccttcgcgttggagcatcagaaaatagtgcgatccacgcaaaggagacacagagatcacctctaatttgccaagggtcagcaaccattctacaccccatataataaacgagggcccgttacaacgttagacaagatgatcggatggacgtcaggtccaagaaatacacacaaacatatataccaagtaaaagagcgacagaaatacgtacagcaagatttaaacaaaaggcagtggtaggtgagtcatgtgaaacatttggctatcaggaaaatgccgataagttataagcaactacaaagtcttatcacaatgaaatattggtcagaagccacgggaggcatcaagctgtgaacctagaattctccctactcccaacaaacattggttagaaagacttctcccccctgtgatcacaaaaaaataaccctgatactcgctacggccgactcgaaatgggactaactattggcaacaaacatcgaggacaattccataatttaccatcagaaccaactctgaacaggatgaagaaaattcacacagcatgagctcctggaagaattaatgggtgcatgccaagtaggggcagcatctgatgggcctttccagttgtcaataaaaaaaaggctggtctgatgccaaaaactccatggtgccaacacccatgaatcggtaagctgttcagccaaaacagtatattagaacttgaggattttacaatctcaataaagcactgattgacatatagatctaaatcatactatggatgagccattatagaacacccgacttacctagtaacaaagcttctttatgctttcatgaaggcatccaacttcgatctcttgagatgctgtggtctaaaatcctccaacttgaggttggagcttgccttggcctcattcaagaatgaatcccccttttctactttgatcgactctagaactgcaccaaggacatcagctccaatgccatgatgtacaagctctccaggttcttctccacctttttcaatcaatgtacccacctcctgcaaggacaatatgctttctaccacaaaccttgcaagaagccgtccaagatactctgcagctcttggagcatcacttagagcatcttccaatgaaccaaggacagtcgcaagtctggaagtaaccatgtgttcagtatacagtaaaatgtaaaaaacaaaagtagagtcaataggagtgaaaagaagagaaacaattaccctgcagtgagatgagacttgctcaataaattatttcgactgttgcaaagactaacgaaaagctttgtcaacaactctctttccatatctttcctctcaaaagaatcatttacccacagtgatacgacagagggatagaaacttggagcattcaactcctcaatacacaaagcaacctctttctcatcttttgcactgccgaaatagttgtatatatgttagcacacaatgcagaggactcatatatattactaaaaaatttagaggaccacaataaactgttcttgtggtcctctaaattttttagtaatagtaacaaaatgttactcaataaaaactgaaatccaagaacaacaccctagcttcctaaataaagtacacagtaatagatatctcaagattaaaattaattggaaaagaagttgtaattgccctccaatcttgtgactggctcaacgttacaagaatgttgtctatcccttaagtcttaagtttgaattccagcattcataaacccccagtactccaacgtcagaaacaagggtacctcagcagacttgaaatccacataatgagaagtgacaaatttaaactagaaagcactagtagttgcctaaaataattgcgaaacagggttgtgttcggaggtggagattgcaaacttcacctccccgcacgcaaaacggactgatccattagcacataattaattaagcattagctaaaataaactcgaaaaatagattaatatgattttttaaaacaactttcctgtagagtttttttttccaaaaaaaaaaaaacaccgtttagcagtttagaaagcgtgcgcgtagaaaatgagagtctagttgggaagagttggtaaagaacacaccctaagaaactagcagttgccaaaagaagacagtaagtcattattataatcaaaatttgtaacaaacataatagttattggcaaaaaaatgaagaaatagtttgtatgaaaattcagaggctacaaaatattacctgtaatattcccggatggcggaaatagatttctctcttaaatcatcctcagagtataatttattccctgaacggccctcttggctggcaggcctgttcgatggtccagcaaactgtgtatttggtgctattcttccagagcgatcaggaattctcgagccaggttcctctcttgcagttgaagcagaattatacccgttgggaccagataccatcctgcgactatcagcagaagaaagctcagcatttgatatcagtggctgccctcttatagacataccccttgctaggccaccttgtggcccaagagtgatggcttcatccttacgcggaggaaggacagttgttctatggtccaaaggactcctttcttcaaaccggatatcttgggtaccaaaccctcgggaatgcgaaggcattcctctatggccaacttgctgagaacttggagaagccaatgctgctgctgagccacgaggaccataatccataggtgcagctcctcgccttggaccagaaccaacaactgagccacgagctaacctactcgactgagcatgtcgttcctgagctgcatccctgtgcacctcatcaattttctttgggccttccaccttacgcctttgctgccatttatttttcctgagatcaattgaatctctcagcatgaacctaacacgggaagataattgctgacttgttgaaagcttcagcattatatcaaagtacgcatccatatgctccttagcctttgcatggtctatcatctctccaattgtgctcatcaatttgcacagtgcttcaatgttctcttcatcagggttctgataatttcccagcaattttttaatgcattcatgcatgatgcgttctgtcaacatcctctttttgtacaattccccaatcaacctaatgttcccaagcatgcgccttcgagcacggattcttttctcttccctttcctctttagtttgcttaatctcaccttcctcctcagttttgtctgcttcagcttcttctctttcacccctctcaaattcctcctgacatttgttcaaaagcaatctcttgaatgtaattttttcattatcctcactaaaatctggcagtgcaccagccaaatggaaacaaaaattagcgtacatttcacagaatgttggttccatcaaagctttgtcaaatatctgtgaaatgaccccagtaagagttgccacattgtcaatgttcacctctttaactttttcaaaaagcttttcaaaattctgtggcgtcaatttgttaagtattgccttcagttgcctctgcttagcttcttcctcgtcagaaactttgccaacgacatattttttctctgctttgtgcattacttgcatgggtgtaacaggagatgggaatatacccttctgctgccatctatctgcatcagagccacttcgagacatttgaggtgcaaccggtcctacattaataagcccacctcgtggattcctcataactcctggagcaccacggtgattcatagttggagggccattgtccatggacatatcacgaccagaaccaaaaagatggcccgactttccccatctatcatcctcaatgacaacaccacggcgatcaccacgagatgctggcctgtcagctccccttccaggacttgggtgatcaacaacataagactttccggccaaattagggaacagaacgctggcgtactcaatcatctggaaaccaacaggaagattagtacaactctgtgctaaagttagcaaaaaatcgcgtgaatatctcttcctcccattagcttcggttgtttgattgctggaatcagacctctccaactttggagtagacatttctgcagcgtcttcccaatcatcaagctcaacctttttctttccctcgtcctcacccatattaacctccttttcggaggactcgtctggtagctcatgatcagcaattgaagaactatcaagactctctgaggcaccaatgaaatctactttttcctcaggtcccttgtatgcattataaagatctgagctcccggcagcatcagcttttgaaagcatttctcttcttttcttctttttcacagctgtaaactttgttctggtaatttccacgctaggtttttcccttgaaactggtcgagcagaggctgctggtgcactactcgattgatcctttaacatactttctggtttcagtggatcctctgatgccactgaatgaggtaccggcaacacattaagaatattgctagatgtagcagaccctgtttcctgattaccacttgtgttacctttagcattggcattttgaattatagattctggcaaagtttcagaactggcaacagaagcaacagtgtcatcaaccaaatctgacattttttcagcactctgatgcgatctgtccataataacattctcatcagatactgatgagctgggttctttgagaagctgtccctggtcagttacagaagttgcagtatctaaattatcaggattagaagctcccacaggtaattgctccgccaaatctagcgtgcaaacttcatgtgattcattcccagttgaaccagaagaaatatcatcctttgtaagatctggtgaaactttgttagttattccacttttctcagaatcaccaatagcaacatcagattttcctacttcttgaacattctcagtgctctcagaggtcgatcttgcagagctcctatcaatgctagaagcatcagcagctgccaaagcaaacatgttaaacaaagcaacacaatacaactgttttggcattgattttcaaagtgcataatgcatataccttttaacatttcagtcggtgaagcggaagctgcattggtctgttcagactctttattcacacccttggattccatgagactaacaccacaacatacatcctttacagaagtatgcacctttaaatcttcagcagatgaagctgactgaacgaaacaatatataagctgttgagcaaaacgtacaaaacaacagaaaattgcaaaaatagaatattttacaggactacctgtggttcttgtgataaattcctggtgtccttagtggcgttcttattgctatccttaaatgatccagttctttgaatagattctttgctttttccatcatctccaggaacagaattcacaacaaaagatgcagctgctgtagtttctggatttgcagctagagcttgtaagggttggctcactggtgtgggatgcttctccgtgatcggtgaagctttgctctcattttcacctgatttacggaccccagaaacagcttcattatccttttgtcgatgtgatacaacatcttcagctggttttaacttgttcacatctgatttaccaggcggcgcacttatcgtgaccgtttgtaccccggatttctccatgtgcaaaccagctgggtgtggtttgcctgtgacttgggagtgtccagatgttgtagaccctgctaggttgtccttgttactgccaggacctgtgttcatcgatgggctgatgtatgaaactgtttgtgtggatacaaacctaggaccctgtgatacagtggatacctgaccgacaccagaggttgtggggtaaaacatagttgactggttatacgaattttgctggtagaagcccataggagatccataagtactgaccggctgggattgttgttgtacactaggtaaacccctttgcccagaagagtccatcctcttatcgagcttcaattcttcatgagtatctggatgagtaattttgactgtggtcttccgagttgggcctgtaacatacttatttggctgttgtggagtaaactgaggtgccacccccacattcatcataccactcatctgagtgagttgatgagcagctggaccataaggtatacctgctgcttgatgcatcattgttggcggttgcagttgatgatggtgctgaatggtagggatgtacatttgctgtgcaacctggggtgcgttggcgccatgcaatcccatagacatttgtagtgaactgggcacaactccctgtggtggaatttgtgggttgtgaccgccaaactgcaagggtgcctggtggtgaaatggcattgacatgggcatcccaggtatctgctgaacagggggtcttggtggtgcaacattgggcacggatggtgagacatgcacagagctcttaacttgggaaggaatgtgagggttgataggtttcgatgaatgattagaactaacaacatcctttcttgtttgctgcagtggtggctgtgactgcggctgttgcttctgctgctgcaacggctgctgttgctgctgatgttttggagcttgtggaacaagcccagaaggtacaaccttatgaccttcagggagggcctaaacaccaaagaaagataacacaataatacattcttttagaatattgaaaattaataacacctatcaatacaatatcaacaatagaagcaaaaaaaggcatgacttgctcaaatctcctgaaagcatattatacataggagcataaattatttggtgcatttgttgacaacatactgttatcgatatatctaacaaaagcgcactaaaaatcatagccaataccaccaaattaaactaacataaagcagagaaacaataatggtaaaggccaagggaaggagaaaatacctgcatgcgtttttgctcatccaaattaggaggagctgagcttgtcctggcagggaattgctatgcaaaagtatttggaaattagaaaaaaggtgaaaaaaagaaccagaaactagaccaaattgaaataagaactgcaagctgcaagaacagggttgaagagcgtaccattgtgctaccaccagttccaccattcattgggaaactgccaaactgaagattatatgctccacctgtaaagaagagtggcagcaggcagttaacaaagtagtataccatggatatcaattacaaggtgcaaacaacccccctacgaggaccaaaccttttggtgctccttgtgaagtggacgtgcttgaaatccttgatggtgcccttggagcggcatgaggaatacctttcagtggtggcgcattggccgtgttctcgctggaaggtggtagggtgggtgctcgcgctccagacggatctgctcattcaagaaatgcatgcgatcaccaaaaccaatacatcaaaagacgcctttttcacattgttctaatttgtaatccaacataagggaacaggccgataaatcaccatggtgctgaggacgtggtgcgggaacagggacatgcgccggcgcattctgaggtgccggcgggcgcaacggcggcgtctgcagaccggtcggggcaggtgcaggcttgaagccgtgcgtgtcgggttggctcacagccctctggtgcccgccatggccattcccggacttcctaaagctgcaatcggatccaaaagtccagtaaaaaaccctagcttttcctcggagcccgctcgtccccagatcaaatcatgggggggcatccaatccatcaatcaatcaatcaatcgttacctgcggttagttgcgaggggaggctggccggaggagcccccgccgcccttgcccgcgccgccgactcctccgcctccgcggtggccgccgcctaagctgctggaccggccgggtcttctcgcgtgcccctcgcccctgtcccctcgctgggacataaatccctctcccacttccgatctcctcctcttcctttttcctccccctgatccaaaccaaacaccaaacacccaaataaatcgccgccccgaaatccaatccgcatacaaagcaaaaaaacaacaccaaaccgaaccctaatcccgccgccgcgcaaagagagcggccctcgccggaggggatggacgaacgagcgctttacctggtggcctcccggggcggcggcggcctagggtttggttgtcgccagtggaggggcggcttaacacgagacggacgaagaaattgatgggtgggggtggggaggggagtgaagagtgggggcgaagcgaaagagaagagggaggggtcgggggcttctagtagtagtctagctgcatacgatacgaaaccaaacagggcaatgaaaaagaaagagagagagagaaaaaaacagatatagtctgggacttgtccttctactactgtactgaataataacagaattattttttattttttatctcatcttttatctctaaaattcgattgaatctaaattattgttgttttatattattggtgttagttttttgggatttaggggaaaaaagtaggggaaaaaaaggggagcgaaccttgagcggtcaaggaggacagatcaggcggaattggatggctggcgttggctcgcgcggccgcccgcttcgctcgcctggttgcaaggcgtgtgcgtgcgtgcgtgcgctcgggacgggagactagtcgactcgactcgactcggcaaaacgggtgtgggttgcgttttatatctggcagcaaccgcgatgatcgtgttcggtacgaacgagtaggattcgcaggcgtcagccgagttctcttctgttcctgtgtgtttctaaggctgtgttcgtttggacgttttcccagcgcgctacagtaacacggaaaacggaacggttcattaacacgtgattaattaagtattagctaatttttttaaaaaaatggattaatttgattttttaagcaacttttgtatagaaactttttacaaaaaagtacaccgtgtagtagtttgaaaagcgtgcgcgggggcaaaacactgtagcaagtgtgtttctaatattggtgttttgatacggagaggattcaatgttctaaatggagttggacacgagttggggtttagcaccgctgaattttggtggaagcagacgagaattgcggtatcgcagttgtagacagacctgggcgtgagtgatgatggtaattaaaaaagaacagaaaggtaatcatggtagcactagggggccgtacttggggcctttctgagttagggcccatcgacccgtttgcttggactaggtggcccatgttggcgaacggcgtttcaaggaattttctacatgaacacagcaaacgaacaaagttttgtagtggcaaattgcctagttttgcatggtcctcctccaaagattacgacgatcgctcggggacagccaccggcactagcttctcgatggaaaccagcaagctgtgaatctcaccattgcatatatactataccccgtccacactgcattccaattctccagcacattcccatctcagagcgttgcacagtcttgcacattgatgaagtccagcacagaataacagtacggcactaagccactaacagattactgttcgagaataaggttgccagcagcaagtcttgcttacattaacttaatacggtctattaaactacattagtgactactttgtgataaatataacccaaggctcaagaacatccgggtcaacagaatggcagcaccattttgaacctcctgcacttccaagcagtacggatgcatggcacgagtatgggctcaaaagcacggcttcatccctgcagataaatttaattagattttacagacacctactgtgaatgcaaaaggatttttttttaccatattcacatcttcacctaatgcctgatattccacccgaccacaccatacatgtcctatatatttttccaatgtgttgccaaatttttacaggaaacctcgtaacagtcccaacacaaaattatgatgacccctcgaacaaaaatgttatggggttagtaggataggatcatcagcaaggatatcagcctgagcttcagctcgaggtaagatgaagattgacttggaatgctcaatatgagccatggaatgacatgtttttctgctcgccactaatcaatagtaagaaaagtaagaattggtaataagcagaatatgagcatgagtcacaacaaacttgaaattggtaagatagaagcctatacaagtatggacaccaactctttaaacaaataaaccaacagatctcttgcgccattacttctaataaaattattttctatcgagataaccataggacgggatcaattggacaaaatgtggtgctcataaaatatagaaggtaaaaggtctatagaacaaacaacaacaaaagatacaccaaaatgaaatgggataagtagaaaatggctgtacatgctataatctgaaaggaagagattatttgggggtttgggaatggaatggaattgcgacctaagataaatttcctagtacattgtagtctatttataaaagaggcaggtgctgaacagcaagcagtgatgaagttttctgtttgttctacttgacaggaacaaagtttcccagatgaagatccgggttcaggtccatcagaacattaatgacaggtataacttacgcattttctggatacacaatattcattctctagttaattcttaaagttggaagcaagttatcccacagcagagaatggataaatgatatatcctaaaacgaaattggtgtcatctatttgcctggttgccagagcatgatcatgcatggcaactggatgctatgccagacagaaccaaaccatcactaccttcagaacataacaggatgattaagagctagatcctacaagaccatctaaatacacataacatatatcactgacaaattcccagacaggtggcagcatacaagctacattgcaacattgaggatgagataaactgagtgcccaaaaataagaagcttacctctacctgaactactagacagcaaactactgctagcataaacaaaataaatataaaacaaccccacattgataactgctatgacaacaagcttaccacttcaaacacatggttttgccgatggtggtgaaaagcggaagtacgggcaaacatgaaagtagcacttgtccatgtccatcgcgcagaccatctcaaattcaacagtcttgacattgagcgaataatattctatttcttcaggatccatgtaaagatcctctgatgaagagtcttctactttctcttcttctggaatgcctctaaggaaaataaatccctcagctgcacctaaggtgaagtacttattgcagttgctgggcaattgtataatattctccgacaggcgttcattgggagattcacggtcactttgtttcgcgatgcgagagaagcgaaactctctattccccaagtattcaccaacagtcagcatcccaggggttccttctgtatcaactgcaatgcaagcccgaaagccgtcctccacacgatgagcatagttgataacagagaactccatcttgatggcatcaagcacaagaatcttgtccgccgaaggcactgtccagtagaagcagccatcaacacagtcgaagcaactcaggccatggcggttagggggctcttctgtgcccaaagaactccaggtggaagacgaaccgattccccattgcctagtgacggaagagaagacgaacgcgaccagattggtgttgtaccgtgccacgcatatcaccctgaacgatgtatccgcctcatcctcttgggagggggcaaggcagagcccgaaatcaacaaggctcccctcattggcggttaggtcgtcgggtacgggtgggagcatcacgtatctcttgaacaggggatcgcacacggcgtagttcatgaagcgggggcgggggaagtcgccgccgtcggggtcatcggggaagtacttggactggatgaggacgcggccgtcgcgggcgtcgagggggaaccagccccaggcctccttcttcggcacccacggcacgaagccgtactcgaaatcggccttgcgagcgagggcgatggcgcgctcggcggaagggtggggctccgtggccgggtagaagccgtcgtagcaggccaacccgaggaagggaggcgggcgccccgaccggcgcctcttgcggggtgggaatgcgggcgaggatcccaccgaggaggccgccgctggtgagggcggcagggagcggcgctgattgctggcgctcgatggcgacggcgacggcgacggcgaggccatggcaggcgaatcgccggaggttgatgatggaaggggatcgatggggggtttcttggggttttgggcgggagggaagtgtgttttcaataaaaaggaatggagccttcgaggccggtgggaatctgggaatatttgggatagaatttcgcccccctggcactgaactgggggtggggagaaacttgtttttggcccccttaaatggcggttggctggaataccttccaaaacacgttttgcttaat

SEQ ID NO: 14044 - DNA, 19363 bp, Oryza sativa
  unsure (1)..(19363): unsure at all n locations
gcggcatggtgactgcctcctctgcaagnacnncatcatgtcgagtcataagacagaattgccctcaccggcaccttcgccctcggcttcctccgcgtcaactccaccatgctctacctcgtcgtgctccacctctcatcctcgttcccactctggtgctcctcaacacctccaacctccaaatccagagcggcgcctggtgcgagtgcctggccaatgcgacggacggctcggtatgcgccgctgcatccgtcggcggcggcggcggccgcacgagcggcgaggtcggcgggctgtactgggaggtgcggaggcagcgcgtggagctggcttacaaggagctcctgccgtttcaacacttgccgtcggcggactgcgaccccacctgaatctttcatttatggaaagcgaacttgcatgattgctgcaaacaaaacacaaaatgcaaattccaatgcttattcaatcgacatggtccacaagaccacaacttcagccaacacttactctgacagacaacacttattccgacattggttcgggccaacacttaaccgacggactgggtaccgcccaacactatccgacacactcggttttacccaacactctcattctttctttttcccgaggcgcccaactctaatttgacaaagactgggtttagcgacagcttgttttgattacacgcactcaggaaacaagtttgatggaggctctgcctgctagcattgtagccgaacaaaagtacaacaccaatacaccatcatggtcccttcaccaacaccagaactccagaaggatgatccagagaaaggccagcgtccatctgtccctgaaaatgcactcagttaattagatgtcactatgatggatgcaacaaaaatatttactccttagtttcaagataccatgttcgaaatcagtctgatttaatcagaaagtgtagtttagttcagacagttaagataacacttgtgtgttcattctccattcatacttccaagttccgatgttcatatttgaagttcaacacttgagctcaggcagctcaagataaatactaagtgctcaatcttctctttacttagtcattgtgttcataactaaaaagtgcagtttagctcggatggctaacattcaaaattcagggaccactaagccaatcagatggatctagagattacagatttacagggcatcagcataacaaacaaacatacaagttgtaaaccgaagtagttttctaattgctgacatgcatacaaagtcctgaacctgacattatcttcttgatttcctgactttcataaggtatctaacaatagataaatctaagcaatgaaagctatcatggacaacaataataacctaaagccttaacaatttgtcaaatgcatccgatttacatgataaccatgctgggcagaatataatgaatgcttaatacaataacaacaagctgatcatggcctaatgcaatgcataagcataacaatggagattttctccctcacaaaagaacatggcagacaactagacgaagcaaagattacaaagaaaagcttaccatttcatacgcttggtggcgacaaagatggggcgaatccagcaaacagatcagcacctatcaaggtacgcctagtttcacagaacatctcaaccttgaaagtcttgagctccaccgtaaagcacacctgatcttgcacaggcccctgcactgaaatcccctgaacaaggaggtaacccccagctgctcccaccaggttgtaccgaaactccactggcaacttcatcagcctctccaatggccacttgttcgcgccctcgggatcccaaaccacatagaacatgtcgaatgtgctgtccaatatctcgtcaaccatggcaaacatcccaatcccgcctctcgctgactccacgattgcaacctgctggatttcaatcagttcactggatgggaggttgatggtggatagttccatcgtgaaggtgtccagcacaagtagtttcttcgcccaacgcaagaaccagaagatgcagccgtgagcatggtggcgttgggtcaatgcggtttcctgagatggagttgctgcgaccaaaatcccccatccgtcgtaggaggtggagctccattgttgggtatctgaggagaaggtgaacacgactagcttggactggcatcgcgccatgtacatcaccctgaatgacgtgccgccgccgccgtcgtcgtcgtcgtcgcgtggcggagcgaagaagggctgtaaatcgaggaggttgtggagctgggcggaggcggcgaggtcggcggggacggcggggagaaggacgtagcgtctggacaggggatcgcagacggcgaggtccatgaagccgggatcatcgtcctggccgtcgacctcgccgccgccgcccacggcgccgcgggagaagaggacgcggccgtcgaggacgtcgcggcggcgccagggatccggggacgaagggaggaaggggcaggcgaagtcgacgacgtcgcgggcggctgcccccgcggcggcggcggcgctggggtggggcggctccgcggggacgaagccgccgccgacgtcgatgaagccgagcagcgccggctggttgtcggcggcgcggaagcggcggaggaaggagggctcggtgatgacgcggcggaagccggcgcaggcggtggcggcgcgggcgaggtcggcgggggacgggacgcggacgaagatctccctcaggacgtcgtcgctgagaaccgccagcggcggcggcgtcggcgtaggcgtcggggcagaccgcgccgccggcgagggcgtggcggcgttgggcttggccgctcggcggcggcggcggcggaagcaccgcagtttggccagccgctttaggagaaactgaaggttggccattagacagattggtgtgtgtgggatgcgtctaggggtgtctattgtagtacgtcactgcgtgcaaccagctagccatgttaaagaaaccgggagtaaacctaagtacctaaccggtcactggttcagggttgggatctcttcaacttgaggatatgaatttatattcaaatttttatttgtaaatttatcagctggttagctgccaaagtgttagatttgtaggtatgtgatttgatatgatagaatccagtaaaatcataattttagaacctagcaacactagaacttcttgtgagctttttaaatggcggtgccgattgttacaagaggggttgaactttgatgctaatatgcattctattcactcgaaaggttagaaacccttatattcatatataatttataacatgaaatttatatgtttgaattagattactcgtggtattgaaaatcacgtaaatttatgtcgtatccacttagaatgtgtcataaaacacacgcctacaagtgcaaatgcatcatcattcatctatctatccgtttatctatctatctatctatctatctatctatctatctatcttggatatgactcaccattcatctatctatctatcttttagtgtgacgcaccattcattaaatggactaaatcaataaccccttactttttcataaatgattagtgtaggtgacgtgctcctttagcgcgcaatgccaacttaacccaagtttgcgtgcccgataagtttttatcaacaaaagcaccttttcttctcaccgcatataaaagcaccatttatgtgtttctataatctctttctcgtgcaatgtttctttgtacacacactttaactttatgacgatataagatttctatatgtgtttatccgtagttatatttatgtatcattataattgcatatatgattggttaatggtatgatctatatatatgtgtgtgtgtttggtctgatttagtatcatgctagaattttcacaatgcacacatatccttatgtttttagctcatgcccatacatatgcggtctctttagatgcaattggcaaccttcaagatggtgcccatccagacaataggacactcggttttcacattgcgtgactcgccgagttgctctgtgagacagcccacgaggccagatggcgtcagagtccatcacacgataaggctaatcggtgtgccacagcaactagatatgcagttatactacaaagtaaagtaaagagaagactaagacatgttcgagatgagtatgatctcttagacaatacaagattagattatttaaagaccgtgcttttacaataattgacgtaacaaatactctaaccattaactcaaaaaaatattattctattgctattctttcctttttcacccttatacaaccatgtttccaatagaggttatgagtcattattgagccgttgttaccatatagcaacggtattttgtctctcctatttatctctcttccatattaacaaatattcataattagcaacactaagagacatctattaatgaccattataaatgccctaaaatgagctagtattactttgttcgaatgactaaaaaattaccttattaagcaggtaaacaagagagttttatgctgcctgttgatcatggtggacgtagattataatggtttataaaaatatacaattgtacttttgtagatatatagaagcaggcgttgtatattcacgattacggttgagtaggatatttggctatttccattcatatagaggtgaaaaacgtgttctcaacccataatccaaattaaggaatcaactttgcgctctctctttctctctctcaacacaaattgaaaatgcaatatattgtgtttcacatgatcttcattggaaaagagaaaactatcctgaaagaacatttctattttcaactgagtgccattccatgcatcagcacctgtcatcctatttcattgagtactacctctgcccaaaatacagtactacctccgttgcaggttataaaactttctatcattgtccatattcatatagatgttaatgaatcttgacacatatatatatctagattcattaacatatatatgaatatgggcaatgctagaaagtcttataacctattaagataattttattgtcattacctacatgccattgccacctataaccaaagttgatgaccactgctacatataaaagttaaaaacactccagaagtgataagtattatcatcgtagcagcatagatatttagatatctgatgtatcaaccctacattgtataataatataacacagcaatttgaagctcttataaacctccaagatgtagtgtgacgtcagtggctagaagctgcattggtttgtcagacgagaccgagaaacttacagacaaccatgcatgttatcaatccccattgtcacgatgtgttcatgtgaccagcactcatctacatgaattatgtgttgcgcgctgcttgctacatatggattaattcaacttccaaagtgaattctggaatgcaaactcgtaagtattatctctcctctctttttttttatccccagatgtaacgaagcatatattactggtgtaacatgaatctcccgatcaagaaatttgtacgagccgtgggatcaagatcatagcaacatttacacatcttctggctgaaattcttctagagatgaaccgtgatttcctatttggacacagacatctaattgcagcagaaagaagcaataaaacaaaactaggaagcgatttgctcaccaaaagaagtgaggtagttagataccagatatctaatggaaactctgagctccacacgcagcacattagcttggaaatggaccagagctctgctacgaataccagcacagcattcgcatcatcagtgcatatcagcgttcagaagaaagaaaatagtttgataacataataagctagctagtacctagcaagcagcttagatcgaaacacaacgaaagtgtattataagtctggtaaatatacctagccatggattagtgcttaacaagtgtttgacaggtaacgtgaagtacttagcaaaagcaggcaaaggtgaactagactagcctagcgcgagtgcagacgcagcaggaccacagatcacggctattccccaacgaacagcagcagaatagtagaattcctgcaaatacatatagtaagaaacaactgttatgaacatgataacagatttattaatcttcacagtttaatactcaccgaaaaaccatacattcaagatttatagttaaactataaatcttttttttctgaaggtcattaaactgtgtattaaaaggatagaaaaaaaaatggacggcactgcatacttttgaaatcttgaaaccaaaatggagtatgataatttcagtattacatgcacaagcacatgtatttgtgtgaactgatgcacactgcacgatgacagcaccagttatttagcaaacatggcaagacctatatgatggaggttatttatttttaaacgggggacctggattgcaaagggaacactgacttctttctgaacatcggaacactaccttaagctttcaacgataatatcatgccaatcattttcccaataacatgacctatatgtgcccaactgttgccctacaataatgaaaagaaaaggtacataagcttatggcaattttttagatgaatattctgagactaataacttctgggggtctgggaataaatttactttcatataaaaacttcagttggctatttgtagaacaagaacatcaagcttaagggaatttgttgggagtacagacaacaaacagagcctataaaaactcacagagttaaggcaccctttggtgtaatacaactacatgaggactagctaacaataaggaaaatgtattttcaaaaaatgaatgtctgcagtatctcccaactcccaacttttagtagaacattgccagcgtatctgttatatgaaggctaaatgatttgcaaatttactttatcattcgaattaactcaaagtgtgatgacaccagtataattgttcaacaactcaacaagacattggtcattgtcgtattctgctattcagggctttgataagcaatcagcaacacaataatttaagcactaatggctggcataaactaaaaataacctaaagcagtaatgcatcgtaaaatgcatacaagctctgtgatggccatgatgcgcagaacatacatatataatgttgctgcaactgcaataaggtctgtacaagattaagtaccagtacagactagattctaatacctgcatcacaaaggataacttctttgcatgaagcatatgccaaacaaaaataaccaagaacatgagcctatgagacaaaagaaaataccatttcataagcgcggtggcgacaacgatggtgggtaactggtaaacaggttagcagttttgatggcatggttagtcccacaaaacctctcaacccgaaaagtcttgacctccaccgaaaaacaaacatgctccggcacctctgacgaagattctgaggcctgtgatgatccattttgacgcgaagaggcctgccatgatgattttgaaccctttggaatcccttgcaggagcacgtaacccccatcaatccccaggagattttcataccaataatttaagggcaactggatagcctctattacacgccattgcttcactcccttatcattatcttgccaaatagcataatagaggtcaaagctggtataaaaattgttgatgagaacgaacagcccaagctgaccttcctctgtctccaggaatacaatgtctttcttccagctgccgggaaccatctcaattgtggacaactgatttgttgtggtgtccaggatcaggagcttgttcgcccaatccaaaagccagcagatgttgccatgtacatggaatcgccagaacatctcggcgagccaagtcgatgtcccgttgatcagagcagcccaaccatcgtactccacggcgcgccattccccagcttcccaagggaagataaacgccatcagcttggtcaggccgcgcgccatgtacatcacccggaacgaggcgccgccgacctcgtcctcgtcgtcgtcggcggcggtggcgggggcgaggaagggctcgaagcaaaggaagctctggccctcgagatcgagggggtcgattaggtcttgcggtatttcggtgaggatggcgtagcgccctgagaaggggtcgcagaccgcgagatccatgaggaggacgtccgcgccgtcgtcgtcgggggcgtagtactcctcctcgcgggagaagaggatgcggccgtcgcggacgtcgcggcggcgccaggtgtggcggtcggggaggaaggcgcaggagaggtcgacggcgccggcggcgggggcgctgcggtggggcggctcggcggggaggaaggcatccgcgtcccgggggaggatgccgaggagcggcggcgggtagagggcgcggtagcggcggaggaaggaggggtcagtgatgacgcggcggaagggcgggcaggaggaggacgcgcgggcgaggtcggcgggggtgtcgaggcggatgaatatctcttccaggaggtcgtcagtgaggatcaccgaaggcggcggcggcggcgccggtgcagggttttggcgcggcgaggccatcgcggcggaatgggagtgaggagtggggaggacggggagtggggtctgaccaggtcaaacgtggttaggggtattttgggtactttagactgaaaacaagagaagatgaaacgaattatgggaatctttgagaggtaaaggcataagcgccactttaatcctgttggataattttctatgaaaacttttaaaacaaaatattaaatcatgtcatgttgtgtgaagtttcgatggaatgaacaaccatatagaaattttagagaaaacttaacaagagttctaatatattgaattttttttaagtctacctctcttattcgatttttgttttttttctactatccaatcaaatggtctatcatgtattttataatcctctattttatactcctaaattataattacattcatgttagaattgtttttatcctaaattgttcaaatcaacaagaatttattgaatgtcaaccgatacacaccccatgaattgaactcttgacacaaattcttagagaatattgtgcaatattattgagtttgagtctatgtaatgtttatccaattctatactctcacaagttaaaaatccacaatgcctactatatatacggtctatcaatgcaatcgttttgttcatgtttatgtgccaaaatttaaatttttaaaacttaattttaagtagattatatgttttaaaaataatttattttaaaatatttatttttaatcaataaggacctatatataaaatttttactcataaattattttttattagctaataagccatatggataagcatagcataccctacactgcgggtggttgcgattgccatcttcctaagctgccgctgacattctcttcaacgccggtttatttgtcgtcccccatgctgtggcagccacgctcaccgtctccactgacgtcactctagatatgcctcctattccaccttctgccgctcctatccaatttatacaacgaggctagactcggacgagtcgctcattgtctccccaaacatgaggaaaggaaggagagtggggaaagcaagagaaaagagagagaggagggtcactaacatgtggtcccacatgttgacttagcggctaaaccaggttaacgtgccacgcaactgaaaatcatcgtcaatactactaggagagttattcttcattggtttaaatagttagagggttgatatgtccggttttacggtttaggaattcaaattagattcctatctgagtgaaattggactctttgcgctctcttcaccatggcttcctgccacacgaagccgagcttgcgacggtgccatgtcgaagagtggggagcttccctctacctcgcggaggacagcgccgatcggcgacctctgcgtgccagttgccggttactgggcgccggcggtgggcaccctcgaaaactgacggggcaacgcgcacgaatgaaggcgatcgagaaaattccttatgtaccctaaaatttaagctaatcccttctatgcccttgaattttgtttacttccttgtatacccaaaaatttaattttgatcccttccccctctcgtcagttgaccgtctaatttctagaaaaattaccattttaccctttggatgtatatacaaatttatgaattatattattggaaatgtaaaagtttgtcgcattagactattatggttatgagtttgatgtgtgatacattatttattaaaaaaactatttttagataatgaaataaaaaataatgtatttattttattttaaaagtcataaaaatgaggagcattcatacaaaaaatactgcgaatgctcaccatattttttttatgaatgatcccgataaagaaaatctattgtcatattaaatttcaaataaaaattttactttattacatttgttttcttttcaaaatttatgtcaaaattttccgcactaattatttagtctcattttctacctaaaatgcatatattgtgcactcaagcaaaattttcaatcatttttcaagcttatattcaaatctaaatcatcaagggcattaaaggcatttgccatcaacttaacagttaaataaaggaaaatgtgatggcaggtcggcaggggcatggaagagataagttaaaatttcagagatatagaaaggatcggataaattttagcggtataaaaaggattgagcgagttttcaaggatatacataaaatttactcaaatacgaaggcctccagttcctcgttgccttccgccgccgagccctcgccggtagaatgctgcagcttctcttggattcggagggtagaaatgctcgctacaaaatactctgatttttaaagtttactcccctgattgaaaaaggaaatctgattgaaaaaggaaatcatgcctctcctgatcaatcgtgtttgtgctttggaagctcgagcacgtatacgtgcagagtttgggatcggatggagaagtccaaagtccaaaccaaaccggattcatctcgttggcgcgcgttggggaagcagtccaatatgcaagcggactcctccgcttgtccttctcttcctcatcgtcttggtggccgctgagtggacggctcgacgccgtcgccggactcagtgtcgtcccaactccggcaccggtggcagtctcggcgttgagatggcggctccttcgaatcgaaagcggaagcgtaggtcagccggagccgcgggagcacgaaagagggctcgcaggcacagcgtcgttaaggtaaaactacaaacccaatcccctgtcgttttcatgttgaggtgtactccctctatcccataaaaacaaatcttgaaccgaatatgacataatttagtagtacgaatttgaacattttcagattcgtagtagtactaggatgtatcacatccagtaatagattgattttttatgggacgaagggagtatgctagtaatagggaattttgcttctccaattaatcctacatcctagtacggcataatgttgttcattagttgatcagttcggcttattgttatggttgttttatgagtgaaattcgtagccggtctttaaacttgaactggtttgttacttaggtccgtgatcaaataaattgcatatttagatatatataattctagcttaaaatatcataatgggtcgaaagtgttgaccgatcttaagtgcccacgtggttgtccacgatagccaaaactttgcattcaacctcctctgaaaaccgcggtgacaaaaaaggaaagcatatagccccttctccctaccgtgtacatccaaatatccattcaactccttcttccactacatttcaccacttcgactctacacatgcagtcagtagggagggcggcgattgggctgacgctgacaagcgtcggcaggccaagatgctttggccggagtgataggtggcacacgataggcggtgcaacatgttggaatagtcagcgggaggggttgggggttccgagttacaaaaacgaattcaaatgtctatattttggcttcttgtcttaacttaactctatgggtaacaagtactccctatgtttcatattataagttgtttaactttttattagtcaaaattatttaagttgatcaaagttataaaaaaatatggtaacattttaaatagaaaataaacatattatcaaaatatattcaatgttgaatttggtgaaattaacttgacaacattgttttttttaacgcaggcaaacttacaacattgtcaaacctaaaaaaacttagtaagaaaaaaggtgaaactacttataatatgaaatagagagaatagtaacagatgttttttttcctaccacgcagctacgaaaacagcatgaaagcacatgccacgataggataagtgaactacccgatgacctcttgaccaccattttgggccatttggacacaaggacatcagctgcaacaagtgtgctctcaagaaggtggcaacacttacggaaaagcgtcccaaagcttcgattctcacaacatgacatattgccacaaacagaactatctcattttctgagggcccatgaatatgtttttttcaagccatcgctgtgcccatggaagcggcgggtacgagctaatccagagcgccttatcaggtactccctccatacttgtaaaggaagtcgtttaagacaacgacacgatctctaaaacacaactttgacttcttttttctataaaaatatttattgagaaataatataggtatacttttatgaaagtatttttcaagacaaatctattcatataatttttatattttcaaactcaacaacttgaaagttatttatgatttatattcccaaggtttgacttaaacattgtcttaaacgacttcctttatgagtatggagggagtataaaattgaagctaaacttggtaccatctgtcagcgatcttgaaatgaggcaaatcatattttgttttattatgtttcagcaatacttaagtaaggtaggcagtatgtatgaaactaaacggtgatataacattactattcactgattacttggcaggctagttggcaggtatagaacacgtatattcttgagtttgttaactggctatctacacaaatcaaatgctggtgacaagaacggcacaaaaatctcaagccttgtcttgtgttgcaccatggaggatttttatgccaacttgattgacaaattgatcagcattgcaatctgccgaggagttgaacatctgaatctggaaacatacttgtattctgctaatgatcaaagacctagcccagctccgtacaagtttcctttatccttgttcgctgatggtaagggattatctgtaacgaaactcatacttgccgagtgcaccctcagtattcctgtcggctttgctgggttcaaatctctggttgagctatcgtttactgaaatgcatatttctgaagacatgattcagacacttattgaaaattgcccaaatctggaatgcttccgtcttagactttgcagtggtgctagacatctcaagattgcatcgcctcatttgcagctcagagaaatcatggtaaagagttgccttcagattacacacatggagctttttgcacctaagttgcagcaatttacatacagagggccatgcatatcaatggttctttcctctgtgcccttgatggagcatgcgtgcctggattacgaaggtagaagggacggtgaatctgtcaagtatattttagggaagttgtctcaagacttttccctacttacaagcttaagcattgtgcttaacacttatcggttgaaggtgtggagatatatttgctcttctttttagtgttcattgtggttgttggtcacacgagttacttgaacattctgatttacactaatgctgtttctgcagaatccagtaattccagaagttgttcccacgccatttaagaacctcaaaagtctcacgctgggtgcgataatgcactgtaacgatgacattggttgggtaactatgctgctggaggtggcacctgtccttgaaagttttcagatagaagtatgatgaaaacttcgctttactagtgattgcatttattagtttgaattactatctattttcattgacagtcgattagttcgataagagttataaatttacatgcatgtgtactccttttgcttatattttaaatatttcttgtacatttttactagggtcttgattcatgatacataatgcctgaaacagttagctacaagtattctgaatcaccaagtaaacaaatacaaaactaacagcttgtggtagctcaggcctctttagttcccaaaaaagtattttctaaaaacatcacatcaaagttttagacatatgcatgaagcattaaatttagatgaaaaaaactaattacatagttatgatagaaatcgcgagacgaatcttttgagcataattagccataagtgctacagtaacccacatgtgctaatgacaaattaattaggctcaaaaattcgtctcgcggttccaggcaagctatgaaattagttttttcattcgtgtccgaaaactccttccaacatccggtcaaacgtccgatgtgacatctaaaaattttcattttgcgaactaaacagagcctcagtctcatatgtccgctcgctctagctcaatttcatgtttgaagaccttagtgtttttttaggaaaaatactaccagaccttgcttagcagtgtgattttataaccaaagaaaacataatagttttatacatgtatataccttagtttttttttgctttgaaattcatttattagcttggatagcaaaatggtgtattttccctaatttctcgtaacactctggacgtactaacccttgtcatatatttttttctgggaagttatgcatatatattgaagtgcagcgagaacaatgtatatcactaattcaccatggaactaacccatgttttgcaagtgcagcttcttaccaacgagaaacgagaacacccaggcggcgttctgtgggagccatcagacaacgcgcaccgtcatctgaggcaggtgaagttctaccgcttcaggatgagacaggctgatgttgcgctggcagggttgcttctggcaagagccccattgctgcagaccatgacgttttcccgtggatctgttcatcgctctcccggtcagaccgctcagtacgttgaggccgccgccgactggaccgcggagcagcgatctgctatcacacggcggcttgagacatgcaatgcttttggtgcaagattggaattccggtcatgatgttggatccccgtcctaaaatacactacctcaatgcatatatgtataaggttggctagtataaatttgaactagccaatgtcatataaaaaaaactggatagagtagatgtttaggaaatggcacatcctaatataatatgaatctatatatcattgttgtttagatttataatactcggatatattgttatactttagaacatatataataacttagtagtctagttgtataattttgcgtcattatttcttcgtttatggttgggttgtctttacgtcgagatatgtgctaattatcagatatacgatttcacatactatagtatgtgccgtttgaatgcagaggccggtattatatataaataatgtattatatataagttaaattcgtgttggtgctgcactgcaccagctcctcgctgcgtgaccattccgtttctcttcctatctaaactatggaaaaaaatagagtaaattttacaaaactacagatgctataattaaattatcacaaaactacagatttaattcggtgtatcataaaactacacatttaacaccaaatttatcacaaaactagatatttaagatgaagtatcacaaaactatatgtttagtaactaaattatcataaaactacaagtttagaactaatttagttacaaaacaataatatttatagctccagtataataatggtgctagggatttaaactctaatgttgtagttttatgataattttaatattaaggggttgtttggttggctcccaaagtttgccaaaggttgccacacctcatgttagtcaagtttgaccaagttagcctattgtttggttcataggcacacttgtggcaagattccttctcatctatttaggcccccacatgtcatcaacttagtaaaatgtgacacaatccaattttgctagctaaggtgtggctcattttttgtaagccacaacttagggcctatttggggagctttagattctgagaagcagctgtttggtagccaacttctgagaatctagaaaagctctgaaacccagcttctccagcttctggcttcttagttcatttttcagaatctgtaactacagattctcaaaagctgtggactgtttggggcagcttctagcagaagcagcttttgagaaaagctgcagttgggacaatctcccccaaacagggccttagacaagtgtggcacaaaagtatggtgaatggtggcaaacttagtatagcatccaaacatgcaattttgtgatacttaacttaaatatatagttttgtgataaatatgatgctaaatatgtagttttgtgatacaacgccttaaattcgtagttttgctatagtttgattaaaaaaaatatctgtagtttcatggaatttacttaaaaaaatcaggagcaatagtgcctcatttagaagacacgatatttaaattaagggaattcgatttcatgtaaaaaaaatcagagataccataattaattaaataaatcctgagaggattaaactattttcatatagaaaaaaaaaatctgctactaacaaattcgtgcgtggcaaggacggaaagagcccaaaacgaccaaaaccggactctcccgttcgcgtttgaggagcacttcaaatttccgaaggactccactgcttatccttgtcttcccccaatcatctcgcccacgctgaattctccaattaattttccgcccacaccgtcgcgcacccagttccgccgccgccgccgccgcccgccggcacagcgcccgcagccagcgatggcggctctaccgaggcgaaagcgtaagcgcgggttaggcaaagccgcgggagcacgaaagagggctcgcgagcagcaccccggtgtcgccaaggtaaaattacacgcaaaaaagcatctaatctgttactgctagttctgaattttgttttatccagtccaataaatcctctgccccttctagttcagtttaaccctgcttttacgcactttgatccaatgcaactgttttttttttgtaggtaaaatattttggtcgtaatatattttactaatctagattttgaccaccgagttaatccaatgttaacagagagtatttggaacgtggtgtgtagcaaagtaacaataacctcttctcctgcagcacagctacgaaagcagcatggaagcacattcgaagataggataagcgaactacctgatgacctcttgatcacaattttaggtcacctggacacaagatcatcagcagcaacaagcgtgctgtcaagaaggtggcaacacttgtggaagagcgtcccaaagcttcgattctcacagcatgacatagtgccacaaacagagctatctcgtttcttgagagcccacgaatacgttttcttcaagccgtcattgtgctcatgaaagcggcgggtccgagttaatttagaccgtcgtatcaggtatgatattgaaatgctaaacctggctttatctgacaacataaatctctttagtaaagtagtctatgggctaaatggtgatatgacaataatatttgctgattgcttgacaggcttactgacatgtatagaacacgcatattctctagctcattaactggcttcctacacaaatcaaatgctggcgacaagaacaacacaaaaatctcgagccttttcttgtcttgcaccatggaggatcgttatgtcaacctggttgacaaattggtcagcattgcagtctgccgaggagttgaagatctgaatctgacaacgagtttttattacgatggtcaaagacgtagcaccactccgtatgaattccctttatccttgttcactgacggcaagggattatctctaacagaactaaaactttgcgagtgcaccctcaatattcccataggactcgatgggttcaaatctttggtcaagctatcattaactcgaatgcctatctctgaagacatgattcacacactttttgaaaattgtctgaaactggagtgctttcacctcaaccattgctggggtgctaaccatcttttcgccgggccgggtgctaaccatctcaagattgcatcacatgatttgcagctcagagacattatggtaaacagttgcgaacagatcacacacatggagcttgttgcacctaaattgcatcagttcagatacagaggtccatccatatcaatgatgcttggctcagtgccctccattgagcatgcctgtctacactacgaagatagcagggatggtgaatctgtcaagtacattttaggaaagttgtctcaagactttcccctacttacaagcttaagcatagattttgacacttacgagttgaaggtgtgaaaaaatactctcttttttcttttagttttcattagttgttggtcacatgagttacttgaacattctgatttacaatgtttctgcagaatccagtaattcctggaggccttcccacagcatttaagaacctgagaagtctcatgctgagagtgacaatgcactctaacgacgaccttgcttgggcaactatgctgttggaggtggcacctgccctcgaaagttttcagatagaagtatgatgaactctgctctagtagtttcattctgtattatgaccttttagttaatattttttccgttgataacttaggtcagttcgatataagaacatataaatttactcgcatgcactccttttgctctcattgcccaaaagaatgcttaatgtttcgcctacaaggtcacatgtaacatcagttaaactgcaaaatgaaacaagtcctaattccaagataaatgttatcataagtaaatctttataagactaaactaattcacctgaatgaatcttgtgtttgatgaggtnctgtaccattggttaatcaattttcaaaggggggcat

SEQ ID NO: 14045 - DNA, 739 bp, Oryza sativa
ccgcgggtgattcgcgttttctgctagtagctcatcacgaccatacagtgcttcgtaagaagccatctgaagactagcttgataactgttgttgtacgaaaattctgcatatggttgattcttatcccaacttccaccgaagtctaaagcacaagctctcaacatgtcttccaaaatctgatttaccctttcggtttgtccgtctgtctgcagatgataagcagtactaaagttcagcttagaacccatctcttcctgaagcttcttccaaaaatttgaagtaaactgactacctcgatcagacactattttcttagggacgccatgcaaacacacaatccttgccatatacaattccgccaaccgacttccagaataagttgtctttactgggatgaaatgagccactttggtaagtctgtcgactatcacccaaatagagtcatggcctgatgacgttctgggtagaccagtgatgaaatccattccgatttcctcccatttccattcaggaatcttcaaaggctgcagcaaacctacgggtttctgatgttctgccttgactcgctgacaaacatcacatactgctacgtattctgcgatttcacgcttcatacttgcccaccaaaatctttccttgagatcctggtacatcttggtactaccagggtgaatggagtataaagtatcatgagcttctttcagaattgcatcttttaaatctttgttgtcggggacc

SEQ ID NO: 14046 - DNA, 10350 bp, Oryza sativa
  unsure (1)..(10350): unsure at all n locations
cgggntttgactatcanttgttcagtattccatcatctattttataataatctttcacaataatctatctatttatttcaaattactcatgataatttagattataataatcttaagttgaaccaaacaagtccttagacatgtccgtatttcctagttctttaaacataacgccatcttattgcgctaatataattgctatgtctgtcaatattctaatactatgtaattatgcgagtttaggagaagcatccacatatggtcatgtataggagatgtaggccctgtttagttcctaaaataaaaattttcacgttgtcacattgaatgttttggcatatacatagagtattaaatatagggaaaaaaaaccaatttcacagactgcgtgtaaattgcgagaggaatcttttaagcctaattgcgctatgatttgacaatgtggtgctacagtaaatatttgctaatgacgaattaattaggcttaataaattcgactcgcagttttctggcggaatctgtaatttattttgttattagactatgtttaatactttaaatgtgtgtccgtatattcgatatgacaactaaacttaaaaattttccccaactaaacaaggcaaacaaggctgtagtattcggttgaacatcataataaataaatattgtgcttatgtgttactagtacgtctggatctaatctcctaaagcgactgcattgtctgatatcgatgttgatttcgatgccggttttgataacaaacatacaaagtttcttagtaactaaggatattattagtatgatggtgtactttaggggattaagggtgtgtttttggtttgtctgagctccaatatcatacctttcgttttttatgctgacgttttttaaacagttaaacggtgcgttcttttttaaaaaaaattatatgaaagttgctttaaaaattcatattaacctatttttctaaaaagattagctaacaattaattaattatgtgctaatgtgtcgcttttgtttttgcgtgatggagggattaatgactatataccgatcagctacttattgaagtctccgaagctttattaaacatggcaaatgttccgtttgaaacaagtcctaattcctgtgacaattaagctgatttctgtacaactatttatagaactcatccgatctaggggtatttggatggggctaaaaatttttagtccgtcacatcggatgtgttgacactaatttagagtattaaacatagactaataaaaaattaattttataaatgagagataatccgcgaaacgaattttttaaacctaattaatccataattagcaaatgtttacaatagcatcacataggctaatcatggattaattagtctcaatagattcgtctcgcgaattagtccaaagttatggaatgggttatataattaatctatgttgaatactataaattaaagtcgaaacatccgatgtgatttaatccatatgaaccaaacaggacaatttacagaagaggttatctagggactgaaacactacaacaaggttggatagtcaatcatactcataaagtcataagcttacatctagctagctagctactccaaatctctgctctgtcaaactgtaggtaagacatgtacttcattcatatcataaccactgttacccatcctgtatccctaatcaagttgaaacagtcctttcatggttgtatgatctgacaacctgcctcgcgacgacgacctcccatatgccgcatacgctaaccgtgcttaattgggcgctgtttgcagagcagaaccagtactctgccatgtccccggccgtgctcctctgcttatgccgccaatatacaatcttggccaggacaggccagagagaaatttgcaagatctacctgaatacctgatcatttgcaccggtcaaaaatcgtttttaggtcaaccaaatacaccaagatgatacaaaagcactgaacacacttccggcatttgcatatcggtatttgtataattaggatgcacacagccaaaccggtaaaaaaatcgtggatatataccatgcattcatgggattatttgtgttgttttcgtgtccggccttgtgatccaatcatgctcatgcagaactaatgtcaggtcgatatcaggtttgtagtagtaggcatatggttcgatcgggtgtaacgtacgtgcgagtcccgtgatagagcatggtcctgtatattatgtacagatgtgtaaacaaaagttagtggtgcccaagtatctggataagatttgtgtccgtttgttggctcacgtacatgacaaaactgataggttcagacaaaatagtgcacgaatacaatgttggtcgatcaatgaaaggacggcgcgtgtcgtggaaaacaactgtgcataacgccaaataaaccaagttaatatccatgtgtggtgtgtgtgatccaaacgtgcgtgcatctaggctcgtcccttttttttcctcactagcttgatgtctcaccaagatctggtccacaactctagcctaacgaagctagctgttgcatcctacgagtgctttttggaacgtggaaattttataggattttcatgtgaattagtttgatttcttaaaacctctaaagttccatttttgcaaaatgaaaaagaaaaagaaaaggcccaagggttattcttttacgtttattctataaaatatcagaatgtaccgtgttttctgctgcctacaattacaagacaacaacgtagtgaaccattttttcctcttatgcaagtaaagcaagatagaatttgttcctcgtagagttagccattgggtcagaccgagcgatatgatctcggtcttcactctttagggaaattttggccatctaaaacttaagaccgaaacgcgttacgaattacaaaaatcaatatccgttatgaccaaaatcgtcaacaatgttagagatgaaaaaaattacagaaaccatcaacaatttcaaagatgcaaaagaacttacataaataatcaaataacaaaaaaccgttagcatccgctctagatctccacctcgcaaccctccacatgtcgccagcaccagcgcccttctccatcaaagttgcttgctgcctgacccctcagtgtaggaggttgatggagagcatgttggcggtggaagggtgcacccctcacccatggggggtttataacctgaaatgaagcatgttggagaggaagtgtgcccgatgtgcggcctacgccaaaggtggagaggaatgtgtcgagccagaaagggcatcctcttcactgagccggcggtcgaggcatcaccggatcttggagaggtggaggtcatgcgcgactagcgaccacgcagtgtcagggatacaaggagcattggaaagggggttatggtagggctgtcaacgagccgagctcgagcgagctcgtctgcctaagcttgagctcgacacgagctcgagccgagctcgagccgagcctattgcaccttcgagcttttaggcaagctcggttcgagctcgttcgagctcgagctcggtgccgagctcggccataagtagtataatatatattttaataataatctcttgataagtataattattttctagttaatcacactaataaaagagtagaaaatgattaaaataaatatattgtgctaacacatgctaatttattgtgtaaatagatacaaatatatatatttatctattagtttattatattaataaggtgaacatgcaatatagactatacacagccaagctcggtcaggctcggtagaagctcgagctcggctcggtaaagctcgcgagcttttgctcaggctcgagttcggctcgtttggagcttgagccgagctcgaatcgagcctaggacgagccaagctcgagctgctcgggagtctcgagcttttttgacagccctaggttagagtcttaggattcattgtgctctattaggctattttagttaatgcgataaccgaaaggtgatgaataaattagccgaatataattccgttagtaagaggttgaaaccaaattaatgttcaaaattttctctatctgtcttgtctctcccgtttcttttggttttggtctgttttgcacacccttatttgtcgatgcaatatatgcatgaatgcttaatttgtatattgattatttgagtcaatggtactactagctagctagtactatggaaatttggtgtatctaattgtctgcccttgcaagtgatgcgaaaaacaaacgggaaggtgacgacgggtttggttggctttgtgtttcccgaagccattggaaggcagccaaggtcttttcactaaactgtgtgtgtgttgttgtgtactgtactatagtgttctgcatcgtttgcctgcctgtcttggactttggtttttccctgctttctttccttgtccttcacttccctgtagagtatcttcgaagtcagagaaggagagtaactaaaccaaaagttttgtacttttgactgcacttacgataggcacgttgtactatagcatgcaggccctaaacaaaacagagcagtagttggattacattgttaacattgctttgcttgtacgctgtttactgtattattaagacttggggcaattctaggatcacaaatttcagagaagatggaaccaatactgtcatgcatagcaggacaccggtaaattaatgtactgcaaatagcaactcatcagccatttcaactatctccgtacttagatagcaaccaaattatcaaattactagtacatagtaatggtaactatatttggaaacagagacagtaacttttagtgacaatcatggtgatcacctaacccatgacaatgagatcatccctgcatgccaaagaatgcagaagcactagtttacataggcattgatcaaattttgggagtatatggtttcaggactgtgcaactagattcatagtccatgatgtccacaccgcgcagcaatgtcaagaaaagcatagcgtcaactcgacacaagtgccttttgcttgtagtagtagcatactatacaccttgcttttggggctcagcactcatgatgtagcatccgatggtgagggtggatttaaagaagaagggttggggaaagcaaaggtcttcatgctactaagccataaaagcgtgcaagacccatgcaaaggtgtgtgtggtcacgccatggaagcaaaggggggttaaactgaaaatgttttttgcagggaccaaagtgcatttataagggtgccaagacattcatattgaccttgggggaatttagcatggacatattaatttgaccatagtttacaatgctgacagctcagatctctagtaggctttcttttacatgtatgttaccctaggggttcttgctctgttgctattctaaggatgcaaaccccactgtatggtgagattgaggcgtgaatgaaatccagacaaaaatgtttcactttcaaattgtggtccaaaaaggataaggtccatagtgtgccaattcttttgatttcctactgttagatttgtcgcaatggcgcgcatcgatggtcggtttaatatagaactccctccatccaaaaataagcgtagccataagttttcgtcttcaacttagatcatctgtcttatttgaaacttttttatgattagtatttttttattagattgtaaaacatgaatattactttatgcatgacttatattattttagattttctaaaaaaaataaataagacggatgattaaagttggacacgaaaactcagggctgcgcttattttgggaatgagggagtacggagtactaatatcaaaccacaatgcacggacaaaaccactccaaaagctaggtggaatccaacccagattcatacttataaatacatatgcaccttcatctcacaaattcatgccgttttaggcataaatagtacatcaaatatccaaatcatttttcaaacattttggacaacaaggaaggtagcccgtgcattcgcgcgggcatgtatcgtaggttgtatttcaaacactatatgggtggaatataaatcaaaaaacattttcaaaatataaactggaaataaagcccacatagatgcattgacatcttatttgttgttcaagaaaaagaatagtaacataaatcatatatcattatatacactgtaagggaatgtaaattatcttacaataaaaaagaaatatatttgctgtaaaatagatggtatattttaatatactactaaatataagaataagaatatctctcatatttaaataaaaatcattttgtcgtggtcatatataaactcccctattgttattgttttaaatgctatgtgcatttttaataaatgaaactgcattaataccactaaaataaattatatattattaatacactaaaaaatcatctacactgcttaactcgatgtccatcacttattttcacatctatgtataaatagtctaaacataccacttctaccggataatacgataacaccgttaaaaatagtcataaatgtctctctaacggatgaagtcgataactactaaagctttcttatgtaatgcccctgaaacaggggggttcctaatggggcgatcgatcagcacaccacaacaaaattttaaaaaaacaaaaagttagaaaaatttatgtgtaaaaaatttgaattcaaattcaaatttgaatcaggtatgtaaacttttgacttataaactttggatctataaactttagatatatagaaatactatatatagaaaatatttgaattcaaattcaaatttgaatcgggtatataaactttaggtctataaactttagatgtatagaaatactatatatgaaaaatatttgaattcaaattcaaatttgaatcggatatttgaattcaaattcaaatttgaatcagatataactcaaattcaaatttgaatcggatatataaactttaggtgtataaactttagatgtatagaaatactatatataaaaaatatttgaattcaaattcaaatttgaatcggatatataaacttttgatctctaaactttagatgtgtaaacttgaggtgtataaactttagatgcataaatttactaaaataggaaagtaatgcggtgccaaaaaaggaaaccaggtggagggagggagagggaggggggggaatcgatcgccctcgctcgcccggtagcatttccgcctgaaacatgggtcccacattgacatagccgtacacttaaagaccagcctatggcaccattttaacacttagtttactatgggcacacctacaaaggattgcattagtatgccacttaactcaaccatatgcaaatgcctgcgatatttacgatggcatagtaaacactacaccctgcattgaaaggacagggatggacaaaaaggaggaggtgatgaaaatagttatattttttgccccctagttatttctgtgtggtattatttttttaacaaaatcatagtttaaagatgatcataaatataggcagtttggttttccatctaataagtgagaaagaaaaaaaaggaaaaaaataattatgtgggacgtacttgttttttttgatacctatacgtgcacatacaatgcgagtttttgagataaatttaattgcattttttataatagatctaatggttataaatttgggcccaccgcattctaaaattttttaaagcgccacgtgtttaatggatttttagtagataatagataatagataattgatagattgaagattaggaaagggaagagaagatgaggggagagagggagtacgtacgttacgtaccatctggaggagaatgggaacgtagaggaggtggggaccggtgtggagaggaggattttattttttttatttgatctaatggttgaaaatattggacccaccaatttaaaggaaaatcaacggttagatttttagactgtcacttggcatctttggagcgttcgtaggaggacatgtggcggcttaggagcgcttataggaagtttaatggacttttagtatataataactaggaaggtagtccgcgcaattgcgcgggcatctatttatttctaaatgttaaaatcctttatgatgactgaaaattgtttgtatctatatgaaaagattttgtaaaatgttcaatatatatagttagtcagtcccatatcatgcagtttgttttgatacttcaaagcttgattggaagtaaaaaatttaaggcctagcttgtttcacctatgaacattgatgaataaatctatgactgatatcttcagataatatagaactaattattctttgaattttgatatcactatttttcttaatgactcaaggattttatcatgttttataatggtttcaaattgatcgttcataattttaaatttaactaaatgtgttggcactgattaatatgatatctatagattggttaatcttttagcgtgactccctagcgtgttaacagcctatagaagtggtgcaattgaggccatatatgctagatctttttttataattggtggtttaattgaggccatatagtatctatgggttaattattttacatgaaataagatgaatggcttggtactgtaaaatatcaacaattagtttaagctaatttctttcggtctttggttgttttatgtaaaacatatttttttaaagatctaatgtttaaaattaataggtccatttatttagaagaatttttttagagatgtaatggtctaggtccaagagtcatgattatttagctatctaatattgttttatatagttagcgctagttagaaaataggagaagttaaatagaaaataggagaggaggggagagtgggaaggtggagggaatacataagtgcgcacatacgtggttaatatccatgggtattctgttttctcttacatattcttctattttctgatatgatctagacaacggactgtaaggaaatactcacaggagagaatggttaagttggtcacgtatgtggtgttgttatgagaaaagtacgtattatcgtacttgtatgggagattaggagaggtttatatacatgatattaggattgctatttcaatagatctaatgtaatggtctaaaataacacgtccatcggcactaatttaattgaaaatcgatagctggatgatattttgttactttctatgaatttttatgattttctgtaatttattagagcaccacatgacaatgttggagcatttaggagcatttgtataaagttaattaacttttacttataacaggtgtatgatgcaataactttttgtgtatttatagacctaagttgaatatcctagtcgagccacagaggaggcctcatatgtaagttcgtactcgtccagtttttatatgtactcgtataaaataggagaggatggttaagtcggtcgagggagtatattcgtttacacatatgtagtgttgttaatgaacttttacttatatataacatatatatgatgcaatatatttttagtgtatttatagactaagttagatagatttagtagcgccgcaaaggaggcctcatatgtacatacatacagatataacgatattttaattttttgtttgagaatgaggagggaaggtataatatcgttacttttcagcaaaagacgtcgctttttagctttttttttaacgaattttacatacttattttttgtccattctaatagcacagtatgaaaccgatatctatgcaggaatagcatcgagaaagttcgtttgcatagttacttattaaacctaatcaccaattatagatggtaaaatttcgttgagctgctgctgcctatggattgtacaccaaatgatcaaatgctgctgcctgtggattacattgccagctactgaaagtcaaatgcttgtgcaatcccagtctcatgtagctcattttccccgattaatctgtgtggaggctttaatttgaaacctaatccaagtctaggcggcagcaggaaagctttcctctatcgaggccttgagcccaacacggacgaaaggcaccggagtaggcgacaggaagcgtgatcggatttggggcaagaatttgggtcaccaatttaattaaaaatcaatgacaggtatagatctaatctaacggtataaaataatgggtccactaacttaaatgaaaattaacggtgagattagactgtgccacgtggcgatctaggagcgtttgtaggagcgccatatggcggtttgagagcgtttgtaggaagtttaatggatgac

SEQ ID NO: 14047 - DNA, 17341 bp, Oryza sativa
  unsure (1)..(17341): unsure at all n locations
cgagttgannggctgattcggcttctactgcaagtagctcatcaataaaataatgggtccaccaacttaaatgaaaattaacagtgagattagactgtgccacgtggcgatctaggagcgtctgtaggagcgccatatggcggtttgagagcgtttgtaggaagtttaatggacttttagtatataatagatagatagatagaagatagatagatagatagatagatagatagatagaagatagatagatagatagataatagatagatagatagatagatagatagatagatagatagatagatagatagatagatagatagatagatagatagatagatagatagatagatagatagatagatgattagtgcccttttgaaatgtttacatcaaacataataacatttttattcatagatttgcatggagatatatttcataataacgtaactttatcggatataaaacatggttgtgaaattaatctatttcagtcttcagagagcatgtgttgatatccataaaacacaattgatcataagtaaaaaagggtgaagtgtagcatattgtgtactccattggcccaaacaattcagatttgggaaagtttaattgagataattttgatctcacaaatataacatgcatatgttcctaattaaataggaaaagttttagtttgagaaagtagaggcggtgtgggacgcagttccatgacatgattaatttctcaactactatcacataagccctgaaacatggtaagaaaagttgatagtgttgttattactctgtctaaaatataataatttttagctataagtctagataaatatctaaattcattgctaaacttgttatattttaagacgaataaagtataaattggtataacatggtaggtgtgccatgtcgttctattgatcggatgagaatcataacatgtaattcttacagcctctccgcgcgacaccgagcggtctcgcgtatttaccccgcgacaccgtgcatattgtgctaataatattgtatcctgtatatttttgagaaataaaaaaaatgagtagtatatttttaaacttaattcctctgttttcgcgatcaatcatgctgatctccaatggaacagtgccttccaccttttgtgctgcaagtcacatgacacgatccggaccagatacgtgcgtacgagagcgcatcgatcgatcgcctttgctagatagatccgcccgttgaaaatgcccgaacacccgcgcctacccgcgcgccccccgcgtaccagttcatgcgtgcgcggcactacgtttcgatcgtacgcgcgtggcttagcacgtcgcgacgcccgcgaggccggccggctagcggacccgcccgctgcgcgcacacatgagacggtgggatcgcgaccgcgacgcgtactaacgtctctcgatctctcggtctctcgtgcgaatgcaggatcgagtggcacagagcgtggaggcggggagaggggggatcgtgattcttgccgtggcccgtggtcctcgcgtcgcgtgaggtcgtttcctgcggttgcgcgcgtccgtcgtccggtcgatccggtgccgtcgcgtctgcacgtcccaccaccggattcggtcgcacgcgcctcgtgacaggggccactgcgctgccagccagaccagccatgcctctacgtggtacgtgtacgtccgtctcgtcgacgattcaacacatatcgtcgagccatccagatccagtcgcagtgtgtactggagcatatatgtgtgcgtatcagtgcagtatatatgtgcctcttaactttactgtactctagtacacgtacgttggaggtaattatgagacggttgggttgggcatcgtgtcgtccgcgggcgggagaaaaagccaggaaacacggggatggagagaaaggcgcacgttacgagcagcgctccatagcttcgcgttcccgtcgcatgcatgctgctacgctataccacactgcccctgccctgtgctaagctaacctcgcagaactagcagccactgcgtacgccacagccttacgcgcgctcccggggtggtgggtgggccgcggccggtggagtggtgtggccatgcgcgccgtgtcagcgcccccccggtccagccaacacatgcgccgcgcgcgagatcgtgcattcgtgcgtgcgtgcgcgcgcgcgcgcgcctgtgccgctgtggccaacccggtaacccgagcgagcgagcgcgccgtggcatccatccgctgcggcaactttaactaccaccagtccaatcccgcggcctgcgcggctgcgcgacgtcatctcggctgccctgcagtgcgcagcgcgcggcatgcagccggtgtgtgcgagctgatctatgcgcgccctgtacttgggtgtccgggccgcgcggagtccattggccaccgccgattcgccaatcttcgctgccgcacgcctgcaactgcaacgcatggacgtacgacggacaccatccccgacatggccggtctccgtccattacttcccttttattactcgcatctccccttctcacctgatggaggttttgattggaccaatttccctttcagctttggagtgatcgaaaactactgaacctggttttccttgcactggcagtaaaatgaaccaaaatgcttggcaaattaactagagggatgttacatttttacttatgtggtcatatatagccggggcccctgtcatgtttgtaaggatccatctgacggatgtagcagctgatactgtaagatataccccataccccagtactgctcttcaaggactcaagcatgagttgctgacaagggcggagcaacttgtgtctaggaggtaccaggaacccgattccgaaattcttttaatcgatcagttcttctattttcatcctatcatatgtacacctctcagctaaaacttagatacccgtatcaatttaaactcagtccaaaataaagtaaaacaaatgattagaattctctccatttgattctagctccgtacctggttgaagggaacatgtgtttgtgctgctgagcagatgttgatgatgttggaattaatgaataggccttagcccactcgaagattaattctttggaaaatcacaaaagcccacctcatgggatggcatgcatgtggagtttagtaccaccttgcttattctaggagagggggaccttattaaaagggaggatgccctcctagtcacttgaagcatgtgtggtggagagaagaggggaaacacacgcgcgcgctcgctcgcctcgcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcagcacacgcaaaatcaatctagggtttgcctcctactctgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcattcatgctagttttcatctgtaatgtcatgatttatttatggaacagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcattcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgataaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcagtaagtctgtgaaccatatttgtggcagtgtggatgatgaggctaatgtttggcattcacgtttatgtcatattaattttggcttgatgtctcggctttccagcatgtgtttaattcctcagttttccattgtcaaaggttctaagtgccatagttgtgtgcaatcaaagcaacctcgcaagcctcacaaggctgccgaggagagaaacttggcaccactagaactcctacattcagatctttgtgaaatgaatagggtgttgacgaagggtggaaaacgatatttcatgacattcattgatgatgctactagattttgctatgtgtacttgttgaaaacgaaagacgaggctctagactattttaaaatttataaggcagaagttgaaaatcaacttgacagaaagataaaaaggcttaggtctgatcgtggtgaagagtttttctcgaacgagtttgacttattctgtgaggaacatggcatcatacatgagatgacgcctccctattctcccgagtctaatgggattgctgaaaggaagaatcgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctatcttctttgagagctttttcccaatgaaggatacacatagtggttcgaaccaaccatctaaaataattcccagttcaatcacaccaccagaacaaactgaacatacacatgaacttgtctctgaggaggatgtcagtgaagctcctcgaaggagtaagagacaaaggacggctaagtcttttgatgatgatttcactgtgtacctcgtggatgacactcctaagtcaatttcagaagcataagcatctcctgacgcagactactgtaacaaggctgcccgcagttaaatggattccattatcgctaacgggacttggaggtngacagagcgaccctatgggtgtaaacctgtggggtgcaagtgggtgttcaagaaaaagcttaggcctgacggtactattgaaaactacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctaaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtgcctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgttaggaaattaagaaactccggagttataatgttggattacatccaaacagcgagaaacctggcagatcccttcacgaagggactatcacgaaatgtgatagacaatgcatcgaaggagatgggtttgagacccatatgagttatactatggtggtaacccagtctatgtgatcggagatcccgtgaattagatcctgggaagaacaaaccattagtaaactagaggagagtatcaatatatataccctctccaagtgaagatgcatgtactctcgtgagctgcaaggcaggttggctatgccttaatgagttctgttgactttaattagcaaagatgttgtcctgcagagcattcttgaaagaactcacctttgtgagcttgactgttggtcgcagtctatgaagattttgggtgaatcttctaggaagcttactaaagacctagaagtatgacttatacgctccacccgaggggtagtctacagacggtctagtaccagataagactttgagtgaaacttgcttgcacaagacttgcaattcaaggcgtagtccattgttcaagttgtgagtaagtgtagcttggaattctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttacttattctaggagagggggaccttattaaaagggaggatgccctcctagtcacttgaagcatgtgtggtggagagaaaaggagaaacacacgcgcgcgctcgctcgcctggcctggcctggcagggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcagcacacgcaaaatcaatctagggtttgcctccaactctgtattgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctagcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacagatgaagggaacatgtgtttgtgctgctgagcagagaacacagaacacagagacacacacgcgaggcatgctcaggcacaggcacagccttaagtgataatgaccttacattcatggcattacacaaagatgtacggtaacaatggtggctctaaaggctccagggtgcttttaggtaagttcagccctttcggcaggttttcgtgtattcttctaggcgacaagcctggctccgaactgctcatcagtcatcaacggaagttttgcttcccatttctcctgcttactgtcatcctagatttggtactttgtactacataaatttcttataagatagactaagaccaaatgtctatctatagatcactcaattattgtgattgtctgcgctatcatggtgtgaaagaaattgaagagtaattttaatactcgtcgttgaaggtagtcccttttaatcaagaaaaacatcttcaatctttgctctacagcttataaactactgccaaatttagaattttaaaacttaattaatttggagacttattattgtagtttttatattgactctttaaattgctaagaacatatatagatataaaaattttattcataaattaggtactgacacggcttattaattagctttaggccaaacgattgattagcaaccatcacatttttatttagagctgtaaatcgaacaaggtaataatggtaattcaagatacacactttgcgacacaattctaaagagatctccaacacaatcattcatacacggcgccactcaaacataggcatgcatgtccatttcttacgtacagtatctacagcagaacgtgccgggcagcacgagcaatagattgcactcgagcaaaaagcccctcccctcttctcaccccgtctaacgaagaaagaaaagggaaggaggaaaaaaaaacatgaaaaagaagcctcctccgcaccgcacgtcaacgattgctacgaaatctcgggtgttcacggagcaggcaagatgggggaggaaagaccacatgttacacgtacagcggcacatgcgacacggcactcattgtcactcataggagtcaaatgtcatgtcgtaacgtatgttcagcaagggcccttcctatcattttggatgcactatggtgagacaaaaatggtgacccttcggagaaaaataagatacgatattttttttcatttcaattacaagaaatatagaaacagagggtacatagacaagccccacgaatacgctctaacacacgcccaatgagataaaaatcaacttgttaagtttcttgtgatggaatatactcaaccggattctaagtcttacactcgatatggttgcttacatttacatctaattataccgtcaacaatgaaataatcatgataactccatcaatctcaaaatatatcggatcagacttttgaaggtctgatcattaaggtagattatgtgggcatacgtgtatccaatggttatcgtgtgtgcgtttgtgttgtgtttttgaaaaaatagacaaaaatcaatgaatctctaacctcactaaattcctactccctccgtttcataatgtaagactttctagcattatccacatatatttagatgttaataaatctaaacacatacatatgtctagattcattaacatctaaatgaatatgggatatgctagaaagtcttacattgtgaaacggaggaagtacttaacaagactacccgtgtgtgcatatttatggacaccaaaatttaaaacaaaatagccgaaagtcattcacccacaacttcttctaggtcccatgatattgccacttgatgatattaggtgatacccttaatctagggagaaagaattttgggtgggagagagggtcgtgatgagaattttttttttatggtgatgaaacaagacaacatcgaatgggttaggacatgtagaaatagcacgttatagagctttgtatgtttgaacttgtatatcaaggtgacgttagcatttagaaaacgggtgctactacacatttcttcactactgtcgctcgatcttgccaactggcattttgtgcagaaaatgtgcagcgccacgtcaacctactctgctttcctcttgcctcacaccacacctacgtgaaatcaacccaccgtgaaccaggccaacaaccccctagcgaagccagacatgcggggcccacatgtcagcgtgcctgcgctttacgtgcgacgtcaggtgggttcgtgtgcacattaatgcgtacactggatggctacgtgtatactggagtatatataccagtgtacgtacgtagtattaccagggaggggcagtgtacagcaccatgcagggcgcatgcacgaggcgggagcccacgtggggacaaggtgggaagggcgagatgcggccatacgcccacgtggcgcgcatccagcggctggtcacgcgggaaaggtaaagtacaaggctgcctccctcgggcctgacacgtcgcattcctccgtacctccgttgaccacatctcgttggatttttctggttttattattttatttttctgctgtaaataaccaagataaaatggtgaggcccctgatgctcgcaggtggagctaatttgtctgttctacctccgacgttattaggcctaacactggattacaaaatcgcacagatttcacttcgaaatatttatgaaggttgcaaaaggatttgttctgtaatacaaaggacaaacgattttactttttttttctcgaagtagaatgcttctgacatttacatttacaattttctctttttttttctaaggaaaaaagggtggtactatattcttaagaggaattatgcaaccaatacaaagaacacaaacaatgttctgtagcatttctgaagcaatgaaaaattgcattttaacagaaaaatccaaaatgcaccggtaatgagcaacaacattttttttattttccgcaatatcacattatccccctctccctctcaccacaatatattcatcgcccttaacatccagtacttctgaacaaaaacaaaactagcctaaaaaaagacgagcaaaaaaagcaattaaaatgacagctaccaccaccaattatctccattcctgctttacctcgaaaagattaaaatagagggaaaaaagaatcggaaagaaaaggaaaggtgaatgaaagaaagagcagggcaagagcaaatttccagctcttccagctgtcgtccgagtcgtcaccctatctctcgctcacgttgcctcatcactcatcagggccgcctaccccccactgccgaggtgggcccatgcagcgcctcttcgcatcggcgctgttggccgccgatccgacggtggtggtgcgctcgctctcggagctcgcgctccggtggtggccgagcaccgtcaccggcgtctcggcgctcgtcgccgccgccgcccagctgggcccgacgccgcaggccgccgccatcacctcgccgcactcccgcaacttctcctgcagcagaaaagtccaagcaaaatgattatagccagcttccaggccacggggggcattatgagtggttctaattatgtgacaattaaggtatgattaattaactccacaaatgagaaaacaaccaaagtttttacagtgcggtcaattggctgagcttgctccatatcacgaggtaaatcattttttaaaacgtaaacagtattttttttttactccaaaagtcgcctctcacagagagccgggctatgtgtgactgtgtcagacgtgacaggggttgtttcgtaaataagtggtgattaagggggtaattttagatgaaacaaaatttattaaaaaaaaaagaatcatgctcacgctatttacaaaggggcaagcggcgacgccagcttcgaagccgaggaggtgggcgccggcgacctctccggcggccgcgaggagggccgcggcggccgccacggagggggagaactccgccatcttcacctctgcgaaatgcaccggaggcaaaaggtgagcgctcgctgaatctaacggcgaggacggtggcattgggcgtggcggcggcttggacgtacccggctggacgcggaggaggaggtcgacggcgcgggccttgatggcgtcgagcagcgccgggtgccgcggctgcgggaagcacgcggagagaaagaagccgaggaaggcgagcggcgtgacggagcgcgtccgccactccagcgcgttgagcaccatctgctccatgcgctggattttcgcctcgtcgaacatgaactcctcgcccctctgcaacagaccgacgcccacaccaacgacacgaggtttcagcaaatcggatggacgaatccccccccccaacgaaatcgcaaccgcgcaacgggaaatggcattcgtcccgtacctggatgtcggcggcggagatggcggcggcgcgctgcatcttggcggcgagggtgaggcagctgatggcgagcagccgcggcgcccatgggttgcgctcgcactgcacggaaccattggggaatcagatcagaagcgaatccctgcacaaaatccagccagagaaaagagcccccgtatcacgcgttcttacggccaattggcgcttggagaggtagcgatctacgtagttgagcgcgaggtaggcgacgcgggggtgcacgtccagctcgccgtcgtaccgcacctgggcgcgccgatcaaaaacacgcccgatcagatcaagaaaacaggggaaagaacctcgaagaacccccccaaggaaacaaacccaagaggagaacgcgtcccggataccttggagatgaacccggcggcctcgcggcgggcggcggaggcggcggcggagacggacggcgagtggtggccctcggcgtcgaggaggctggcgatcggctcgtcggcggggctggtgaacgggttctcgaggtcgaactcgtactcgtacgcctccaccaccaccacctccttcgcccccgtcgccatgtccatggccgccgcccgccgccgcgtagtacgaggaaggcccaggaacacgccaagaaaccaaccgcgcgtggtgcgtggctttatgggggagagggagaggaggaggaggaggaggaggaggaagccaccattgctgctacgcagtgctactactagtactagcctctgtctagttgggagatggcttttaataggaaggggtcggggacagtggtacaaaaggtgtggatttggggttctttttgtgaagatcgggaggaagaggaagagaggaggaaaaagttccctccgggggtggggcccacctgtcagcgggacgcaatgatgccgccctgtgagagggagacctgtacccgtactgcgtcaatactccatggcttcatccggctttgacagctcacaaccaacatggaacaggggaattggtaaatttcctgctggaaatgtttctcctcttgctattttccccccttttttttttcttgtttgtctcatgggttgatggaaaatgaaatcaatccccgagaataagatcgataatctttttttctctcttttgattacactaaaatagcatacatacactaccgaacatacgcactacactcacacacctacaagtacgctgtcgaacactagttcctttaaatttattggcgatatttttagtacagaacgttactacttactttcgtatccagctaatttacatcttcaatagtcgacaaagggtctgttcggcaggccgactgcgacggctgcgactacggctgtagctgcgcacagtgactgtggcactattcgtgcgtagccgcggcgctggacagctgaacaggcccaaaatttattaacaaaggtgacatgaaacgctaaaccaccaaaagatttatataaagggaatgataaatgtgaaaatattgctacattaaccgacaatataaagtggatctcactactcaaatttccaaaggctgagaagtggcagctcgtatgaaatttctaaaccactcatcacactgtctcacttcattacacagaacgtccaattttcagaaaacccttacaaagaaaaaaaaccaagaattatcttactagagcagcaaacaaatcttgttagttttttcctcgcaaaagaaacaatttctccagaattttgttggatctttgtactgtagtggtggcaggtagagcagggggtaacatgtaaattcctggctgtgtggaaacgaacccgagtacgcgacatcgacggcatctggcgggagaaaaacggacagcgctgcatcccccgttttgacctgcggccgtcgctgttgcaaagaggacagtggtcaacagtgctgcccgggcccacgcgcgcgtgtttttaccgaaatgccccctctccatcctcatcatgctgtttgctgtgtcccgggcccaccgtgcaaaatgtcagattcaccccctggcacgccaaagctcatcctagctctctcgtgaaccttacctctgttcgttcttcggagacgagatttgtgttgaaattttgaatgaatttcagaaatggtaaaaagaaaaaagaaaggtgattagctcggtaaaaatcgcaacatgcagacccccttcagctggctggtcacgattcgatcgtgttgttttgcttgcacgcgtcgcttcctggagtattatttctgaaccctatggctacacatacttcatctcctacactaataatctataggttttccagatcgtttagttgattatcttgacaaaactgaactgtggccatgttaattatgagcacttaccagttacccacgggatacgagttaaagatcaccttcttttggaagacaagatttcacatgagtttttgcagggttatcaaagaaaagttcttcagttattgccggagcgatcagttgattggcgtaattttgggcaggattgcccgttcggaaggaacagctcgtgcagctgatatgaaatggatagtactggcctgcgttgaagggctcaagattgatgtgatgattgaggggacggatcataccactcagtcactccaatgtctctcaactcgttaatttgttccatgtacagtatacatatatatggacacggtagccctggttgtaacccatgttctacgtataacatatcggagtccttttcttgttcatcacatctcaacgtgtctttgacattaggccaaatctaaggtcaagtgtccatatacacatatcaagattaccgtagagtttgatgctataactgtgggtgtataagtataaatctattcaccagtagttcaagcgtgtgttactacattcgtagacgttcaataaaatatgaaatcttgatcactgctcttgactacaaatgtgtagtgcgctcccagaaacctcgtggcattttcataatcgttacagtttcacctcaaaattctctgttttcaaaaaccaaagcctcaaattaaactttcatgtgtctgcagagtctgcatctgcatgcacctgtaaaaaatctacacgcaacaaaacagctagtttaacgattaccaagcgagatcccggtctcccatgcaagtgtaacagctacggctgcacattaatccccgttttcttttctcccatgaggcaaccggctcagtacggcgctacatatcgtgagcatatatgtatccgtgcttgctcttggaccagagcgcttgttcttgtactacctcaaaaggctttgttttttttttctctttctaagatgtaccgcctcaaagatctatgctcgtnnnnnnnnnnnnnnnnnnnnnnnnnnnnnnnnnnnnnnnnaggcggtcatcaatcccgc

SEQ ID NO: 14048 - DNA, 8575 bp, Oryza sativa
  unsure (1)..(8575): unsure at all n locations
cgcccccccctccccctttgannacctcgctctaacagatcgtacagtagttcatcacccttgcatataccattttgctcagcacttgagaaactattgactattaaagtttcatatatcaaatcttattttaaacgttaaaatatttatgactggagtctaaagggagtatctatctgtatttcatggattgcatgttttcctatttaccaaactagctatctaagtgggagcaagctcctctaacataaagtcagagggacatgagtccctgacatatggggcccaccttcatgggcccatatgtcagtagccatgtccctctaactttatgtgagaggagtctcatccatctaagtggatcattttgagcctcatccatcatttggcttatcgatggaataagccaaacgacatatatgcaaacgaaaaataatttatgaataaagcttttatatacgtgttcttagcgatataaaagtaaaagctgaaaaataaacttcgatgaaaaaaaatctcaaaatcaagtctaaatttaagattgaaaatttaacttttggttgataagtatataagtataagcgaaaagatgaggctgtaactgatgcgtgagaaattaacggaacttgcgcatacgtactgtacacagatcatgggtggaaatcggggaacacctgcttctcaatttcaaacagatcatctgatcatgtgctgctgccttccaacttttccatcatttccatggtcttttattccagctccctgtagatcgatgcccccacgattttacttcgaaacttacccaaagttaacattctgccgctttgcttttgcacaacaaagtcttgccgcctcacgttaattaataattaccagccttttacttaatttactgccgtttgataggaaaaacgcaacaaaagctactacttggcaggaaggcctgcagcgactgaaatcagatggcatcgtctttcgccgcgagaggagtcagaaaaaaacaactccggtggaaaaagctaacgcgatggcatatattcgcagctctccgctatcagttatgatgagttttccgggcaaagcgtttgcattttccccgtgttgttaggagggggaaaaaaaagaagaagaaggaggcaattgctgctatttgccgttccagtagtttcagagggcaaagcaacacgcagcgttggttaatgaataatgtttgttaggtctaaaagttataaaatcaagatgagaggaagaatggaacattggttaggtatttgtggagtaagttacgtgctctggttcaccgcttttgtgcctctccctgttggtccttcttccaggagctttttttctcggttgaatagttttttttttttgaaatttgaagaaattttagccgaacttgaataaaatttgaccaaattcagaaagaaaatataatttcaggcgaaatagtttcgtgccggaagtccgaaatgaaatttcgggaatttcaaaccgaaattgcaaacatattgtatggcacagaggaagggagctctctcgtttcagttaaggccgttcgagttaagtttaattcgagtgtacttcgagctgaactcaaaccaagtccgtttcagttaagttcagactcgcttactatctgtataccaaagggtataaaaacatttcatacccatagcccaattcataatgatcatacacacacatgggattgttaatttgttatcatggaagcggacacattcacagtgaacactgtgctggtcgactgataatgaaattagtgttccattccatgacaacaatttcttcttcttcctatcatccttccagcgacgcagtagcactcttctcatcagagaagtaatcgtgcctgtaaaagaagagatcaacacgaaagttgttaacttgtcagaaatcacatatcgaatcgtaagagatcaacacgaaagttgctaatttatcagaaatcacatctggaattataaatcagcaagctgaggattggttttgcagtaacagaccttatcttacgggaaagctggcacacgcctgtcacggccattgcagcattcacgctggagaggttccagtttatctgcaacaatacaacagtcataaaacagatatctgaatcagtctatccaagtacaacagtcataaaacaggtctttggcttgattcagtttcaaaacagttactcctttacagtacaccgcactaacctacactagagaatcgtactagacattgcgcaaaaaagttgctgtttagactgcattcaaatgagatatacaatccaaaattccaaatatttttccataataacgagaaacgattgtatgtatggctaaatatcaggggcttcaaggtgtgatgaccatgccccaccgtgcccaaattactccattgcaagccacaactgcacatcatacatcatacatcatacatcagagtaagcacaacaacattatacatgaattgatgataaactgatgtcaggaataagattaactgacaactaaacctaccaacttgctgagggtaggatatcatttcaggaggtttggcaaagtcagcaacattggcaatactgataccccatttgaatgttggggcccagaaatgaactgcaacaaagatcagatggaagcctcaacagttcagatgacagtgattgaatatgttaaatgtttcatccaatagacatccatcagatcagaagaagaggagaagatggaacttggctactactagaaattagaaaccaaatggatcatcagacaattgaagaatgaagcacatcagctatctgaaggagggagtcttaaacactgttgtttttatgttctgacggtttcagtaatttagtattttgtaaactggcttgtgatcaaaccaggctgtctgatttcacatactattctgaactgtaagctggaaccatcagcatcagcctgttccctaatcatgtcatctgttaataattgacaagctgggaagtagttctcactgtgtaatgacatgtgtaagctagcttctgttccctaatcatgtctatgggaatatcaattgccattttacactaaaattaaggcaaacagggttgccactgacttgttttggggccagcaggatggttccaaaaggcctgaagctttgaggcagccatattcagactgattcttttctgtcctcttgcacaacttgctttcaagttcaggttccaattgcagccctgtgcccctgaaagcagaaggtgaatacatctctcaagatcccaattcaactaggcataatttttttaaaaaacaaaatcaacataacccagctagcatatttcaaagaggcgttttctttgtgcaaggacatcaagttcatgcagtacagtacatgacgaaaaagtcaacgtgcatgccacagcaaaaaatttcccataaatatggagagtcaatacaatttctgcatagctagaacttgctataatcatttcagcatctcacacagaattcatcacaaacttgagctacttgataccactgcccagccatcatctatgttaaggaggcagaggcgagaacacaaaagtctgcaagaatctgggaagctagctccatcgatcatcaactcaaacccatgggccatggcggctgattaacggttgatcacaagaaggggggaggagatggatggatggatggatggatcacctggcgctacctctcgccgccggccggccggccgcccggtcgccggagcagaggaagccaagcaagtggttgagcagataggagtgctgtgtcagcagcttttgcttgccttgccggccttgcgagttgcgactccgtttatactcttccattttacatataatacatgatgttgctggctttacacacgtttaattatacgtcttatttaaaacatttaaaccaatacgtaagatataaaaccatctttaaatgtttataaataataattatgtagaaaaaaatttaaataaaaacgaatgataaaacatgtttcttctcttaaaaacggagataacattttctttttaggcgtcgcgtgtgacgaaaagcacatggaccggaggggcgctggcgcatggagaccggcgaagatcggcggccgttggtggagacatggacggtggcgatgaggttcaggtgcatggatgcagtgttggcgaggtgactcgcggcggctaagccggagtagataatagatgacgacaacgtcgtactaacccacccccacaagttgtgacgcgaggttagcatttttttttatagctccaatgtttgaggcgtcttcttgttcttggattggtgcagatatggcacggttgacccgcgagctgaataagctgacgacatttttttttaacggtaaattaattgtcagttctcatgactttgtccgagcttcctatcacttcgccatccattctggagtctggactctggtaaccaccaaccatgtcactgaaataaggtggtgtttgtttctaattaatataagatgtcggtaaagttagaacatgtaaaacgaaataaagctatgagtacgtggttaattgagttttaattattacatattaaaaaaatatttgatttttaaaagtaatttctatataaaaagttttcacgcgaaatacatcggttagtagtttaaaaattgtactaacgaaaaccgagtaaaaatttacatcttaattaaaatggggccttaaatgaaacaaaatctatggaaataaaacactatagttaaacgcgtaaatacgaaagttacaagcaaacctaacagtacagggttagaacttggaagtcgaaaattaaaaacgacaagaaaaaagtgtacccaggaaaaaaaacaccacaggaaaaaaataattgacaaaaggataggtccacttagggatgaaaacggtcaggaaaacctataccattttcattttcatttttttttatagaaaacggaatcggcacggtagacccgaaaactgtaatgatatcggtatattgaaaacgggaccgtcggaacagaatataccgatattggtcggaagtcaacagaatcagcagagtatggcatagcacacatttaactatgcacgaagatgactttttaactttattcttacatcatcacactccacataacactgttacatgatgattaatggtatgataataagtttgatgaccaatataaacaaagttcaacaatacttcaacatcgataagttaaggagaccaaagttcagcaaaatccacatgccacatcatagggttaataccattttacctagtcacttctctttttttatgggctgcaagcctaccaggctttcttctttcatgggcttctgatgggttaggctagctgagctcctaggaaactttcgaaattttgacggaaattatcgtacaaatatggttaccgacaaaacggttggaaaaacctccatcccatttccgctaccattttcggaagatattaccgttttcatttccaccaccgttagttaccgatacagactgaaacggtcggtgcaaactgaaaaagtcaaccggaaatctcgtaaatttatgtactgctttcacccctaggtccactcgagatgcaatcatccaagttacaactagagggtaaacattgtttctcaaaaacagaaaaatagtacgaaacggagtgccgttttccctaattctgacgtgatagcatttccataacagaaagccaatagttacaccaaaaccctcaaacaaagtttcattgagctaataacacagcagaaaatgtctaaattcatagtgttagaaaatatcttatccggttctagattattatattttaggacggatgaagtactcaaaagagccagcatactcgtgatcatgaaaatccagccaggcatgctcaatggacgggattgaggcaaacaccattgttatgcatcgccctgcatatctggacttctgcaacttgggagcaacaagctcgatacatttgatatgaaagcaatgacatatcatcatgtccctgagctccaaataccccaaaaatggttcaggtgaaagctcttcaattttgggcaattttcaagaagtgtctgaatcatgtcatcagaaatgtgcatttgaatccatcaaaaccagtgggaatactaagggtgcattggccaagtttgagtttcaacagagataatcccttgccattggtgaacaaggataaaggaaatttgtaccaagctatgtcagatctttgatatatttggtctagttttgttgtcagatccagatcctcaactcctcggcagagtgcaatatcgaccaatttatcaatcaagtagacataatgatctgccatggtgcaacacaggacaagacttgagatttttgtgctgttcatgtcactgttaattgatttgagtataaaaccagttaacgagtttgagaagaggtgtgtctcgtacctgtcaacaagcctgctgagcaatcggggaatatttcctactccctccataccataatataaggcgcgcgtatttcaagatttaaactttaaaacatttaaccaacacttataatatggaataaattttatttgttaaaaattatattattatattgaaatttaaatttactttcatatggttataattttgttgctacaaatcttcttattgtatatgagaaaatataagttaaagattagctttggagaccgtgtcaattttgaccgcgtcttatattatgggacagagagaatataatataatatgtttacctcatagacaaccagtttacttaagaagcgttgatgaagcaaaactaacaaaaccataatatgattatttctgagtcttctttcttagataattgcgagtatagcatttcatccaatacctggtaaggtactcaatactaacttgcacccgtcatcaccatgggcccaataatagccttagaaaaatatatttatggactctcagagatatcattggaagagagaatccacagagacccaagagaaatttggatgaatacgaattacacattggctttaaataaatttttcatctcgaacaacggatctatagaactgctaaataaacaacggcaaggccttgccccgagcttgaaccaaatatgctctcaggccaccatccatcaatataaccacaaccctcacaagctcctcaccagtggcaaatggaccaccggtgaaacaaagagagccggaggattcgattctaaagaatgtcatcatgaacatgaaatttatagccaatcataccctcatggaagaaaccacggaggtagatggctaccgttgttgacgacgacggcaaggaaagatggtaactttatttggctgaaaacctaagcaactagatctactggatgggtgggtctctttcccctctttaccaatagcttgctggtgaggaagaggaagggggactagaggaaggcactaggatttgggttgtggtgagacgggactaggaaagatgaagagttgtgctcgatggagggtaaaataaaaatagaagtaaacaggttggttcaaagaaaatctaaggagtttagtgtcaataatttaagaagaaaggtgagcatatcaagaaatagtcgaaggtagtattcctcgattgaagaaatcattccaatcacaggaatatggggatatttttatcccaaccttataaaaatctctcgtaagaagcataccacgttccttggcccttggcccatgtacccgaaaaccttatgactatattatggaagaactaaatgcaggtcgttgatcaacactatgtatactacatgtagtctcctaccttatctggtcctctctatctgtctactctagagatgcaaaaaaaacattacaatatgattttttttaccattttggcatttttgccggggcaatttaagaatgaaaaaaaaacattgtatttttcaaatctatcatgttggatgggttatggccatgcaagtcttgctatttgttcatacagatcagatatcaatgccgtttcttaaaaaagccaacggtcaatatggtgcgagttttgagcaaactcgtcctaactcagacctggaccatcttttttactgcaggacagatcaacatgttcaacaatcaacaagaaattcttcaggccactctccttgtgcgatgcacatggacaccggcagtgacacacatgaatgcgtccttacaatttgcaatttgccagtggcatggcaactggcaaggcaccgcaccacctctcatgtactccctttttcgcgtgttgatgaaaaatccaactactagtattataagattaatattgccatgttcttttctccaacaaatattggataaacttttggataaaaatgacatgttttttaaactgctaaacggtgtgtttcgtgtgaaaactttttatataaaagttgttttaaaatataagattaatctatttttcaagtttgtaataattcaaacttaattaatcactgatgagctacttgcagtagntagtcaatcaaaanntcaaancccatcg

SEQ ID NO: 14049 - DNA, 15918 bp, Oryza sativa
  unsure (1)..(15918): unsure at all n locations
aggggcntttganncttggattagacnnnnnnnnnnnnnnnnnnnnnnnnnnnggaaactggtcattggtcaagtcatcgtcaagcttgggccactaagttcgacaacaaatcctgttctcaaacatggcaacaacagtattataaaaaaacatggcaacgagtgtttaacccagatttgggatttatatcacccaattttctgaaacataggatttatatcataccagattagcccttcaaaatgtggactgaccaactaatttgataaatttgcaatcaggaaggaatagatgtgtacaaaaactagaatatgacaaaaacaaagcagaacaaaaatctgacgggaagaaaaaacagcagacagacgtgtaggaagacaacgttcacaccagctgttcagcagaagctttttctatattgatcgcaatgagaaacacgaaagttatttacggaaagaacagatatccatgaaccaaaattataaatactgttagtcttggtaacactcaacatttcaacagatcagcaggcaattctaacactgacagtgctattcgccgatcaacatgaccagctaattttcttgcagcaacatttcttacccggtctctagaaacccacatgagagaaaacagggcagccaacttcaagattttggtcatcttcaaagggagatggtctggtcctgatcaaagtttgaaattattagcacagagaattttgaaacctcagcaaaatataatactagcaagtcttaaaagagtttctctgaacgaccggccacgttaaactaaggccaagtcaacgcagagcccccggagcttttgctgccaccagcaagccacaagtccaaaacacctttctttgacttcacactattcttagtttttaaatttatttcgcaacagaataaattactaagaggatagcatcatagcagatgttggcgtctctgttcacaaatgtgaatactaataaattactaagaggggacacgaatatcttcaatcctagaacacaagttgattagttgaacaggcagcaaaattaattaatactaggaacagtactatttcgcaagcaaaactgtagaaccaattttctgcacccctcctgcaaaaaaacaaaataaaacccaccatttaataattcaccacaactttaaacagaatattacatttcatattgattattcttctataaacaaacaccaggtcttcgggtatgtaccttttccacagaaccctctactgtgccaggtcaaagagcgttcattctgcaatatctcgtgaagtggagccttgctgtccatatgagttataagaccaagcttaccttcctctcaggttccaaccaccataatcaaattactccaaaggccaagctcagcttccattcgtcccaggttctcagccctggctgctctgccaagatccatccatggctcctgtcttcttcctcctcctcttcagccaaatctttctctgcaccgcagtggacaccatcaactccaccacgccgctgtccgggacgcagaagatcgtctccaagggcggcaggttcgcccttggattctacaccccgccacaaggtaacaacaccgcctccggcaccggcaactactacatagctatatggtacaacaacataccgttgcagacgacggtgtggacggccaacagcgacgtgccggtgtctgacccgaccaccgcatccttgtccatcggcagcgatggcaatcttgtcctccttgatcaatccaagaacaggcagctgtggtcgaccaacgtaagtgtggcctccaactccaccgttgccgtcatccaggacggcggtagcctcgacctcatggatgccaccaattcatccatagtctactggaggagcatagatcatccgacaaacacctggcttccgggcggcaagctggggctgaacaagaccactggtgtgagccagcggcttgtgccatggaggaacaatgcaaacccgtcccctgggctgttctcccttgagctggatcccaacggcacaacgcagtacttcatccagtggaacgactccatcacttactggaccagcggcccttggaacggtaatatcttcagtcttgtgcccgagatgacggccggctacaactacaacttccggttcattaacaatgtctcggagagctacttcatatactccatgaaggatgactcgatcatctcgcggttcaccattgatgtgaatgggcagatcaagcagtggacatgggtaccagcctcggagaattggatcttgttctggtcccagccacggacgcagtgtgaggtgtacgggctctgcggcgcatatggaagttgcaacctcaatgtcctgccgttctgcaactgcatcaaggggttcagccagaagtttcagagtgattgggacctccaggattttactggtgggtgcnnnnnnnnnnnnnnnnnnnnntgccagaccaactcaagctctgcacagactcagcctgataagttctattccatggttagtgtgaggctacctgataatgctcagagtgcagtggccgctagttctcaggcctgtcaggttgcttgcctgaataattgctcctgtaatgcttacacttacaatagtagtggctgctttgtttggcatggggacttgattaacctccaagaccaatacaatgggaatggaggaggcacactcttcctcaggcttgcagcgtctgaacttccagactctaaaaagagcaagaaaatgatcattggtgcagttgtaggtggagttgctgcagctttgataatccttgcaattgtgttgttcatcgtattccagaaatgccgccgagacaggactcttcgcatatccaagactacagggggcgcactgattgccttccggtacagtgatctgcagcatgtcaccagcaacttctcagagaagctgggtggaggtgcctttggcacagtatttaaagggaagctcccagattcaacagccattgcagtgaagaggcttgatggactgagccagggggagaagcaattccgtgctgaggtaagcaccatcgggaccatccaacatgtcaatctggttcgcctacttggtttctgctctgaaggatcaagaagactgcttgtctatgagtacatgccaaagggctccctggaattgcagctgttccatggtgagacaacggcactgaactgggccataaggtatcaaattgcacttggaacagcaaggggcctaaattacctgcatgaaaaatgtagggattgcataatacactgtgatgttaagccagataacatacttttggatgagtcatttgtacccaaagtgtctgactttggtctagcaaagctcttagggcgggatttcagccgtgttttgacaacaatgagagggacaaggggttaccttgcgcctgagtggatcagtggtgtgccgattactcctaaggcagatgtcttcagctatggcatgatgctcttcgaactcatatcaggcagaaggaatgctgatctaggggaggagggaaagtcctctttcttcccaactttggctgtaaacaaactccaggaaggtgatgtgcagaccttgttagaccccaggttgaatggagatgccagtgctgatgagctcacaaaagcttgcaaggttgcctgctggtgtatccaagatgatgaaaatggcagacctacaatgggtcaggtcgtccaaattttagagggattccttgatgtcaacatgcctcctgttccaaggtcactgaaggttcttgatgaaagccctgatgtcataaattttttctcagatgtttcatcaagtcaaacttcgcagatgcataatagcacagcttcttcgcagacaaagagttctacttcaggtggttcacaatttcagagcacataaatcagaaaatcctgaatttgattagggaaagacatttacgtatttgagagtaatatgagtgactcatgttgtacatatgctatgcttttctgtagttctgtagttccatgccttctgtatattaatagcacataattgagctatcacgaactaacacattgagccatccaccatgtattagaatttttatgtttaacctatgaggaggcctgactgcacatgttaacatttgatagagtcccaacatgtgcttcaattcaggtgttatgatctgcttgcacataacaatctgaatagattaaatttggtaatcttgagctacttgagaataaatactccctccgtcccaaaatataagcatttttagcacagtgacaagtcaaacatttttaactttgaccactaatagcaaaaaaaaaattaaaaaagagcaatcatataaaattgatgttactagatttattattaaacaaacaatcataatatgcaactctttttatttaaaacatcttatttttatagatattgttggtcaaagtagtatctcggagaccatgtcaaggttcaaaaaatgcttatattttaggacggagggagtagctatattttctttaacatctgcactggttaaatatttttcaaattcttaagggccaaatgccatcatctgagtaattacaccattgttatcctgtaaatttacaaaatagttttttggcaggccagtagaagaatcccggctgaagctttgtttatactaataagaagccctcacattaatcttaaaaattctaaaataaataaattcacacaataataaaaaaatggctaaacatgagcacattaatctttaaaaaaggaaaccatgaccgtcaaatttgatttaatgttttcatctacaccctacatgcaatagataataagtatcagagtagtagtagtttttaaagtaatagtcaaaactcagaagcatgcgttccatgcattgcacacaatatgaagataagaaccagaaggcatccatgaatctgtttcctgggcgcacatggcctggaaaaacaaatcaaagttcagttcatagtaactctatgtatacaaggtctgaacatataaatatacacagaataattagatttattttcgattcccatgttctaatcaagttgatttacactatctgcccaatcagtatgaattaaggcatacaactaaagcatacctagaggaatatgtagctagcttacatactaatcttgtcttaaaaatgttcttaggctgtaagtaaccatgaaaaaaaagatttattaggttttaatttccagagtttaaaaactaaacttccatactaaatataagcatcatgctgcaacaaattacaaaagtatccacacccaaagtaataacttcgttggcaaagaggaaaaatataagtgtactgtattctcagaagatttaaaaaagtgctggcaaggaattttcttgttgtttagatagagttttctcaatatatcaaattaaaatattcataaatataaataatgatgttccaaaatcacaataaaaatactagcctgtgccggtgtactgactgatgactacagatgcataatcacatgaaaaacaatattaagaaagatgtaaaactgaaatcgaaactacagcatgatgcacagcagattttatgcaattacatgaaaagaaaaaaaaagtgattgccaaataaaccatctatgctcctggggatgcacagctttatcatgcttctgccttttacacttgaataacaagatgaaccaccaaaaacatctgatgcttcaatggccaaaacagcgttgcaattgaagaacatattactactaggacaaatatgatatataacttactaaaggtgagttatatcgctatatatgatgcttaaaagaagacattatttggtttgaatcaccagaacagcagtaaaacagaagcaactaggagaagaattcagagtttgaaagagggtgtccgttctttagtcaaaaaaaagaggatgtccgtttcacattctgtgtctggacttatttgtgaacaagtcgtgtctaactcttatcaagtgctcacacatggttgtgcttgttccagatggcacaatagcatccgtcaattcacaggaaactagactaacaacataaaaagaatattattttggaagacaagtcaaatgagaaggatgacaatagagggaagaaataactctctaccttgtggcatttgcattaactagaagaataccacacatccaaatttccatgcaaaaaggatggcccctcccagcaagtggaagatatgttcttccttttcttttctcatattatcaatcttccatctttacacaagtacttctgctttgactgatacaatctcaagagtccaatctctttctggtagtacaactgctgtctcaaaagaagcaaattttgagctgggattcttctctccaggtaatactggaaacctttatgttggtatatggttcagaaccacatcaaagaaggctgttatctgggtggccaaccgagacaatcctgtcacaagtgctacatcttcagagctcaagatatcagaggatggaaatttagtcctccttaacaagtttggagaaccaaaatggtcatcaaatggtacttggaataaaccaagaaagtcaatagttgcagttcttcttgacaatggaaaccttattctgagggatcaaggtaactcttctgatgtaatctggcaaagctttgatcacccaacagacacaatactgagtgggcagagatttgggatcaataagatcaccggtgaataccaggatcgtgtttcttggaaagatccagaagatcctgcaccaggtcctttctccaaccatgtagatctaattagattgaaccaatatgtctctctctggaatcaatctaaagtttattggcagtctgggaactggacaggacaagcattcacatcgatccctggaatgccactaaatactgaatacaattatgttttcattaataatagtcaccagctcaagtttatatacaccacaaaggatgtatccataatcacaagaatagttcttaccgttaacggtcaactccaatgccatacatggtccaacaaatcagaggaatggatagtacaatggtctctacctgcagctctgtgtgctgtttattcagtctgtgggccttttggagtctgcaaaacaggttttgatgagaaatgctattgcctgccaggtttcaggccagtttcctcgaggagctgggatcttggagcatggaatcaaggttgtgttaggaaaacagatatctcttgtgttgactctaataaacataatggccaacaagagaagcatgcatttctcaagattgccaacatcaaagttccaggcaatccaatgcaattgaatgttcaaagcgaggaggagtgcagatccatatgcctgaacaactgcatttgtactgcatatgcacatcaacatgaatgcattgtttggaatagtgagctccgggatcttaaacaattgtctgctggtaatgttgatgctattgatatttatgtacgtcttgcagcatctgatcttcaagttcaatacaatgaacataagacacatcatatgaggctaattgcagtgctgggaagtacctttgttgcactatgtgcttttggtgcaataatttggacgtttcgaaaaaggaatgcaactcaaaaggctttctccaatgatgattctctcatcctatacagttactcttttttacagcactgcacaaagaatttctcagataagttggggcaaggtagttttggttcagtgtacaaaggatcactcccaaactctcaaatgatagctgtaaagaagcttcaaggaatgaggcaacgcgagaagcaatttcaaactgaggtgagggccttaggacgaattcaccacacaaatctggtttgcctcgaggggttttgcttgaggagctgaaaggcttctggtatataaatttatggtaaatggtgtttacacccaaatttagcacctatggacgaaataggggaagattgccaaagtttggaaagtgacagatttccttcacagggccggtcagaccacaggtgtgtgggcggtctgaccagctagtaggaccggtctgaccgcaggtatatgggcggtctgacaggcagggtccgagtccaagtctgttttcgtcgggtctcgggtttccttgctcgggaaggcatgtttcatgtttcctttagtttctatcctgagttggacgtggagaagggcctgtagagggcaagaccaaccccctatttaagggacaaggccgccggttcattgtaaaacccccgaatacaacttacttgaatcgttcttttactatgttttctattttaccctagtttagtccatctttgtcggtttgcgctgtaaaccgtccgccgccgctgcgagagtgcgacacctctttgtaggtttgtcctgaaaaccttccgttttgcccacgagacgggtagttatcctcatatcgatctaaatcggcctagaggctgattttgatctctaaatcggctccgctagccggtttagttgtttttctccgaaacccatcttaatttggcctttggctagatcgaggtggttggcgactccatatcaccgcaaggcgtttaggtgttgcgatcgtgcttgtcgacttgtcaaaaaagttgccaacacgatttttggcgactccactggggaacgatctaatcggccatatcacggccgaatttcgtttaatctagtagctaccgtttcgtcaaatccaagtttcggctaaacggccgaaattaatctagtatcgccggattaatctaatcggcggcgaggttatttggtcgtcaccgaatccatctgaacacttgccgtgtgtactgaagatcatcatcagggagcagtagctgactcggcaacctcctttccttttgtttcacatggcaacagaggaaaagatcaggctactagagccgatctgccgagagacaagcagcaggagcattgtttccttttattactgtatacgtgcatagatcaaaaagatcaggctataccagagccgatctacagagagacaaagcaaagtttatctgttgattttggtggaattaattagtgcacacattgctcatcgcgagagaaaaaattccaagaccgtgtattaatttattcggtcaaatatttcggctatgagctatatggccggatttaatcaaggaatttcttcattaactatgacgagcgggaacggttcaacaatattgctacacaatacatcaagaccgatcaagacgtcatgaaaggaaacgtgccgctacctcaagttgcagtttcaccgaaggtaacacaatctatccaacaagaagtagcatctacaatagattcatccatgactgtttttaaagataagttagatgcaacttttgagggtaaatttgatgagtttttaagatttaaattcggccctcttatggccgattacatgtttaaaaataaagcctctaccactgctagtcaagctcctatagatcaaacaagtagtggaaccgatggagcagcgcatatagccggtccgaccgaacctgatggccggtcagaccgcgatttcaccgtcggtccgaccggccaaacggccggtccgactggatattaccccggcagtcagaccgggactcaggccggtctgaccgcgcctctggatgtcggtcaaaccgagccctggaccggtcagaccggcacaatcataccgattcaggggatagatccaatgactaatgctagttatttgtatcatcttagaacatttgatcctcctgtatctactgctacaactaatccccaagttcccccgcatgttcctaatacttataatgatgttgctagaggatattctcacgatactaggcaaggccaatataatcatattgcgccacaaacacaacctattaggccaccaaatccaccaccaattcaacataggcctgataatatggaggagataattagtgagattattagggataaatttgggattgaaactaggaatcgtgctaaggtttaccaaaagccgtatcctaattattatgataatgtgccatatcctcgtggttatagagttcccaaatttaccaaatttagtggtgaggatagtaggaccacatgggagcatgtaggtcaatttttagcgcaatgtggagaggctaatagtgatacttttaaattgcgcttgttttctttatctttgtccggtactgcttttacatggtttacttctttaccggtaaattctattttttcctgggctcaattagaacaaaaatttcatgattatttccacactagtgagactgagcttaggttgtctgatttaacatcggttaggcacaaatacaatgaatctgttgctgattatattgaaaggtttagagatgttaaaaaccgatgttatagcttgaaaataactgacaaagatttggccgacattgcatatgatggattgcttgattctattaaagagaggttgaatggccagatatttcttgatgttgatcatgtgttgcatgaagctccggctcaggaaagccgagtggatgacaatagcttaaatgctagtttagatgataatgcaatatcatgtatagccgaaccaagcgatggttcggattgtgttaatgatttgtgcaatgatgccataacgattatagccgaaccaaatgttggttcagattgtcttgctagcttggaaaataatgcaacaaccattatagctgaaccaagtgttggttcggattgtgttactagtttagacaacgatggaatagccgaaccaagtggtggttcggattgtattgctagcttagagaatagcatcattgaagatatagccgaactaaatgacggttcggattgtattacaagcgaaagtgaaatagcattgtcacctaagaccgagtcacaaatcggtcatgtagatgttggaaaagatgatgacaatgtcttgcgggatagtagtgaaatagaatccaaagtagccatgcatatatatcaaaggccgtatcctgaacatgtagattcagttccatacccgcaaggatttgaggtgcccaacttcacgaaattcacaggtgagaatgctatgactacaatggagcatatcgaccgctttattgatcaatgcggtaaggccggtagcgatgatttgcgtaagttaaagttgttttctctttctttgtcaaactttgcatctacatggtatagtttgcttgctcctagttcaatttctacatggtcacaaatgaagcatgagtttcatgattattttaaagatgcaaacttgatggagaaaagaccggttgatgattcatcggtcacttgtgaaattatttcggttacatctatgcctaagaccggagttgttagtgatcctctctctgttagtcctattgatgttgacaaaaagaaagggagacgtgttattattggggatcctcggcccaagaataggatcaaaaatgcgaaggccgaagatcataaagatgcaaaggatgagtcatctagtttccaaaggaccaaaaagccgaagctcacttttgagatgcttatggctaagtacaataaaggattagccggtcaacgacttgataatcaaactagtgattcaaaaagaccaagatcatcttgtaggaagagatttggtcaaataccaaagcaatcggagccatcaactataccaactccatacaaacctccggttgtgatgccatggtatccatatccaatgtcactatatggttatccttttatgtattacatgccttggatgcatcaaccacctatgccgtattaccaagagtggaaggaatcacctaggtcaacatcaagtcattcatctaactcaagacaagaccgtttcccacaaaagaatcggtccggtggatcaaaggtgaaaaaggtgaaggtgtgggtgaggaaagaagccaaagctccggaggtcgttgctatcaatgaggaatcttaagatgttcatgtacctactggagatgcgccgaaaactatacaagcggagaagactgaagccgacgccgttactgtcaacatcggcggcttgaccaaaacagctagccggtctaaccgccagacaacggccggtctgaccgaccttcctggccggtctgatcgacggtttgtagccggtctgaccgggcctagaggccggtctgaccggggggcattagagaagagtgagaaaattgagagcaacacaggagcttccacttcgaccaaaaatatgaagaatcatcatttggctcctggaaaacaaccacagctgaagtggataccttccggcttatctcgctctcaaaagaggaggcttcagcgtcttcgggccataggtcaaaaagaaaaggaggccgaagatgtggagaacaaaacatgtaataatttagagcctcgaacgacacctaagcgagtgtggagacctaaagaagtaaaaggtaagagatcggtgatttcccaaagtagtgataaatccaatatgatgagagaagaatcatcggtcattagagataagtctccttcacatgatgctatggatgttggtgcggtgttcgtcttgcctttgaaatcgtgcaatcaagaaagccgattttgctcggggggcaagacattaatatgcttatgaagaaatcaagagagatgaacggcgatggatacaacatcacatctttgagccgccgtttgtcggatgctaaggcaaggtatgggtttttttgtgtttaacattatattatatgcctatgccatgttagaacattgcttactatctagcacatgtgtgttgtttgcttatcaaattgatattatacatacatgttgcaaatgccagttctaagtagtggaattggtaggttggcatataatttgttttaagtatgatttggttcacgagtctttgatatttatttaaagccaaattgtatgtgtttttatggatcaccatataagatatagattttataattattgcaccatgaaagttttgcttattagtaattcggctaatgtcaatggtcaatgtgatgatttattctagagttgttttctttagaaacattggcattattaatattttgcatacatgctcaagccgattacttacatttgtagtttattggaattcatgtgtgtgaggcatatgactttggtgattcattattcaattggctaagtgttttgatgccatgatgattattgtttcaaaagccatttgaattagtattcatctagacatgttagttggatgttatagtttttcatatgtctagagaggaggaattttggtccaataatttgatacaccaagcatctggctattatgtgaagaaaaattatatactaaaggccgatgcttgattttaaaagtttggacgaaattggcaaagtcatagaccaagggcggtctgaccggcattgcacggccggtctgaccggtggtaccggcggtctgaccggctctgcatagccggtctgaccgggcagacagggtggtctgaccggcattgcgtggccggtctgaccgatcccagacaggaggctggggggcacgttacaattgattaaaaggccaaattaattgtgaattcgaacatttgtgcccatgagttagaaatagcttggagaattcctttgattagatatttgaaagatcctacacttaaggttgatcggaagattcggcggcaagcgttcaaatattatatcaccgaaaaatagatggagtattacttagataatgatcaatctgaagttgctaggagagtagtacatgaagggatttgtgaaattcatcaatcggcccgtaagataaattggttgcttaggagagtggggtttcattggccgaaaataattgatgattgtttcaaatgctatagagggagtgaagcttgttaacggattggcaatgttcaactagcgcctaccgttgtgttgaatcctatcattaaactatggccgttccgaggttgggctttggatttcattggtcaaatttattcttcgtcatcaaaagagcattggttcgtgctagttgcaatggattacttactaagtgggccgaagccgtgccgctcgagaatattacttgtacggaggtaattgactctattttgaagcatattgttcatagattcggtattcctcaaacgttaaaggagcttcttttatgtccaaggaagtgagaagtattgccgaatcttatgatattaagttgttgagttcttacactcaggttaatggataagccgagtcgagtaataaaacattgttgaaattgccgttttgccagttgaggtaaatcttggctctcttcggtatttcaagcaagacgacttgtcggttgaagattataagaccttgatgggaagcaatttttgaagatgtcatcgacgagcgtttgaagactttgaaggagatgaagacacttcaagatggtgtcttcagatatcactgtatgggaaatacttgaagaaatgcttcccgagcatttggcaagatgcttaggaagttctatggcccagaacttgattatcgccctgagataacatgttctatgcttttaggtttacgtatgtttcaccaaaaaggcaggggggcatgtgtttacacccaaatttggcacctatggacgaaataggggaagattgccaaagtttggaaagtgacaggtttccttcacagggcggtcagactacaggtgtgtggncggtctgaccggctagtagggccggtctgaccgcaggtatgtaggcggtcagaccggcagggtccgagtccgagtctgttttcgtcgggtctcaggtttccttgctcgggaaggcatgtttcgtgtttcctttagtttctatcccgagttggacgtggagaagggcctgtagagggcaagaccaaccccctatttaagggacaagcccgccggttcattgtaaaacccccgaatacaatttacttgaatcgttcttttactatgttttctattttaccctagtttagtccatctttgtcggtttgcgctgtaaaccgtccgccgccgctgcgagagtgcgacacctctttgtaggtttgtcctgaaaaccttccgttttgcccacgagacgggtagttatcctcatatcgatctaaatcggcctagaggctgattttgatctctaaatcggctccgctagccggtttaggccctctttgtttaggcttaggcttattggcctagacttttaagtcagcttattggcttatatgatttataagccagtggatttaatgtcctaagtttaatggtagagtcatacatctatctcatataagccaaaaaaagcttctccaacctagcttttggcttaatagtgttagagtggcttatggcttaaaaaagccaaatgaaaaagctgcttgtttgttttggcttagacttttcgacttataagttggcttataagcctaaacaaagagggccttagttgtttttctccgaaacccatcttaatttggccctttggctagatcgaggtggttggcgactccatatcaccgcaaggcgtttaggtgttgcgatcgtgctcgtcgacttgtcaaaaaagttgccaacaaatggttctctagattgtcacctttttaataatgtgaaggtgttggactggtacacaagattccaagttattctaggtgttgcaaaaggattacattatctccatgaggaatgccatgaatgcatcatacattgtgatataaaaccagaaaatgtacttgttgatgcggacttcagcccaaaagtggcagatttcggtcttggtnnnnnnnnnnnnnnnnnnnnnnnnnnnnnnnnnnnnnnnnnnnnnnnnnnnnnnnnnnnnnnnnnnnnnnnnnnnnngtcaaatcaaggccgcg

SEQ ID NO: 14050 - DNA, 4947 bp, Oryza sativa
  unsure (1)..(4947): unsure at all n locations
tccttgnttgattcgntgcttaggacccttgtaanncanttaccgatctcataaactcagtattccattcatcccagcagtaccaaaatgtccaagacctcaaagaaaagttctggtgggtcagcatgagaaaggaaatagctgaattcgtagcactctgtgacgtctgtcagcgagtaaaggcagaacaccaaaggccagcaggtttgctacagccacttcagattccagaatggaagtgggaagaaatcggaatggatttcatcaccggtttgcccaggacatcatcggggcatgattctatttgggtagtcgttgaccgactcaccaaagtggctcactttattccggtgcacactacctactcagggaagaaattagcagaactctatctagcaagaatcatgtgtttacatggtgtacctaagaagatcgtgtctgatcgaggaagccaattcacttcaaagttctggcagaaattgcaagaagaattgggaacccgtctaaacttcagcacagcctaccatccgcagactgatggtccgaccgagcgagtcaaccaaatattggaggatatgttaagagcttgtgcgcttgactttggtggagcatgggacaaaagcttgccgtatgctgagttctcctacaacaacagttaccaggctagtctgcaaatggcaccgtttgaagcactgtatggacgaaggtgtcgtactccgctcttctgggatcagacaggggaacgccagttgtttggtacagaagctttaaatgaggcagaagaaaaagttagagctgtcagggaaagattgagaatcgcgcaatctcggcagaaaagctatgcagacaaccgccgaagggagctcgttttccaagcaggggattatgtgtatctccgtgtcactccgctcaggggagtacactgcttccaaaccaaaggaaagttggcaccacgctttgtgggaccatatcggattttggaacgcaggggtgaagttgcttaccagcttgagcttccctccaacatgcttggcatccataatgtgttccacgtctcccagttgaagaaatgtttgagagttcctgaggaacaggcaagtccggatcaaatcgaaatccaggaagacttgacgtatgcggagaagccaactcgtatcctcgaaaccagcgagagaaggaccagaaacaaagtaataagattctgcaaggttcagtggagccaccactcagaggaagaagccacttgggaaagagaagatgagttgaaggccacccacccgcacctcttcgccagctcttccgaatctcgaggtcgagattccgtttaaggggggtaggtttgtcacgccctgaagtttccccctctccttgctttaaaaattggctaaataaatcgtccgaagaaattatcttaattatcctagagctaattccctaattaataaatgcaattaataatcggaaatgcatggtggaatttttcttgagttccccatgctccaatgcattaacaagatttttagtggaattttcagagccttggaaataattttaaccaattaaaaatgagcaagcgcaatattttaatcccaggaaaaatcctttttcctttttttttcctttttcccttttcttttcctctttttctttcttgggccgtcggcccgatccagctcgcccagccgtgttcggcctccttccttgggccggcccgtttccccttccccctctcttcgggacgctgacaggtggggcccacctgtcaggtcgtccccttcctccagctgccgccccacgccggcaaccgccgctgccgccccacctgattcgctcctcccgcgcccacgccacgccgttcccgcgtcctccccacgacgccgcccacgccctgtcgctcctgccccgcgcacgcgctcgagagggcggcactctgtctctctctccaccccacgtcgccggcggtttcggccacctccccggccacgtccgcccccttccgcacctataaatcgctcccccgagtcccctctctcgtttcccccatttaccgtcctctcccacatcccctaccgcacccgcgccgtcacacccgagctccgccaccgccgcccatctccggtcgcgcgccgccgccactatagccactgccgcgccgcgcagtcgccgccgtcgcgctcaccgagcccgcccgcacctcggccgccgcttcgttgccgcgaatcaccgccggagctccgattccttcgtgagctcaccattgtttccatctccggccggccattttgggtcgtcgcggtcgtcctctccatccctaactcctctcctccccttctttgggtgttgccgccgccctccgcgcgtgagccgtcgtcttcggccgccgccgtcgccttcggccatgcgccgccgcctttcggccgtcgccgccgcttcccgcaccgtcggtcaccgccgtcggtggccgtgcctcgccgccgcctcgccttggtcggccggtcggccttgaggccgagccgagcccggccggcgcctcccttgcctcccctttgagccaccgcctggtggggcccacctgccaggcgccacctccctccctttggagccgctgacccgtggggcccacgtgccggcgccccccctttggctgacgtcagccctgggctttattgcgcaataaagtgattaaggctttttctttattagtaaaaacacagtttatcttctaaaattcataagtaattcatccgagctccgtttaagtccattcaagtctcagtaaatcaagaaaaatgcaaagaatccattaaaaatagttttgtttcctgtttcagtagtcttatagcatgttttgcttgtgtgctttgtttgtcgcgtagatttcggccgtttcgtcgatccgcggtttctcgaagacgttactgaggtctcatcagtgcgagagcaaggcaagtcatgcaatacgtttgatcatattgtacccaatttacaaatatcccgcatttctattaaatgttgcattcttttacaatatcatgtgggatgggtcctactactcagccatatattgtttaccttatgccattgacaacttgggtattaaaatgactagatgttggtttaggaaatgcttagccatgcttagttctactagtacacaaaaagggaatcacattaaagcatagactttgattattggcaatagctttggattggtgccaccgcaagggtgttggttaattaaaatacactgaatggtgggctgtgggtgcatggttttgctggtcgcacccatggcaattagggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcactgcggcgcaagaggggaccgcctactgccttttgaggggtgggggtgaaaccttagcgtggtgtggatggttaggggagggttatgtggagggtcttgtcacgatttccccctttgcagtatcatggtgatacttctgggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttaacttaatgaacgggtgtagttcaggtggttggttgggcctgttgcaacgtggtgtaacgttgaacagtgtttggttaatattgataattgctacaaactgtttactgctttcaactactgcttttaaatgctatctttatgcaaaagaacccctagcctcctttggttatatcctgcatcatacctcctcttccggtatgacttgctgagtacagtgggtagtactcagtcttgctctcttttctcccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgcagcatttgtaatcttttctatttttgtaagacgtggatctgtatgtcaacaattgtcgtttgtgtaccctggctggtcctggatagggatttaatgcacattcagcttagaaattctagttcgagaatttctgggcgtgacaccgcggggtggtcgtcgtcgtcgcgcccgacctcgccgccaccgcgctggatccaccgcgcctgacctcgctgctgccgcttgccgccgtcgtcgtcgccgcggggaggtcgtcgtcgccgctgtcgacgggtggtaccgcgactacggtatttggatggtatagggatcgtcgataccaaggtatatgcgagattgatgtaaaagagatggagacatggatttttatacaggttcangcaccttatctaacaggtaatagccctacattctattgggccgaaaccgtgttgctctttattatctggatcacacaagtagaatatttggngaaaacctatctagnttgtcgtcaacttggtggcaggnataaccaacacgtagtcaacgacaaggtagtctttcttctcgagcatgaacttctcgagatcagagatagcgctagaatcctnttagccggccncgtaggcaccggatgccgtatgtttaggctaatctctgaattcagaacctgcggtgtgggtggcttaagatatggtggggctgatggcctgtggcttcgtttttctcctgggggcttgttattaaccacagggtgccctgtgcaaagaattggagaccattgtaccaaccgaagcctggaattatataaacttatggcctcctttcc

SEQ ID NO: 14051 - DNA, 2767 bp, Oryza sativa
  unsure (1)..(2767): unsure at all n locations
cggccgggttgtgggggaaccacacatttccggttatttctccccccccatttttatataaaacagggtttaaattgagggttttgggtggccccttccacaatgtgtgaaccttaaaaaggttttgaataaatataaaaatccaaacatttttttcttcttcccacggttctttaaagtgctttttttaaaaaaaaccccctcaccctctttggtataaaccggaaaaaacctcctcttcgggtaaactttgctaagacagggggaaagaccacagttgtggtctcttttcccccacacaaaagttaaagttctcctagtggaactgtttgttccaatttgttttcgtccctcccgccaagattccctgtaaagtgaattgcccctttctaaatcagctttccggttaagctcgcttttatcttttccgcgccattggtaatcttttcaattttggtaaaccgtggatctgtatgtcaacaattgtcgtttgtgtaccctggctggtcctggacagggatttaatgcacattcagctttagaaattctggttcgagaatttctgggcgtgacaagttagcatcagagccgaccttgaccgtagggcaagccaactagaaaacctaggagccctctgaaccctttttcatatgcatatgcctttttcacttggattttgtttcgggaaaatttggggtttgcctctttggttggtgggaaaaaaaatcttggtcgttcattcggatcggatctttaaaattagctcagtctagggttttagtaaaattttatttggagtttattcgacagtcagtcgggaatctattgggggttatgcattaggtcgtgtctatgttcgatggggcaatgttatgcgcatcattttccatgcaactagtctatgcattaatttattgtttagtcagttgcattagtgtcttttgtctcggttcgtggaaaaggttgttccatgcataaaaatcaccatgctaggttatttatttgagtcatttgttgctttgtttaatttggatttgagcatgaattggttcctatcccttgtctactttagatgtcagtcctatccctcgattgcaagcgccccccgagcttcagagtcgccgcccttagctttatcgtcttcttagtctgtttgcttgctagttttcgtgtttaggtttgttgcttgagggttagtcggtggtcgatatcatgtgtcagtggtatgactgcctcaattaggagttgcgtgcctctttttcagtgttttaatcaagattaagataattgcacttaaattcataagcaagattagtttctgagcctcctgtttttctttcttttctcatatttctacctatccccctcagatggtgaagacaaggaatggttcccgtgactccaacaacgccagtggcagcgaagagctgatcgatggagcacgtgccaacagtgcatctggcaacagtccgtccccaccgcccgagaacccaacaattgctcaggtgttggacaatcagactcagatgatgacaatgatgatgcaacagatgcagcaacagtaccatcaggtgttgcagcagcaagcacagcagcagtagcagaacctgtagtttggtccctccacctcctcagtccaaactattagaatttcttcgtgttaagccgcccaccttctcaagcaccaccaacccaatcgaggccaacgactggcttcgtgctattgagaagaagctgaatcttttgcaatgcaacgagcaagagaaggttgcttttgctacacaccagctgcaaggtcccgcttctgtttggtgggacaactacatggcgacccgtccggctggggcagaggttacttggacagagttttgtcatagtttcaataaagcacaagttcccgagggaattgtggcacaaaagaagagagagttccattccctgcaacaaggaaccagaacagttatagagtatttgcaagagttcaaccggctcgcgcgctacgcccctgaagacgtgcgtaccgatgccgagaggcaggagaagtttataaaaccccaatcaagccgctccaagaggggactgctctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggcgccttctggtcgaacctgcacttaacggaaacctgtccgctttttcccttgggaaggcg

SEQ ID NO: 14052 - DNA, 1941 bp, Oryza sativa
  unsure (1)..(1941): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatttatcgagaaggattctctgtcgtacactctgctggctaaacctttccggacctgacccttgtatctttctgacccatgtatggaatgatttcttagtcaacttccgagaggcattgaaatgatttctggaagctataactgttgccttaaattaagtaaaaccattcttgatccatgttcacaccactagggtgttgtttccggtcactattttccacataactttcaaggttatagagttctaataatccatatatgatatcactctcaaatattccatccatcttttcatcgtcttggggtacccctaacactgcacctttattgggagaactttaattggttttcaatttaatttaattgatttaatgaactttgttttatttaaaattacttcttgagctccaaaaattcaagagaaatttcagagaatatttagggcacaaaggatattgcaaaaatattttcggccatgattttaaaaggaaattttaattccctcattaatttacttgataaaattaacttttacataatttctagatatgcgctatttaataatttttgatcccgaacgaaaattagggtgtgacaaagagagaccaagaaagatgggaacggtggggagtgaagggatgagcggtggggagagtgaagcgataaggataaggtggagagagatggcagtttttatatgtcgtgtttttaataggattaattggattaatgccattgcaaacatgtcatatataaaaaaaatgccagtattattcgtgaaacatagtgcgtgccattgaaatttttgaaaatttgaaccatgccactccgtcatgatttctgtcatagagatagatgccaagttgttgctatatcaccgattcaatttcatcctttctctctcgtcttgcatagattggtttgttcgtccgttcgtcgtgcagcataggggatcaagaagagaagaaggatcttgtgctgttggtaaatccgaccaagaaggaaggaaaaggatgggggagaaggttactgaagcggagagaggagtggatgatgaggatgaggatgatggctcggtagtggcagcatgcctggatggattcagtactgcagcgaagctagcgagcatccctacaagcggtggtggcgatggctagcggaggacatgtaagccgatcttcaatnggacg

SEQ ID NO: 14053 - DNA, 1617 bp, Oryza sativa
  unsure (1)..(1617): unsure at all n locations
cgacagtttttcgcgggttcacccatatttgtggaaaaccgtatcccgccctgaggaaagttaaaacgcctccccccacccaactcccgaagccaatagatatatatttacagaaaacggaaataagccccacataacgcgaaacgcctctctccccgggggtgtgtggcaaatcttataaaaccaggtggcacgcacaagtttctcccctcttgaaaaacgggcccatgtgcgcccacccacatataatttggagtgtaaggtcccccccattagggcccccacgggtctttcacctcttaaatctttcggggttcgtatatgttgtgttgaatatgtgtaacgggaataacaattttcaccccaggaaacaaagttaatgccctatgtttccgccaaacttattttgggttcaccttataaaatactccaagcttggcctcaagctggggaccaagctcgggttcaattagaaacggcccgcaatggtgtggaatttttccaaattcaaaaagttatccaatacctaccggaaagatcaaacccaagtttcctgtaaaaaaatatatagatggtagtcatttgaacgtgttacatgtgtaggtttgggcgtccatatatgcctatataatgggcacggtgatgcacacaataatcaaacaagattcacagaaactaccatcaataacaggactcctgcacttcatacatggccactgccagctctataaacaagaggtttagcctcgccggtgccacggcgcttgtcaccggtggcagcaaaggcatcgggtacgtataatcaacttaccaaatcaaactgactaattgtttggctcatacgcttcatcattccagtggtgcaaatttatcgaagcatatcatatgaattattaaccatgtagccgcgccatcgtggaagagctggcgagcttcggcgcgacggtgcacacctgcgctcggaaccaggcggagctgagcagatgccaggaggagtggacgtagggctaaccaacccgtttgagttgtaacacattagccgattcctggctcagtgtggtgaagcatcggctatagacgctctgaaagttaggttattctggtaatctctgtcctatcgtcgagttccatccattatgcgtcatgaatgcgcggacagaagggtgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgtttgttgtaaataaaaggtctcgcgaacttaaccggggggctatttgggattaaaaatcggccttattaccacccctatggcccggggcgcgctcccttattgggaaaag

SEQ ID NO: 14054 - DNA, 1806 bp, Oryza sativa
  unsure (1)..(1806): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagccaaaaacaaatatgcacacacacatagagctctaaaagatatccatcacagataagacaaaaaaaaagcaaaaaaaaacttcataacaagtgtgagaatgtatggatctgaccgccttaggaaaatccactaaaagtttcgagtttaaaaccccaccctataatttgtttgttttgggagagaaaaatctcggctaattaaactgaacagggttcgagaaggaagaagactatatataaaaaaatttttacaggaggacaacttaacccgttcgtgttttagttccgcctgtgataattcatacatcaggaggacggtttaaggctccactagtgaagaagtgtttgtgcaggcggaccgtggacgggcatatcgcaacctccactcagacaaagtaagaaatagtttttggcggcgaaagttcgcctcatctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataggttcgccccttgagggcttcaaaaaattggtttaataaaggggggaaacccgcaggctttaaaaacacgggtttcccctgaaagtcttttggtcttttgttcaaccttccttaccggactcttccctttttcttttggagagggggtttctaaaaatacccgtg

SEQ ID NO: 14055 - DNA, 1188 bp, Oryza sativa
  unsure (1)..(1188): unsure at all n locations
tgcgtgtgatatgtaccggcgcgtgtaatagaaaacgacgtgtattgagaggaagtgcgccattgtagagagcgagcggcgagtagaaggagaatgagtaatacacgcctcgctatatgatgcggcgagagaatatcggcgggggaggagtccaccgcctttaaatgggagagtggaaggggaggtcggccgagaaaccggagaagtttaggacggggctttaagatggaatccaagaggcgggcttttagaaggggtctttaccagagccttgatattagagggaggtggaaatcttgggaggaggcgcggcggactatccctccttgtgtgccggttgggcgcccaactaatcacaccgcttggaggaaaaaaccggctttcctcccccagtttgtgattgcgtgggtggcttcacacacagcccccaagttttgggtggttgtaagctcggacaccaggcctaccatggatgtcaggagtttactgaggtggcatggggcttggctgcaaccaaccaccatttctatgggtggtccgccaaatctttgccggtgggttgcgcttgcatcccagtaagctcctagttgatttgcaggaaagtctcattggtcgaggcaggtttgtctcttgggccccgcaaaaaaaggttttgggtcacctgtctgtccgcgcattcatgacgcataatggatggagcccgacgatagggagtatatctgaaggcgcgccgatgatatgtagcccatgttttggagatcagatggaaaatgcgaggtttgtttgtgctgtttgaaggttgggtgtgaagatggaggtagggagtgttctcaagagggcaaaggttcaaacggctgttgagatattagtgaatggggagaacggtcaatgtgtgtacgagagaatgagaattctgaggatagaagctgaaaactgtgtaagtgaaggaggatcattagccaccggtctacgcagctgagtagatcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcnaaatgcacttaaatcataagaagggg

SEQ ID NO: 14056 - DNA, 1157 bp, Oryza sativa
  unsure (1)..(1157): unsure at all n locations
acgcgccggtgatcccctttgtaaccgcggccagcgcaagcagcgccggtgctgcaacttctgcacccaccaccattgacagtagtggtggctgatcaagtggttccgacgaagttacctcagcggcggccggagtaaggtccggcaaaggtggtggtccaagagagatgtgcttgccagcgacattcggctccttctcgttcacggtcaccgtctccttagtttggtgcttcctcatgtggccgccgagcgcgaaacctgtcttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgttaccgcccactttaaccccggcgttttggtgggtaacccccacagtgaaccctttacattgtgcaagcgcctttaggccccgttctttttggttttttttcccttctcttttggccccgnttgccgggttttcccggttaagtctttaaatggggggcttcctttgaggttcccgattaagggttttacgggcccttccccccaaaaacattgtttgggggatggttcccctatgggcccaacccccgtaaaccggttttctcccttttgcattggagaccccgttctttaattggggccttttg

SEQ ID NO: 14057 - DNA, 1316 bp, Oryza sativa
  unsure (1)..(1316): unsure at all n locations
gaaacttaccccgcctctcaatttcgtttcgtgcgtactcttcctcttccttatcntccctcttgtgtttccattaccctcctcccnncccccccccccnaacttgtgtgattgcacatcaantgacaaaacgagcgtgaaaagaaaaggaattgactggtttgttgcataggtagtaactccatttccctttgcattttttttttttttttgctatcctttaggatgattacatctctgaagaaatggaagggttggtcgatggattgtctgaacaagtctccaggatgcactcctagtgcacaacgatgacgatgatcagtgcaagattctgtgaggcgcaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattcgggtaaaaattgtgttatattagactaacccgataaatgtatttaaaaaaggccattataccttatgtttcttgggcattttaattgtctagctcttaatgttggaaaggataccctctctttatcggttttgataaaggccgtttgattattagtgttttcctcaaattagacacctaaattttgcattggtcttttttattgcagcatttagtatattatttcgtttttcttcggtcactcgtcccggctattttccttgtaagttctaaatacaaggagctctcttcatggaatcatatatgattttttaattgacccttactccgaatactatttatttgggagtttgtactacaccggtgttctattactccactttaacggtttctccatttttgctcgggatacgctactctatttatgtttctcatctttacatggtacacactttatctatccatggctttatcttctttaaacgatactatctcatttccgcacc

SEQ ID NO: 14058 - DNA, 1894 bp, Oryza sativa
  unsure (1)..(1894): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnatagcaggagcaactagtcacagccgatgtgatgacttcccacagccgatggagtctagtcacttgatgattgccgtacaggaggagaagcaggcggaggctatagaatagacaagtgttatatagagccggttgagtttgattaagtaaaagaattaaagacatcttactggtggagccgacttgggaatcattgctgctggctttttcttcacaacagttttctttttctacaaccacaaagtctatgggtaattagccgaagagggaagtaattttggtagaagtcaaaaagagatgcttactcttgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggttttaaaaaacagagggttcccctggaaagtccttgtggcctctccgtgtccgacctggcgtttccggaaaccgtgtcgctttttctctctgggaagcggggcctttttttatagtacacgttaagtattctaaatgggtggagggtctccgtcaaaatgggtggttgacagaaacccctttagaccgaccggtggtctttagggaactttggtttggtcacaccgcgaat

SEQ ID NO: 14059 - DNA, 2112 bp, Oryza sativa
  unsure (1)..(2112): unsure at all n locations
cgatgtatatgagacggtgtaataggcggagcgcgttgaaaagagggacgtggttatagagggaagtaggggagagaggcacaagtaaagaagaggaaaggtgagcgaggtagaaagtaagaggggtggatctaacgaaggcagtagtgataggagtatagtggtagggaggagtaaagagaacggtgagtaggttaggagtgtgaagagtgggagatatagagaggagaattagggacgggtagtagtgtgagagagaaataagagaggaagggttggggggagtatgtgaagagaaggagaagagagacaggaagagggtgagtgggggcggggatgaggggggtatgaggagggaagttagggggaggggtgaatgggcgggatagaaggtgggggtaaggagggtgtatagagcacgctaatgggagtgaatagaggagagttgtgggggggggtaggagagggggaaaggggggtgaacgccaggtaggcggcggtaaagagcgtttaagacgggttaaggggcgggtaacgcagtcatataggaggtacagcgtgtgacagcttgaaccggcgagtaggcgccacagggagaattagcgggggactatgtctggcaagagaggtgcactgccaagggggttaacggcgtgtcggacgggagtggcagtaaggacgctatggcgatcaacggcatgtcgatatgggcgctgtatttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgggtgcccgattctgcttgcaatatctgccagaactttgaagtgaattggcttcctcgatcagacacgatcttcttaggtccaccatgtaaacacatgattcttgctagatagagttctgataatttcttccctgagtaggtagtgtgcaccggaatgaagtgagccactttggtgagtcgagcaacgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtttcaagttgacgagtgttaaacccgtctggcttatttaaatacccagtcgttttcccctgggagactctcctttacccctttcttctatgaacctctccgcttacctggttaccaatgtcctcgttcttcttttgtgtaagctactcatcttttccatctcccttctgtgattctctccttctttaaaacttatctctaacctactgttttttcatatcatccctttaactacaatccctcttacatctctcctccacactatatgcctcatcctaatggttcacacatcttttcttcctctctttccttattttcactctatatttctnaatcgtatcctcctgatctatcgctatccttactcgtcttattcc

SEQ ID NO: 14060 - DNA, 2094 bp, Oryza sativa
  unsure (1)..(2094): unsure at all n locations
gggtcccgtttaggggcaacgcgttcgcgcttgtgcagaagcgggtggtcctagcggcgcagagggtgagagaatccctctagctaaaggcggtaggcacactctgttgggagcactctctccccgatatccgtgttctttggcgttccgagttccccttaaatcaccttaatccggacgcccttcaggggcggcacgccattgtagaggctttgccgggagtaaaccctgtggaatggggtgccgtagagggaaggggacggtaaggctaacggttcgcgggcttatagggcccttggccaaatgttcgcgttcccttgtggggggttaccgtccgacaggcaacgggggtttgagggggcggttccaggggcggtgtccctttccgcctttcggggcctggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaatccgcagcccaacttgcttagagctaacatcaaaagagaaactacgatccaacaaatgctgaacattttaacccgccggagatccaccaatagtggctcataaagcgaaaatgcgatggactgaacttcgagaagaagtgcaccggagatcaaaatcgatgctgtgcttcctccctaattgcaacgccaggggagaagtcccagcctcccggcggcgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgggggcttcaaaaaattccctcttaatcaggggggggaacccccccggggctttaaaatttcccgggttttcccccgggaagactcctttgcgctttttctggtccaccccttcccttatacggatcctgttcgcgtttattctctttgggaaaggggggcgttttttttagtcaaccctggagggatttctcatcgggggagggcgttctcctcaaacggggtgtgttgcacaaaccccgtttaaacccgagcgtgggcttatattggaattatttgttgggaccaccggcgggaagaaatttttctctttggcatcactttataagaaataatagcagggtttttgggggcccccacatatttatggggcn

SEQ ID NO: 14061 - DNA, 1855 bp, Oryza sativa
  unsure (1)..(1855): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccggcttagcagagtacccgcacgatccttcgcctctcgcgccgtccttgttccatagtcttcgccatggggggggcttctccccgactaattttgacgtctcgggcttggctccccacattagtactagatgggtactccgcgcgttgctgcgggagaattatgtgataatatactagatattacttctaaaattttctttcttacctactatacgatttttttcatgtgtttatattttttttacctttatcaattatccgtaggttataaatgattgggttgcttggtgtgtcctttggagggaagagatgtaatttatatcctttatgaatcatccaagagcttacaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataagcttccccccccggtgcggagtacaaaaaaggcgctctaattggggggggaaacccccgggcggttttataaaaaaccactttcttcccagggagaaaaccccctcccgttttttctccacccttccgataaccggacacttttccttttttgtaaggagaggggggtttttttttattctcgcggttgtattttattgggggtggggttaactaaaaagggggaaacccaacacactcct

SEQ ID NO: 14062 - DNA, 4499 bp, Oryza sativa
  unsure (1)..(4499): unsure at all n locations
aaacaaaaatttttttatttggggggatgggcccccaaagaaggtgtggcccccccaaaccccggggagaaaattgttcacggggtttccacaaggaaaataattttttcccggggtggacccaaaaaatattccctaaaaggcacggttggtttttaaggggtttttaacaaaccaagtttgaggaaagccccaccgcgatttaaaacccaggcggtaaaataaaaaaccccactcttcccaagaaaaaaagggaaaggtttcggttaagcaagggttgaacaacaaaacccaaaggaacttccaggggaaaccccggttatttaaagtcccttcgggttttccaccccctatttagaagggaattttgtaaactcgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcccccatgcgacacgcatgccagtgggccccaccatttatcttgcctccacatgccacgtgcccctatcaaacatgtttcaccaaaggtattcacaatgtttcactatgtatatatataatgttgtagtatattgaaatattcttttgcaacaaatcacccacatattttggaaaccctctattaatgaaattcgtttcattttttgttccaccaaatatgtttcacctagtgtactcacaatgtttcactatgtatagatctaatgttgcagtgaacgaaacattcttttacaacaaatcacccacatattttggaaaccctctattaagagaattcgttttattttttgttccaccaaaaatgtttcacccagtgtactcagaatatttcactatgtatagatctaatattgcagtggactgaaacattctttcgctatttgctgaaacattatttttatataaggtaaaacaatgcccgatttaaacgatagttccaccaaaaatgtttcacccagtgtactcagaatatttcactatgtatagatctaatattgcagtggactgaaacattctttcgctatttgctggaacattattttatataaggtaaaacaatgcccgaattaaacgattgaaacattttcgatatacttagtgaaaccaattccgatatatattggggaacatcgtgtaacttttaaaaatattcaataataagcttaagaaaaattcgccggaatatatcatgtggtggttttgttttgaagaattaattgcaacgaatttaatggtgcaatcggatcatgatttgaataaataatttaagaaaaaaaatagtttaaagtagttttgtacgcatgtgtggcgctgacgtcatgcccgatcggtagtcccctccgataaataaataacaaaaacgcataaattggacttcgtgttgtcaggtattttttagaactgagttatttcttgaccgccgctgattccctcaaaatttctgcatatatatatatatatatatatcctattatttcactacttgaaacaggcgaagatggcgccaccgtgcggccgcgtggtcctcttcccgatgccgtacccgggccacaccatccccatgttccacctcgccgccgtgctccgctcccgtggcttctccatcaccgtcctccacaccgagctcagagcgccggacccggcggcgcatccgccggagtaccgcttcgtggccgtggccgacggcaccccgcccgagctcgtggtgtccgaggacgccgcggcggtcctgacttcgctcaacgagacctgcgccgcgccgttcgcggaccggctggccgcgctgctcgccgaggagggcggcgtcctgtgcgtaatcgccgacgtgatgtggtacgcgccggcggcggcggcgccagagctcggcgtgcccctgatcctgctgatgacaagcagcgcgtcgagcttccggacgttcatggagtaccctcttctgcttgaaaggggcttcttgcctgtcgacggtgagtttactccatgtgtccatcgcttggagctctgtgtttttctccctacttattttgcggaaattatgaagatcatcaagttattagaaatattttcaacatattaggtagattttctagataacgagatatagagagtatatagatttaaggtcctgtttggctaatgatatagggaaatgatttcccatctattaaaagacatctttaaatcctaaccatttattctccctctttcatttaatcctaatctttcattcatttcccaatcccaatcccactcccatttctcattatccaaacacaccctaacagtcaagacttggcatccagcagaaaagaaagaacagttttttttttccggggaaaagtaatgatctattactcaactaaagcgtcagcacagacagtctgagaaataaaattacaagaatcaccgagccaaaaatcggaaacagactcagagcaagccttattagctagcaagtggcttgcatgattctgggatcggtgggtcttctgtaagaatgaacagattcaaccgtctctgcagttctagttttaatcttccttgagatatggacagtgttagccccgtttgcttttcgtttgatgtggattttgcccgagaatcaaaagcaaaaccgaataggttgattctgaaagtagattattataattatactctgtttttctatcaaaatctgacaactggtacagaactacttttattggacatgatgtatatttaaaataattaactacaaatatgtatttatcttctaaattacttatagaacttatcctaatatgttttttcgtatttgttgtttcactgattcaatcatttcaatcaaaattcaaacagagttattttcccttatgtgcaaaatctttactgatactaaatataaccccttcatataaatggttctactccatctatctgttcatccatttctccttattttagatgcccaaaaggacactctagtcgacattctcccccctttccgagtgaaggatctacagcgcattgacacgacaaacctctacagcttcgccaacgtgcttgccaatgtagtcgccgcagcgcggctgtcatcagggctcatactcaacaccttcgacttcatcgagggtgacaacatttgcaggatccgcgacgagctctccatccctgtgtttgccattggtccactcaacaaactcataccactcgtcggaagaagcagctttcttcccccagattgtgattgcctgaggtggcttgacacacaagcccctagctctgtgttgttcgtgagcttcggcaccatggccaccattgatgctcaggagtttctggaggtggcatggggcttggctggcaccaagctaccatttctatgggtggttcggccaagccttgtccgtgggttacggctgcattccagtgagctccctagtgatttgcaggaagagatcaatggtcgaggcaggatagtctcttgggcaccgcaagaaaaggtactaggtcacccttctgtccgcgcattcatgacgcataatggatggaactcgacgatagagagtatatctgaaggcgtgccgatgatatgtaggccatgttttggagatcagatgggaaatgcgaggtatgtttgtgctgtttggaggttgggtgtggagatggaggtagggagtgttctgcagagggcaaaagttcaaactgctgttgagaaattagtgaatggggaggaaggtcaaaatgtgaaacagagaatgagaaatctgaggatagaagctgaaaaatgtgttagtaaaggaggatcatcagacaccggtctacgtaacttagtagattcgatattatcttttggaaaatgttgattatctgcacagatataacgtagtcatgtcttcgactaatacttgtagcctctttaaatgcggatggtctaatagaggctaactgaacagcgatggtaaatcgtagaagttaaacaaaaggcaatgacatattatcttctccatggctggcgccatcagangtgcaatcaatggacagg

SEQ ID NO: 14063 - DNA, 1748 bp, Oryza sativa
  unsure (1)..(1748): unsure at all n locations
cctattattctanctattanttatatatcttaatattgtagtacttctatcattatattttttnttacttatttctagtangtagtttatgattcnnctccncccccctattgnanttttntatctattanccccncnnnnnnnaanagaacaagaaggacgaacaaaacaagcacaccaacaatttttttttttcnactactttttttttttacgaccatactattaagtgattatttttttttattagattttattacttcttttttatatgtttttatttagtattaattaattttatatttattttatatttttttatatatttttttatttttattatttttttttttatttattttttttttttatttttttttttttttttttttttattttttttttttttttttttttttattttttttttttttttttttttttttttttttttttttttttttttttttttttttttttttttttttttttttttttttttttatttttttttttttttttttattttttttttttttttttttattttttttttatttttttttatttttttttatatttttttttttttttttttttttttttttttttttttttttttttttttttttttttttttttttttatttttttttttttttatttttttttttttttttttttttattttttttttatgtttttttttttttttttttttttttttttttttttttttttttttttttttntatattttatttttaatatatattttatgtattttatagttctattttattttatatattatttataactttattataagttttatatttatattttatatttatttttttatttttatttaatttatttttntatttttttttaattttttttattttanatatttgtttaatttataattgtatattttaggattgattttctgtattagttaaatttattttaaatttatatatatttattttctattnttatttttttatattcactatatttattatttttcttctaatataaatattttttttacatttttattatatttaattttctattatatattaatggttatattttttatttattaattttattatttattattatttttttattaatttatttcttatattatttcttaatttttatagttttatatttaatattatattttataatttttatatattattaatatatattttaatacttgattatattttnatattaatatgataattatgtatattgtaatttatatctattatatttttatatattatattgtttagtatttttatgatatttttttgatttatctttaagattattttttctaaggttgtataatttatataaattattattttttttatagtattnagattatttgtttatttaacatataataggatatgtatatttgttttttttatcttnattattnngtttttatattttatggntaaatgaatctataattattgtattatgttatanatagtatattanttttttatatttatttagttattaatatagttttatattactttttttatattattaaatatcttattattgtattataatttaatttggatatnataaattttgcttatttttaaatatatatattattctatgtatagagttttctatgangaattttttatatggtatatcttttatttttttatattttttatatattt

SEQ ID NO: 14064 - DNA, 3423 bp, Oryza sativa
  unsure (1)..(3423): unsure at all n locations
agggaagaaagacgtacagaagagagggaatgaggattaagaggtagaggtcgtaacggngttagtcgtagcgttgatagagaagagaggatgagagtgatgaatataagagaagtagatttaagagataaggagttaggctgtatacgggtgatcatgagagctatcaaaggtaatacgatatagcggtaagacatacgacagagcagtaagaatatatagttaaaggcgaagagtcagcgcatacgagagaagactaaggcgtaagtgttagaattcgcatagagcgtttatgttaatgataagaggatagagtacgaatagagtaagagcgggcgattgaatatgggtgacgtaggggtgataggtacaggagaactgaataagagatctcagtaagtaaaaataggcgagatatttattaggtccgggaaggttttcaggaactatatattagaagaagagaaattttgtgtaaccctagtcaacggagagactaagacgttgattagagtagccacaagcaacccgggccctgtttaaggggtacggagcctatttgcgggcccttttgacacaaattgtctttaccagagttagcaccgtaattttggtaaataacggtatttaccgcccttgaattgatcgtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtcgtcaccgcccactcgtcgttgccgtcggggtcaggctcattgtcgtcaggttattcagatctcgaaaatcaatgcaaaccctgaccttgccattcttcttaataactggaactatactagaaacccattcagcgtatcagcaaggacgaataaaaccagcatcatacaatcgtttaatctcagctttgcaggttcaagcatatcggctttacatctcctcggaggttgctggcgtggcctaacccctggtttgataggtagccgatgttcaacaattgatcggctgagtccaggcatctcataatactccagagcgaagcaatctctaaactcttttaagagctctatcagcttggttctaaactccagagataagtttttactaataaatgtcggccttggccgatcgcctggacctatgtctatttcttccaaatcatcggctgacatgaaaccttgaccttgcttgtcatcgagatcatctactgtatgcttagtgtagacatctaaaccctccacgacaccctcaaaataatagctggngttctccatctntaattggctgtatatcagaatcggatacttttagaaaatctccatcccagacttttccagataaacaatcaaggccatccatatcccanaggggctaaatagcactggcaacattaactgaccttgtcgctggcacgatctctatcttgtcgccttgccattgaatcaaacattgatgcattgtcgaaggaatgcaacaattggcgtgaatccaatctcttccaagcaacaaggtgtaagaacccttcccatcgatgacaaaaaacgtagtaggaatagtcttactaccgactgtcagctccacatttagaacacctttggtttccgatggattaccaccaaagtctttgagcaccatatttgtcttgatgagatcctcggcgtttctccccaacttccagaatgtagcataagacatcaaatttaccgcggccccaccatcaaccatcatcttagacatcggcttcccattgacatagccgtttatatacaatggtttaagatgccgattatctgtcccctcaggtttctcgaacactgcctgttccggtgaaagaaccaacttagccgattcctcttccacctcgtcgacatcgacttgatcgatcccgaattcggctggcaaggtaaagaccatgttaattggtgccgtcacaacactcttccctttggccaacctttttgcctcatcggctgcaacatcatcggctagaggaacctgattcttaacacgccactcctgcctcggttttgctttcctcagccgatgattaatttcttgttcaaccgaacagagatgaaattcaaatttcgaaacaagagactaagccaaacttcacaagatggtgcacaggtattctaagcagaggatatatcacagaatcatccacagaaacatcacagaaagagacaagagcgattttttcccgaagttcggatcttgcaatcctactctccgttgaggagctccaaagagctgggtctcaattaaccccttgcctcacttgtgcaaaaatcccagaggaaatccgcagccttcaaccccaaacacccctaggcaaatttctagaattgagtgaccaccaagatccaactcaacctactaatagaaatccaccacaagtgtgggttgctctacttggaagacctctagaatctcagcacaagaacttcactaacttttttcctgggattaaaatattgcgcttgctcatttttaattggttaaaattatttccaaggctctgaaaattccactaaaaatcttgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgggaagaacaatttgccaaagggccccaaggtcccgaacccttaaagagccgccggttgtgggttttaaagattccgcccctgcagga

SEQ ID NO: 14065 - DNA, 4577 bp, Oryza sativa
  unsure (1)..(4577): unsure at all n locations
agaaggaaagaagcagtaagggatagacaagaggtggagaagaaggtgagagtgacttagagtgaacgaatggggtagagtagaggatgagatgtggagaagagtgtgcttaatgaaaagacgaggagagtagagataagctaagagcgtgtattatagacgagaagtggggaagagttagatgataagatcagtaagaaagccgttaagggtaactgagacttagataacatttcgaaaaaagttactacaggaagaagccgtttagagatgaataaggaataccagacttgaggttacgtaaacggcggggcgaatgaaagaatcgagaccaataagcaagttacgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaacatgctagtgcgggtctattcggtgaggagttcatataagcacgaaacctccataatctattcagccgactcatagaaatataatcaagagagatatggggagggtcggtagggatcagacttctcgacgaggtcaaccggacagtgcacagttgataacaagaggagacgtagtgctgtgattgtagggttcggatcatgttgatcgaaagccgaatcatgtttgtcaatttccatcaaatcaagagttatcaatacctaccggaagatcgagacctagtttcttgtaataaaatatatagatggtagtcatttgaacgtgttacatgtgtaggtttgggcgtccatatatgcctatataatgggcacggtgatgcacacaataatcaaacaagattcacagaaactaccatcaataacaggactcctgcacttcatacatggccactgccagctctataaacaagaggtttagcctcgccggtgccacggcgcttgtcaccggtggcagcaaaggcatcgggtacgtataatcaacttaccaaatcaaactgactaattgtttggctcatacgcttcatcattccagtggtgcaaatttatcgaagcatatcatatgaattattaaccatgtagccgcgccatcgtggaagagctggcgagcttcggcgcgacggtgcacacctgcgctcggaaccaggcggagctgagcagatgccaggaggagtggacggccaagggcctcgccgtcaccgtctccgtctgcgacgtggcggtgcgcgccgacagggaggcgctcgccggcagggtgtccgccatgttcgacggcaagctcagcatcctggtagaagaacacgagcacgcaccatgatatgtgatattatcttctaatccagtataatatctctatatggacacgaaccgatgaaacggccggatggatatatatatatatgcaggtgaacaacgctgggacggcgtacctgaagccggcggcggacctgacgccggaggagacgtcgaggttgatgacgaccaacttcgagtcgtgcttccacctgagccagctgttctaccctctcctcaaggactccggaagaggcagtatcgttaatatctcgtccgtcgcttctgtcctcgcgttccattctcttcctatctactcggctgccaaaggtaaaaaaattaaactcccactctgtatgctatggacttcttgtcctattgcacaaaacaacaagcctagcttgcaaatataatttcactgaactgcacctcctccttcaggtcatatatttgacgacgcttaggattagattttgtttaacttttaaatttccaacgtaccattagttttatattattagaataagtttgtaaaatttaacagaaatttatgttatgatggtatagtttgaggcaaatacatgtataccgtatagcatgatatttattacatcctaaatgtatcgttgtcaaacggtataaatccaactccatctatctagtttattttgtgagagcgtttcacccaactcaactcccactatcaggtggatctaaatctaacttcatctatctagcttattatgtgagagggttattccacccagcgttatttcagatctcatgttttattttggcacgtggcgcgcacatccagcgcgagagaaattaatgaattgatttatgtgcacttgcttctcaagttgtaataatcactagctatgcgctttgtaacgtcaggagcaatgaaccaagtcacaaggaacctggcttgtgagtgggcgagcgatgggatcagagtcaattccgttgcaccgggctacatccagactccactcctaactgccgtaagttcctcgttttacaaatactccctcctcctattttatgacgccattggcttttcgaccgacgtttgaccattcgttttatttaaaaattttatacaaatatgaaaatatttatgacattcttaaagaacatttgatgataaatcaagtcacaataaaataaatgataattacataatttttttaataagacgaatggtcaaacgttgaataaaaagtcaacggtgtcatacattaaaatatggatatggaggtagtaatatttttcaaaaataataatagctaggtactataattttagtgccgctttgttttagtatcttgctacggcctattagtgtcttgacatcagagataccgaaatgaaaggtatgatgtctcattatattttaattttagggatcataaaagaccttttttttttctaatgaacgggcgcaactaattaataagactgtggtccccggacgatctcgattacttgctggacttttgtaaactttcctagagaggttgaacagttcggaaagcataatttggggacaaacaaccgggtggcatgtggtattttgcgttttgtacaaaattatatctttaaaaaatactattgggttcatctgttgtttgtcaagctaactgtttttttttctaatgtatatatcacttacatgtcacaatttttgttaaggtgaaataaacagtgttctaactattttcaataagaaattaatatactttagtgcaaatcttagtaatacataaacacaccaaattataagctaggaagatgcaacatctggattaataaaataaaatcgaaaagttacactaaattatacaagagttgtgatctttcggattaagggtttaataagctatttaatgtgctacgttttagtcgatggcaattaagaagaaaatatcagatgactgtaaagctaaacaccatttgaccatccaagtacattaagaattgaaaagttttcctacatttaatgtgagaattccaacctaattttgctatatgtcagatgagactaaagtggaaattgtaagagaaagaacataaataattaaatactatttacgaaagtttgtaactaggacatagtactacttattatgaaaaagtttataactatgacatactacttattatggaaaagtttataactatgacatacttatatttctcatatatattgttgctaacacatggtgcctgcactgcatgtgtatagttcgtggccggcaacgatttcgcacaggttgagttcaaccgtcttcctttgggccgtctcggtaaacctgaggacatctcgtcgttggtggcgttcctgtgcatgcctgcggcctcctacatcactggccagattatatgcgtcgatgggggccgtatgctttcttaataaactctacatatacaaaataaagatatatcatgtatcataatatattctactgaattgggagacttccaagaagaatgaaatctttgtgtgcccgtgtaccaaccacacacaacaggctagctagtcttctctgcatgcgtagagcatagactgggtgtaatgtgtaaaatggccaatatatatttgtattaagtttgggaaatcatgtggagaagattggcaagccgagtgtaatgaattttccatgaaataaaatttacggttcctatgattattgatacaaaacagtatgaatgagaacctgattngtttgacttaagatcattatanggttattcatgctgaattggaaaaataactatttattggatcgtncctttatacactagtacagataatttattgtgacgcttcctaattgtctaggtttggcggccgtcaccttgaagtattcaaaacagccccaaacgaggncgacaaagattacttgcacaaaccttgtagatggcataaaaatcgagccggtacggatgaaacctattgggagggcttcaactggagaccacaaaggtaacgtttgaattttggtcggcctaaccaagcag

SEQ ID NO: 14066 - DNA, 3413 bp, Oryza sativa
  unsure (1)..(3413): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataactgcttcaacaaacgacactgtatatattatgtcaatcggggaagaaagtgctgctagcagctcctaattagttggccaatctgtcatgcgcgtgcatcatatggaaacatgcacttgcgtggctgtctgttgatgctcatgatgatcagaaaaataacttggcgactgacgtccggtcatgccgatcagagaaacaactcggcgacgacagtgattggatccatcgcttaaattaatcttgccggctagattggatccaagttggagaagaaaagcttagcgaattcgtcggcgacgagaaagttgcagctcccgaagtaaagaggaagccggcgactcgtgaagttgattccatcgtacttgtcgatagaaactcgacgcacccctacctagcgcgccaactgtcgaaacatgaattcggcaataataaaagggggtagcgcacgagacctaaaagtggatggatgcggagacaaggatttaaacaggtttaggccctctcaatgagaggtaataccctactcctgtttagggatttaaatccgccgggtgtagtatagatctgacgatcatatgtgctcatgccccctagagggcctcctgtccaccttatataggatgggagccaggattacaagatagaaaccttaaccaatacggtatcggtttcctaaatctattttacaatattgtcaaatcaggactttaggtcgctccataatataaaaggaaacgtaatacccaagtcatgatttgttacatattcctttgatataagctatcccctatgactagtcagataaccatgccgtatgggtatgaggtacccataatctccacatggcaaacacataattgccgatgaccgcttctctgtcctctgatgagatagcatgatcaggttctctccaaaatgttaggaaaaaatttcaatggcaaccatatatcgtaaacaggatacttgtttgatatgcaatgcccaaaccattgataacaggtaaagagtactatgatctgctcgtcaaagaccacgaagaaaaaatgatctacagatgtctgtaacacactaattcttgaggatatattagcaacaataaccttttggtatgcacttgtgttacaaattttataacatcgaatgaataacaggaaacctaaccattaccagaaggatattaatagtgtcagcaaataaagttgggtaaacattgcaaaaatcatctctcgggatcaaggtatattgcaatcatgttatcttacaggaatcctataaaaaaagcaaaataccagggcctatattgtccatgttggaagatttaaaaaattggttaaagcaaatgtaattggcacattaaaatgacaggaaggaataatatgagatatagcttaggaggttgacaaattacagattaattagcattctttaactgtagatagaaataaatgtaagatttgatgcagacgcctactcagtgctcatattacttccatagatactctccatgcactttagcttgttttcacttatagaaaatcggcatccttatgagagatttagagtctcatgggagcataaatctctactatctcataaccatttgtgataccttttttttcgagggtgctcatacctaaacacaaaaaactaaaatacattcctatccttgaaaattatcaaaggccattgatatgcagcttgaggtgccatggtagaaattaggcgagattccccatgttgatacatctgctgatgatctgcagttatgcacccatccacaacaaagtcaattagtatacctggggatactaccagctttttatgaatgataatcaaatagtgtgttcccaaattagataagatatattgagcactcaaccattgggagtttatatattgaaggacaataagtacaacgtatctgagagcatatttttagagtttatgaaaaattgggcggcgaccggccggcgatggaatcagtctgcggcgcgatgtagagagaccacttaacataatggttctagcatgtagatcatagaataatcaaataatttgatacccctggatacccctattctggaaatagtacaactgaataaattggctagactacagtacaaagaagaataattgaataaattggctagactacaatacagagcataataactgaatatgttggatagattatagtaccaaccaagtctaggtataattctgtccaacagaattaacagtgcacatgctattctctttcaaattcacatgattcataccaaaattaatggttcagacttagtaacattttaaacatggaatcaggtaggggaacatatatacatgatgagagttggggagaaacaaagacctttctagcaacttgtgttagggtctggcccgtttggcgtttgccacccaaatttagatccccaggagttcgaaaaagccaccatggccaatcccatggaactggaac

SEQ ID NO: 14067 - DNA, 4530 bp, Oryza sativa
  unsure (1)..(4530): unsure at all n locations
naggccccaccaggttcgaggttatattcctggccaacaaaatttaccgaggccccctctatttcttttccaaattcccctgattccacccaaaattataggttccagccttagtaccttttaaacatgggaaccgggtaggggacccataatcccttatgaggggttgaggaaaaacaaagaccttcataccacctgttgttagggtctgcccgtttgggcgtcctacacccaaatttcagttcccaggaggtcagaaaaagcagcagtgtcgatcccattgaactgcagctcaccgagaatgtcacggagaaatgtcaccgaatcccagtcccatggtataaagtctttgaggtacctgatttagatttcagtaaacaaatgactacatatgattgagtaaataatatgggcacacatctgcaaataaaagtaacattattatgatatagttattgtagtgaatactcttttcatatatatactcgaactgcttgtaaaataatttaacaacaatgttctcttctccattgcaaatatacaaataaataaaaacccatgaaacattaagctcaatttattgtaaatcccatcatcatgacatcataccatctcattttcaaattacattttcaaggaaaaaattattagtctgcacaagcagaatttgaatgacaactaatagtaaaaactgaaatcaagaaaatgaataatctgaaaacttttccctgcattagttagtacagagtacgtgcagatcagtggtgagagggacataccgaactccttggcggaggtcgcgctggaccggacggcatgggcgaagcccggtcggcggggaaatccatttgcgatgcgatgtagagagaacgaaggaagcacgacggtgactggatggtagcggcgcgatggtgacctgcgggggcgacggcgattgacggtgacctgcggggagacggcggttagggttgggaatcgcaaggcgaggaggtgcgatggtggtgagggcttccggtggcgaggaacggttgggcgaaagcgtaaaaagatcggtgaggaaagcaatgccggtgggagagatcgctgcggagcagatcggcgcaggcggcgacctagcgacgggagggtgaggatggattttttttcggaagttacgggggatagacggggtgagcgtgtcgatgagtctgaccgttggataagcgttgaagcgatgaggtgcgttggatgtgtgacatgatgaatgatgaatgagtaaaccatttgtttaactataggatagattagacattctcaaaaataagtttatggggattggattttagcagtttcatagtgatgcatgccgtttggacgtacatgtgtgttttcgtgtaattcaaaaaaaaattgtatttttttcatgtgcagacgctcaagaggaccgtatgtgatgtggttgcattatgggtcctcttagagcctactggggttctcatgtagaaaaaattatttgtgaagtagtgttgtgaaaaataatgggactacattaagtgaaaatcaaaggtcggatgtttttgtctcttcattgaattttattaggccatttccaactcaagacactagccatagtttccttaaactccacatcattaagaaactagtaatagacactactcttccaacgcaaacaccactattccatacttaaatttaatgctacttatctcacataatgtcttggatgttatgtagaaaccatgtctaatgcaagacgtggtttccttctctttcctcatttattcacttgccacgtcatttttcatcctaggtggcatcttatttaatgctatggacaacatcctagtcattgggttgggaatgcccttagagaaagtttaatagtatagcccattactagctccaaatcatttatagccaatgtaatagccaattcatacaatagttgcttactatatgtcacgcccagaaatttagcccaaatttttagactattttgtgtattaaatccctgtccaggactagccagggtacacaaaatgacaagtaataaatagatccaaacgtaaataaagcgtaaaatacttaaagaataggcacttagtcctcacactgaaacaaaagcagcagcagcggaaaaggcgatcctagcggggcttcagctccactccataggcaaaactcaactgaggtctgaaccttggtcctctaacttcatcttcagctcagaagcactacacttctgaaaaaggggaacaacagcaaggctgagtactaccaccgtactcagcaagccacaccaatgatgcagacgtgcaagggcagacaaagaggggtttgtggctatttgcataaaggcggttgtaaaacattttattgagcaaaacggtaaaacagttcagtaattaaagtaatattaaatttccactgatcaacgctacaccacgttgaacaggcccaaccaacctaccagaactacagtgcattgggtcgatttattaagtgtgagactaatcacggtgaatctggtcgatcgcctataaccgcgggcacggctattcgaatagttttactttggccaaaggtgcacaactgtacccacaagacacaatccaccggcatgtcaccatgtcatcatgtgccctgatgcacacatcaccatgtcgagtgattgtgacaagacccttcatataaccccctctgaccaatcgcaccgcacctcaggtttcacccccactcctcgcaaggcagcgggcagtcccctctcgtgccacggtgaatccagaagccgatcaactgaataccccagccaacccaactccattacgcccacccttgcctgggaacgtcagccagaggaaagctatacttcaagtcaggcagttacccattcctgcttgtggcaagcgctgtatgtcttccagggtttcccgcgaactggtccttcattgccatgtgtgcgaccagcaaaaccatgcacccacagcccaccaataagtcgcattttagttggataattatggccaataaacatggccggatgtctcgagcacgcagctcattcagatactaaaaaggtctaatactgcaattatcccattaactgagctagtggtaattaagcatggctaagcatatagttctagctatgtcacataagtaacatgagctagtcgatttatcatccaaggttgacaaagaacagatatcaagtaaacatggcacaagcgagcagataggtaaaccctattcccatgtaattagcaaaacatgcatatttatttgcaaacgataaaacatttataaattgggatcaacatgcacaaggggaatgtgtgacttgccttgcttcttcaaacaatcttccgaactcttttcttcgcgaccgcggactttcgaaacgacggatactacacgctggcacgcaaaacaaggaaaatctctaataaataccaaggaaatagtacataaaagtaaacaaacatgtagagctcaattttagatgagttttgcaagttgaatggctcaattcggagttcggatgaattagatatgaattttagaagttttgaaccattttaatggatttctagaattattaatgatttattgcgcaattaataatggtttatgacgtcaccaaggggaataggtggcgccgacaagcgggccccacctgtcggtggctcaaagaaggtcggcacacggtggactcggtctacgtgcgcactgcccgcgggcgcaccacatggcagccacgaggtggccacggcggacggggaggacgaggtggcgccgatgtggcaccacagggcagcgacaccaggcggcacggggagggccacgtggacggcccaaatcgcccctgtagggggatcgggcggccacgggcgagcaggagccggctcaccggctggccggccggggagcgacgatgcacggcttgatggtcgccggcgatgaccactggcgtggtgacacacgcgggaggcggcggaaaaaggggaaagggagaggagatggaggggttcctcaccgaggggcgccggcggagctctggcgaagggaggtggcgttgcttcggcgacgggcggcgcttaggaagaaacggacgagggtggccgcgacctgcggaaggggaatgagggattaaggaggggaggaccggagcggtgcagctaaaacaatggccggtagcgacagtactaggtggagctcaccttgagtgatagggatggggtttcggcgatgattcacggaggatgagcggtggccgagcttgcccttgggacggcaaagccggtggaggtggttgagcggcgcagcgacggctaggacggcagtggtggtctgctggagacggcgtatggtggtggtggctcgggcgtgtggtgnaagtggcactaggcggttgttttggaaaggtggagtggcggctggcgtgcggcaaggtgtggcgaatgtggtgnaggcggtggtgcggcatgaggtggctgggnncgccgacttgagactgaattcaaaangacg

SEQ ID NO: 14068 - DNA, 2954 bp, Oryza sativa
  unsure (1)..(2954): unsure at all n locations
cggcaatggtacgggtccctgtgggggtacccccccccccgccgggtttaaggcccccttaagggggggggccacttgcgcattgggggcggacttttattttccccccagaccccggggttaggggggtttttgatggcccttttcgcggggggtgtaggaccaccactttttttccccgaatacggaggccgggcccagtggcccataagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacggcaaagccggtgaaggtggttgagcggcgcagcgacggctaggacggcagtggtggtctgctgaagacggcgtatggtggtggtggctcgggcgtgtggtgaaagtggcactaggcggttgttttggaaaggtggagtggcggctggcgtgcggcaaggtgtggcgaatgtggtgnaggcggtggtccggcatgaggtggctgggaacgccggcaagaggcagccggagaccgacacaggcggtggcggctcgggttgatggcgaagctggtggctcgggggtggattggaggattggaccggctgccggtgtgcggcgtgaggtggtaaagccggtggtggtggtttctcgatgcggcgacgacaggaacggcaacggcgcgctgttggagagctccagcgagcggcgcagctcggcctcgcgcggggagagcgggagaaggcgcgacgggctcgggaaatttggggaaatgggagaggagagcacgaggatcgtttttatgggctcggggtggtgagatcgtggctgtggagggtggaatcggccggcaacggccgacgacgtgggtgacattgtgggcgaagtggggactcgatttggcgcaaaaaattgcggaaaagtgggggatttggtggaggagatggaggggaaccgatttcactcggtttgggcgcgagggcgcgggtgggagggcgccggattcggcgggacgtgggcggcaacggccggccatgggcggcttcggcctgggaagccgaaggtagtaggaggacctgacaagtggggtcgccgggcccacctgtcggggagggagagaaggaggagaccgagggggttattcagactttgtgcgaggggaagtcgatcgcgccgagaagggtggggtcggcccgagagggaggagggaaggagagaggggcgagcaggctaaggagggggaaaagatctagggccgaaaatggcccaaggagaaaggggagattatttgattttctttttatttaattggttaaatgatatttgtaatagtaaaattagatattgagcttcgaaaattcgcgggaaatttcagaaagttcattagggcacaaagaatattacaaaatattctcggccatgatttttaaaggaaaattttaatttcctctataatttcacttgattaaattgatttaacttttatttaatttctagaaaatgcattattaaatgatttttaatcccgacgaaaatcggggcattacactatactattaatatatggtcccacctgttatacatatattacgtcttggagtccgcgctgcagctggctatatatctgtaacccactgctcttctctctctttttttatctttttaaaatatatgtttatagctggtttatagcatgctattgtacatgctcttagagcaccacaccatagctaataagtgttcctagaaagcttaataaattttaataaatttttatcgtatggtatatactccgtagatagaagataaattccgtcgacggatatctcgactcaccagtatggaaacaggagcgtatggtagtccatcattttctccgtgtgagacagaagtgtgacacccttgtttaatacctagggcaggccgccataaagtccgaaaataacatcccacctcccaaactaattagctaacttcctgtctgagctaggaatcccacaccggtattacctgagataacgaaaattcttcgcctcggacgaccggcgtgggggagcgaaatcgggcactcttcccccatgcgacacgcatgccagtgggccccaccatttatcttgccttcacctgccacgtgcccctatcaaacatgtttcaccaaaggtattcacaatgtttcactatgtatatatataatgttgtagtatattgaaatattcttttgcaacaaatcacccacatattttggaaaccctttattaatgaaattcgtttcattttttgttccacccaaatatgttcacctagtgtactcacaatgtttcactatgtatagatctattgttgcagtgaacgaaacattctcttacaacaaataacccacatattttggaaaccctttattagaggatccgttttatttttgtccaccacaaatgttcacccagtacctagaatatttacttggataagactaatatgcattgactgaaacatctttccttattgttgaacttatttttattaagtaaaccaagcccgattaaaccatagttccaccaaaagttttacccantgtcctcaaaatattactttggttcn

SEQ ID NO: 14069 - DNA, 2028 bp, Oryza sativa
  unsure (1)..(2028): unsure at all n locations
ccgtcatgatgctctagnacccttgcannagncnngnncgacgagttcttgctttcgggttgagctgcatcggtttcgatcttcaacaagaggtatttcttgtttttacatgtaagtctctcgagtcaacgtataagtgcattgaagaactgcacagctagatgatactgaaagtgcattaatccccctagtgggttttggtgattaatgacaaatgtggttaagggactaatgagttcattgagtaactttcaggtgcattagtccaaaggtgtggaagatggatgcttggagaccccccaaaagtacaaaatcaaagcggactggaactcgagaagtgcataggatagtttatcttttgaaatcgagtttttaggaaaaaccgtactattaagaggggttccaggtgatgctctgagatatgtcaagtgctcttagtgtgaaccaagtgtcaagtttccctaggagtcatttctgcttatactccatctgtccaaaagtgcaggtccggaacttcctgtcttctaggtccggaagttccggtctgatgaaagaatttttccaaagtgttatccggaagttcctggcttccaggtccggaacttcctgtctagtttccagttcaaaattgtgagtaacggctagatgacgtcacctagtcattatacatatacagctcgtttccagctcgttctttggccattccactttcacttttcgaacctagagctgttgctagcctctcccaagtgtttcttgccttctccactcaatctagagcctaattcttgtgagatagagagattgagagggagagaagaagatttggagtggtgtgaagactaggaacttgtgtgagcacttgaatatctcgtgggctgtcatctcggtgcttattatctcctagacggttaggtatcacccgcgagaatccgttgcatattgtggatgtcccgggtaagtttgtgaaggatttcctttcctccgaaagggaacgaggtaagttagtgaagttcttgtgctgagattctagaggtcttccaagtagagcaacccacacttgtggtggatttttattagtaggttgagttggatcttggtggttacttaattttaaaaatttgcctaagggtgtttgggggtgaaagctgtggattttctttgggatttttgcacaagtgaagcaaggggttaaatgagaaccaatttttttggagcttcttaaagggagagtttgattgggagatccgaactttgggaaaaaaatgcttttggatctttctgggaagtttattggggatgaatttgggaaatattctttggttaagaataattggtggacaattttgtgaaagtttggctttaatattttggttttgaaaattggaatttaatttttgttcttgttacccggaaatttctgtgtttaaaacaatggaagttccgggcttgggaagggcggaagtttctggaatttcttttccaggaagttttcgagttttattttaattttaaagggttggaattttgtattttaaatatttaggggagaaacttatttaaacccgtcttttaagggttatattaaaaggggggagaaaaataaaataattaatattttaaggcatatgagtgtggctcagatatgaaaaatttaaacaagttttgggagaataataggtatataaaaagtgtgggtgggagacttttggcaattttattcaatcgggagaggaggggttttataaagatgtttgtttaaaaaataaaacaggtttaagttgaaaaagaaatgtgatatctacaaatgggtgtgtaaacacaaataaaaggtgttaaaagaaagaataaaaaaattttatatctggaggtcttaaaaagaaaatatacataaatatgggttttataatatgggaaattcgtggctgtgggggggcgtttatatggtaactagatttgtacaaattgtagtaaaatgggggttttttgtgggtaataaaaaagtggtgaattaggtatattggtctg

SEQ ID NO: 14070 - DNA, 1184 bp, Oryza sativa
  unsure (1)..(1184): unsure at all n locations
cctcgatgattgtataggtcccttccacncgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatagtacttgcacgcccaaatcagagttcgcatgaagtcatggcgaccgtcaaaagttgggactgtgctgcagtccgaatccaccccgcgcgaatcctcacccatttgattctctccattgttcctgaataaaacaagagtgcacgtgtctccggggaataaataagaatcatatgaatttaagaatgaatgcacctgatagttgagttgacgtgcacgagcgcgagtaataggacgttgaagttgtacttgtggaggcgtggatatatcgttggtgttgatgttctcatcaccgaccctgacgacgacgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccttattcggcatgaaagccgcctctagctccccccctatttgctcagagtgccggctttccttttctgttgaagaagtgtctctccctgcctcccccgaaaatgtcacttacatccttctcataacctcctattccgtggcaatttaaatctcccctctataatcggctaccgttctcccctctcttagctcctctatttgcatacgtttttggttcatatcctctttaatacctctctcctattcctactatctatattcactaatccactctctattctcactgttccatcatctacaaactcgccttatattctcttgctccatattataacttcgccgn

SEQ ID NO: 14071 - DNA, 1124 bp, Oryza sativa
  unsure (1)..(1124): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaagaaaaattgtgcaaacctgctttctgtataaaacagaggatgattcatatggtttgtcatggcttatcacttttggggtgatcttgctttggttacggcgttgatgtgcaagatcacccccacacttgtctttgtatctgggatgctttattggacacaaaaagaaaaaacaaagacaaaagtgaagcggaaaggactcacttggttggaagaccaaggaggcgactttattttattttattttattcatgaaagctagacctaagataactagaaggaggcctaaggactcatggcattaaaaactaacgaatcaagggggacctgaggactccgggtagaagctaaaagagactagattcacaacatctatgtgacgatcaacttctaacggatcaaggaaaacttttaaacgatggccatttaccttaaagatgttaccttcgttgtcgcgcagagtgacagctccatgtgatgaagcgtcgactacggtatatggacctatccatttacttcanagtgttacatgcaggcgtcacattg

SEQ ID NO: 14072 - DNA, 3000 bp, Oryza sativa
  unsure (1)..(3000): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaggaggaggtggcggaggacggcgnccgagctattgcaggtggtcggcggtggaaaatttcggcagcctaacggtgccaaattttctagggttcctgcctggacttagaaaatttggcacgggggtggctgcccttatatagggtgcggatcttcgcaggcgggggtctgcctgtgaagatacgttttggcttttttcgcaggcgggccgcccggctgctaagatgtctccgttaaatattttcctaggagcacacgccgcctaaaaaaatactttcagaaaagtgtaataacgctgctagttcgatctgtggaaccccaacttgtcagattcatcttatatttgcaatattttcagattgcatcttctactcacttgcttgtgttctcgattctcttgtaggatatagccttatcgggcaggtcaatcatgtttcggctcgattgataaccaagggaggagtggtgtagtgaatgcgaggggttcaatcgtcttgatcaaagcctttggatcatcaacgttgagtctccataatcgatttaacacctataggaagaatgagaccctagttcctcatcacatgatttttgccatatggcgggtcttgccgagcttagaaatttaggactgtgacaatattagaaatacattatgtacaccaagaaatgatgtttaacttatttgctccattatttcattacttttatttataaaactttggtatgccacatgttccttatttcttgcaaatccattatttaaattttagccaatttctattatacaaaatatatttgtcccagaaagaaaatctcaatggaatgacaaggaaataattggctcaaaagatgaagcatgcacttctcattacatcaatgttgagaattttattctttaacgtatgtttatatcacgagatcaaattttggttggtttgaagcgtattaaggagataagctagcaaaattcttgtgaattatccactcaattcacgtaacgaggaggtattatttcagggatcaagattgtggtaggccttgtccctccattcttccagctcagagagctgcatcttcctgtgctgtccggctcccttcaagtccatgttccaagtccggatagcccagtgcgccctgtgttccaactctaccgaaagatgacaagtcttcccatagacaagttggtatggtgacatgccgatgggcgtcttataagcagtcctatatgcccaaagtgcatcagatagcttgttcttccatgccttccccatctcattgacagtcttctgtagaatattcttgatttgtttgttactcgtttctgcctgtccacttgtctggggatgatatggagtggcaatattgtgctgagcccaaagttcttgcaataagttttggaaggtcttatcgatgaaatgagaccctccgtcacttatcaccatatacggagttccaaaacgagggaaaatagtctcgtggaacatccggcgagcgtgcttagcgtctgcggtcctgcatggcattgcctctacccacttggacacatcatcaacggccactaggatatactcgcagtcataggactttgggaaaggtcccatgaagtcgatgccccatacatcaaatagctagacttgaaggttaaaattcagaataaagataagtaatattgaaaaaatagtccatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14073 - DNA, 1139 bp, Oryza sativa
  unsure (1)..(1139): unsure at all n locations
cttgcatgtgatagatccatacccctcttaacaaccgtgttatggggcaatgggctgttttcccggggaaggttaaaaccggctcctgaagaagcggaattcacaaaccgattttaccaccgatgaagtatnacacccttaagcccngatgagttgaaggatctggttacagtccagattggcgtgtccntgcaaagggttacccaggaccaaggaatgtgttactcggcacttatataagaaaagtggtgcctnaaagattttacagaagnagactgtgtatggaagttgattttgcgatttggtaacggtgatggtaatttcggcaagtggtcgccgaaatggaaaggacgtttccaatttattaaggttgtgtctaagggagcatatatgtgcaaagggcttgatgggtnaagtctatggcgagcgcttcaatggcaaatatttgaagaaatattacccgagtgtttgagttaatgcatgacagccgatatgtttccatcgccttgagatggccgatatagttatatcacccttagttgtttttatggtgtaatcggttgtggtttgccgatgaccaatggccgatattgttatatcgcccttagttgttttataattttatcaatgcttttgacattgtaaaattaggggggcacatacatatcaaaatgcaatgcagcttacaaattttttgagcacatatcaaaatgccatgcagattgtcaagacagtaaagtattataacgtcttagccgattacaaaatttgtaagttctattacatacaagttattgagacaagtattgctggatagccgatatagccttctgcctaatctgttccacttcttctatggcttgggcatcttgagcgtcagttccagggataactttcaaggacttggtcatatcagcgacattcttgatagccgattttagctttgccttttgttcttcaacagcttgcgggagatcggctagctttttgtgctccatatccagctcggcgttgcattcttgaagttgtgccatgagatcaatcttacgagcttcaagccgatcgatatttgacttgattatgccttcagacagctgatctagataaacttctcgacatgcgtagcacaagtgtaatag

SEQ ID NO: 14074 - DNA, 7643 bp, Oryza sativa
  unsure (1)..(7643): unsure at all n locations
ggagagatggagagaaggagagagggagtgggagggtgggaaggaatataggctagcgattagagaagagtaagagatagggtaagtctatacggatacgaagtaggataggtataggctaaagaggaagtagagagaagagtaacagtataggtagagtagaaataagagtgagttaggatgaaggaaaggggagggtagggagagcaatagtcaaggagagggagtattgaaaaatgggtagcagggcaaagaataagagtacgtatacgagaactgaaggagaggagagaggaggacaggggggaggggaggagggtgtagcaagaaagaggagaggagagggtgggtagggatagggtaagtagaataagaaagagtatggtagagaggtaaatgggcggtcgagagtgaggaggagagggaggcgagattaagagactgaggtaaaagatacaagctaacgataaagcgaatgttgaataaagtgttagacagcaaggttcgaaatggcttaaggagacgacagatggtatgtcaagttgttacgcggggtttgacgaccacaaacatcggtgtacacgcagatagtagcgggtagggccccgaaatgcgttgaacgcaagaggaagagcttaagaggagatgacgactttattaatcatcggtgtgcttacaaagtgcaccagcagcactccgtcgaagaattttgactaaactcgaaaccataactcaaaagtcaaatcaattgctctataaagcgatagagggaagcttnnngntnnnnntntggtngnnttagttcntgnaattngatcctacagttgcaagccctattccatgacagttgataccaatgctaagctatcctccactgatggtaatcctgtgattgatctgaccgtctatcgtagtcttgatggtgccttggagtacctcacctccactcgatatattagatatctcttatgttgtccagcagattttataccgccataaagcgtattctatgctacctttgctgtactctggatcatggcctttacttccaaacattcctccacatttgacttagtggcatagtatgcagctgactaagctggttgtcccgacacgaagatgtttacttaaggctacgtcgcgtttttaggtgataaccttgtctctttgtcctccaaacgtcagaactatgtctcccgctccagttccaaggctgagtagagtgtcatggcaaatgctgtggccaaaatatgccgggtcaccgtgctctactgtgacaatgtcaccgtcgtctatctctccacaaacctagtacaacaccagcggatgaaacatgttgagattgatcttcactttgtttgtgattgggttgctgctggtgcggttcatggtcttcatgttccgacgccatcacagttcactgatatcttcactaaaaggttttcgtggtgctattttcttcgagttccattcaagtctcaacgttcggcctaccgactataaaacaaagggggtgttgtgtatctcgtgtatatggcgcacgactacaaaaaccgtttttgcaaacaggtggattgcattttcgcatgcggttggccggtacacatgcgcgagaaggtctgcaaagatcacgatctttgcatgcggccagtgcaaccgcatgcaaaaatcggattttcgcatgctgatgcttaagccggctgcatgcgaaaatgaaaaatcgcgaaaaaaaaataaaaatccccaaaaaaaaacccctagccctaggcgcccgagctcgccgctgccgctcgccaccacgccggatccatcgcgcccgagctcgccgacgtcgtcgtcgtctcggataggtcgtcgtggccgcacccaagctcgccgccgtcgtcgtcgccgaggttgtcgtcgccgtacctccgccacgctcgagctcgccgtcaccacccgtcgccgtcaatgtcgccaaggtcgtcgtcgccgcgaggaggtcgtcgtcgctgcacccgtgccggatctgccgccctcgagctcgtcgtcgccgaggggagctcgttgtcaccgcgggggagagtgccggtgccggatccgcgtggaaggagggcggctgaccccggatctgctcgggggagggctacagtcccaagatccgatctggccgcctcccgcccccgtgtgccttctttcaagctcaccgccgccgcctttcgagcccgcggcagccgcttttcgagccccacgccgtcggcctttcgagccccgtgggaccgccgccgccaacgcttcatgtacttcctggctctacgccatactgcccagccgagagggaggccgacgccgataccgacgagctccgcacacgtgcgggcgggctcgggcgcagaacccgccgcagaggagggcggacgccgatgcngacaagctccgcgcgcgtgcaagacggctccggcgctgcaaccgcgtgcccgcggcgcgcacgcacgccgccngcggccacgcgggcctcgtcggcctcgccaacgctccgtgtccccccctacctttgggccgcactgccccgccaaagaggaagcccgacgccgacgccgacaagctccgcgcgcgcgccggcggcctccggcgctgcaactgccggaaagggaggccgatgccgacgccgacgagctccgcgcgcgcgccaagcggctccggcgctgcaaccgcgcgcacgcggcgcgcgggcacgccacccgcggctgcgcgggcctcgtccgcctcgccaacgcacacctccgcgccgatgccgccgccctcagccgccgccccgcgtcaccgtccgccgctgccctcgtcgtcctcccgctgcagtgcacaggcgtggtcgtcgtcgttggcggcgatgttggcgctcacgaggcagccgagctccatcttggcgcggggctggagcgccgggtcatgggtgaccagcacagcgtcgccatagctccgtgccgaggccgccgcccccgcgtcagcgtcccccgcctgctgctgtctagagagagagagaggggaagagtggaggaggagtatgacatgcgggtcccacaatttttttaaaaatagaatgctgactggactgccacgtgtacgccacgaaggccaaacccaccacggattggattgagggggggtatttcgtccggtatgcatagttgggggtgaaaaatatccggttttgtggttcgggggggggtaattcggatgaccgcaaaagttcaggggggtaattcgtactttttcctatatgataactcacctcgatttccacaaacaagacccacatcgctatgcagatgaggcgaactttcgccgccaaaaactatttcttactttgtctgagtggaggttgcgatatgcccgtccacggtccgcctgcacaaacacttcttcactagtggagccttaaaccgtcctcctgatgtatgaattatcacaggcggaactaaaacacgaacgggttaagttgtcctcctgtaaaaatttttttatatatagtcttcttccttctcgaaccctgttcagtttaattagccgagatttttctctcccaaaacaaacaaattatagggtggggttttaaactcgaaacttttagtggattttcctaaggcggtcagatccatacattctcacacttgttatgaagtttttttttgctttttttttgtcttatctgtgatggatatcttttagagctctatgtgtgtgtgcatatttgtttttggcttttatgcttttttatattttaattttgtggcaggtgctcgcactcataattctatgcatgggaatcatgtgcctaacctgctttgaacctacacacatacacagagatatgtactgctagtagctcactatctcgttgaatttctgaatatattagtcaacacataatataaaataagcatgtgattagatttatttttgtaagggcaacatgccgttaaaaaagtgttgctaaaacaatcatatatatgtatgcttagataatcatgtattatcacagaagaatatgagctgggcaacctctgtaacatgttacagtatggtgtttgtgaattttcggccaaattctgaaagttttcgtctcaaggatattttcatcattagaacaaaattgtatgttactaatagaggctaactgaacagcgatggtaaatcgtagaagttaaacaaaaggcaatgacatattatggaactgaaaacagtcagtggcagattatggatctaggccatagacaatggtacacgatagattttctctaattagatcatgccattacaaatatacagtattaaaaaaataccactactaatcataaatcggctgccattagcattttctaaaatttgaaccatgcaaccatgtacacatcaggcacccgtgtactcgttttttacatacggcattttcgtatgaaccattttgcccttctctcccaagttccagccttccccctctcccccaccgccggcaagtacatcctcgaatcagatcggtcacccctgccttccgccgttgcagtggggactgggacaagacatggatccaattacatttagagaaaaataaacattaaaaccttcactaggtatatctaactggccttgatagacaggagttagagatgccaaaaggtaatcttcaattttttatatagaatacagttaacaatatttattctaaaaccagagattattacctctgttttaaaatgtttggagttgtttgcatttaaagccccccttgattcaaaagaaattcgtaagaattttacaggatttcatttctatagaaatttttacactttgaatcaaagaaatgaatcctatggaaatcctatgaaatacatatggaatgcctaatacaatgcaagtttggaggagttataacatgaggttctacctcatgaaaacttttctttgagtctttatctcttctctaattcctgtgtttttcctacggtctaatcaaacggccattcctgtattttgtaattatctgttttacatttatattcatatcaaaatcctgtgtttttcctattcttatattttctcaatcctgcaattcaaatgaccctaaatattacgatggatcattagtgttctttgaaaaacaacgtaaatatcgtttctcagcttgttgtgacttgtatcagtacgatttatatttttctatctgcactgattttttttaataagatacagtatatagttaatagggcgtttgtatttaatacagagtgtgtactatagtgaaagaaataaatacgataatacatgcatcctagtcacacgggttaaaataaaggacccaaaaaacgtgtaacacctgcaacatgtgtttgtttcttttcaatatatttgttttgtatctatggtgtgcattactgttgacgattggtcattgcaaatcttattacagcttactttaaatgacaacgtagttggtaggacagtatctcttaaatctttgacaaaatattcctaacgggggacactatcgcgaactgttagagattatacatacgcatgactggtttaggagtgtggttgtctgggaggcgaggcttcgttcgtttcacggtgagtttagaatatttacggtgcacgtgaaacgagcgtagctcaactaggtagttttaatttcttgtgatggaaccagctcaactagattcaaatcataaatttaacatggcgctcggtaggcgacatgcccgtagttactttgccaatcaggagatatgttagcccaatcttccggagatgttaattgggtagagtgtttgtgtgttcatagatttgaatacacacgtgttgtgagcgtctgcgtttatactgtgtttctaaaagaactaattagtatataattaattaaatattactaattacaaacttaatttttttaaaaaaaatcaaaaattattgtagactatgatcattttctacacctccatcaacatgactgaggtgcccgccattctcgttttcaatatccactgtaacataaaaccatttaccaaccgaatactttaataagactaataattaattgttatatatattcaaaagttaataatgttatgtgtttgaaaacacagggtgtattatagagaaaaaatggccaaatacgatgctgcatcatcatagcaaactcgcacgagcaaaaaatgaaaaccccgaacgaacgtgttgcacctggcaggcgtgttggtttcttttcaatattttttttatctacggagtgctttatcattgatggttggtcattacgaatcacagattactttaatcactagttgatactccctccatttaatcactagtttttttaattttattttagtcaaactttttaaaagtttgaacaaacttatagaagaatatggtaacacttataacaccaaattcacactactgcaaaatatcaaataagtgtcggcactataggtgccagaagtgctaaaaccagcacctataggctttttcccacctccgcgggttgaaatcgtaaaaaaccgacaccttgaagtaattataggtgtcggttataaataaaaaccaggtacattgtgtcggttttttaaaaaaaaacctaaacctttaataaaaaatggcacctataattaccgtatttttttaaaaaaatggcacttatgaattgagccaagccggagggccccaccacgacgcatcgaggagataaggtccgctcgctcgttcgaactctcttgtctcctctcgatctctcttgttctctcccctctctatctcgctcgtggcggctgaagaagcagcgtcgacggcgtcagtggcgcgcgccggaaaaaccgcgcccgcccgaaggcgttctccctccgccagatcaggcgggagaaagggcggcgacggcggcaacggcccggcaggtatgggaggaacgtcgggcgccctctcctccgccagatccggcaggaggggaggcacggtggtggcggacggcgtggaggcgggagggaggcaacaacgacgtattgcagcaggaggggaggcaacagcgacgtattgcagcaggaggggaggcggcaggcggtgacgcccatggagcggcggtgggcggcgcctcccctcagccatatccaatgactgccctccatggttacccaacggtgagtcttcaatttctttccgtgatttgggtggagatgaattgatgttgaatttatgtgatgcttctgtgatttgtgtggggatgaatcaatgttgaattatttctgtgatttgtgtgcggatgaatcgatgtgatggttctgtgatttgtgtggggatgaatcgatgttgaatttctatgatggtaagatgttgatattgatgaattgttgtatgtgggatggggagctggctcgtgcatcgagccggtttttttgcttttgtgcctctcaaaggtgccagttgtgacctagggtcatcagtgccgcctctgagatgctggttgggaaaaccggcacccaagggtttttcaatcagcacatttatacctttatgtagtagtgttgttttattaaaactgaatatattttgatagttttgttttatgttaaaactattactattattacgaggtcctcaantggcatcgggcg

SEQ ID NO: 14075 - DNA, 1929 bp, Oryza sativa
  unsure (1)..(1929): unsure at all n locations
tttttgggtcaagggccgtaaccttaatgggacctcaaggacgcccccttttaaatcttccggaaaacccggcactgggcaaagagagagggaaaaaccaaaagcccgggcaaaggccgtgccaaattaagggtccccttgcgtgaaccacccacacccgcggtgtttaatgcgccgttaaggggggtgcccttgccctataaggccctgaattattatttccccagccaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacaaagatgaaaatatatcctacttacacaaagtaattaaataacataagaaaggaacatggatgcttacttaatagaagaagtttctccgaacccatagcagagtataccgacagctccggtactcctcccgaattccttctaggaagctacactcgtcgaggtagaagtcggatgagcaccaaactttcgggcactcctccagagcttccnnnnnnnnnnnnnnnnnnnnnnnnnnnnnnnnnnnnnnnnnnnnnnnnnnnnnnnnnnnnnnnnnnnnnnnnnnnnnnggtttgtggagagatagacgacggtgacattgtcacagtagaacacggtgacccggcatattttggccacagtatttgccatgacactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtttacccttactggattatagaataacagggctctgttctttcgatggtgctagcggctttatcttattcaaagggggcaattccggtgatcccataaatcatggctctattgggaaagataccttgtatcctaatgggcaacaagaggtatttaccgcaatgggcgccggttggtggctattcttacattggcgtccgccaccctgcacgagcgttcctcataacactcctcgcctcaatattcaaaaggggggttgaaaacccgtggcgcgggtcctcttgtatataatatctcccgcgcgtgtggttcccaccctcggattaaggaataacctctcctacggggtggacgctctcttattcttgntgttgagacaacacgcgttctacgcgctatattatcaatcacggagtgtattatcttgtggtgcgccatatgcgacatttctttctgattatccgcca

SEQ ID NO: 14076 - DNA, 1838 bp, Oryza sativa
  unsure (1)..(1838): unsure at all n locations
cgcgaggattgggcacgattcccaaggggagggccttatgggcgtctcccaagggagggtgccctgttggcgggtacccccccgaccccggcggggttttatcccgcctgacacgggggggttccctttcgccctttgaggcctgttattttttttcccccgaacccccagtttatatgggtttttttgtattcctttttcccgggggcttggtatcgggccttctttttccgccaatatgcgaagcccggcaccccggccccatttcggtgggtcttctgcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccctgtaggttgcatgtaccgagtggacgagctggtaggagacttgaggctacgaccgcatccccaagtactgttataccatcaggagttgggatatctaggtcgtacgacttaaaccctttattcaccccttgcgattgcactttcgcatatccagaatcaataaatctgtcatggtacgttctaccagggatagcaatttcgggtcgtctactccaagcccgggtcacaatgagaccggggtggagtcgaacagctccccccttcgctgaaaagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctttccgctttcctcgattaacttaactcctttccctccgtccgtaagggttggcggccatcctgattaacctccctctacagaggcgctaataacggggatataaaacaaacagtggaaataccgcggggaggaacaaatcccccccaagtggcccccaaacgggccggcaatttttcaaaaagatcttctttgttgggtctcccccccgaaaggcacaccctctttttgccgggtgtaaaaaaatccttgtttataaataataaggggcgaaacccctctcggcgctttaaataaacacacccttttatccgccggaatatctcccttgcgcctaaacataaaaaacactctctttctctggttaaaagcccgcctctttttc

SEQ ID NO: 14077 - DNA, 3366 bp, Oryza sativa
  unsure (1)..(3366): unsure at all n locations
ccccactatcccctgtatactaacttttctatcggtctctgcgttcgctcctcctcttcctgngnttttgttttcntttgcggntcttttntanttacctatnnnatacnnnnnnnnnnnnnnnaatagntttgacctttgaatgacagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgataatgacggccgcatagatgaactagcgctacgtccacaccacgaaagaagaaaaaaaacgaaaaaaagggcgagcagcaacagatggccaatccgccgctaccgaccgccagcctcttggctgcacgcggagccgatcgcccgcactgatcacctgtcccggccgcttgcggcaccgccgcatgctgtacggcaccgcaagctgcctcaccagctcatcgcttaccaccgccactgctgtagcaacagcacagcgcgagcgagaaaccctaacgaaagaataggaggggagaggggaatggaggttgaaatatctgaccggtcttaaccgaacacaaattttttcataggccgggatcctttccacaccgggttggtccacgggggttgggtcatgaccccggccgttccgggtctaatcgaacatagccttatggaattagaaggcttataggtgttggcaaaactaaactaaggtcagggctatggcctaagcttatggcaaggtaaaaaaaaattcaaaacaatttattattttttgttttatcatgtgttcatttatatatcttcttccatttattccctttattgaaatatttgttgtggttttgaattcatatggtcttttatgttttttatcctattatgatgaatcttgatatagattggtgttcacaaacattttgggaaaaaaattgttactgataaggttttattagtgtttcacttatatgggtgtagtacaacttatagcaattatccgaagtgtcaatgaacctctattttaaaagataggttcaatgtgggctttcattttgctataaaccttgttttagattgtgtgggtgtgttatttataaatgcattcctgattttacccgttgtcatggagtttgatcattcgttctgattgttgtcatggatactgattacgatcaaatattgaatattgccttgtttattttatttcttgtacaatgtgaggcatgtgttgatattaatcacttacaatttattagtatatgcacttttagcttccttagggccaaaggtcaaacagaacattcacttataatttattttggcacaacatttatatccttaacacatttcaaattttaagtttcatgtcttagggttaaaagatatgaatcatcacattttagagttacgagcactagttaaaacatagataaacacaatttttagtgtggttaataattacctaatttggtatattttgcatactgtgcataaaataaacttttgaccaattttattcctgtttcaacagatagatcagcttgaattcacaaaattttagaaacaagtttcactcaatttggagttgatttgaattagttataaattttcttaggttaattcacttttttcttcattgaaataattataagtgtattacgcctattttttattcattttcccgaattagttttctaaaggaaaagtccccttacactgacaggtgggtcccagtcattttattaaagaaaatattatttttagtagaaaatgttgaaccatggtgacggtgaaactttaccatcaaatggcaatgggtccatgtgccaggaacgagagtttctttaccaaggatctggtcctagatgtcaatgtcccaaattttcattaggacatgagcatttgcatgagatattgatcaaaacatttcctggtgagctccttatatcatacgctcttttcttgggaaacttttattgcatagcgtaccggatgagactcctctaactttatgcagttggggctcacatgtcagtggcataactatatatttacatatatttacattgtaggaagtcagcgatccgtttccaacagcacctaagctgagagccatccgatgagcttttctattcgtgttgtacttcatgcattttgtttggcgcacggatccgatgaggcgacgaggcaacggcacatcgacgcgatggtgcgcaagcacaagtgcgactggttcggcctacctcgaagcagcaacgtgctggcgcaggtctgcatcatatgctacgtgaacgcgatgcaaggaaggagcaagtaagagagagcggtggtcctgcgcggcttgggttagggcacgacgggcggtacccctcaagcactgcagcagggtgcgaccggccggcccgggtcatcgacagaaagctcaacagagcagggtgtggtggcggagcttgccgagttgccggcacggtgagcacggctgccattgctgttaggaaacgatggagaaataaacgataaaaaacaatagatcaatcacagaagacacgagattttaacgtggaaaaccctcctaaaacaggagagaaaaaaccacgggcgctagccagcaaaatatcttcactatatctagggtgaggttacatcgccgtacggcggcttacaagaggtatatatatatggtggaacctaaaagggatgacgatccgtcttcagcctccactacgctccggcccaagccttccggagacgggcctccgctccattacagaaagtgcaaatgaatttgaatcacaagtcaacaattgcgaggcggcctattgactggaagccatgcgggcctaccggagctgtcttggttcgcttggtggcctgccggctctagtgggctgtttggcctattggctggggcattcttgtcaagccccactgctccggtaggcagccctggtaggaccaagggagggaaagaatggatgggtttgttgacataaaaagaaataagttcacttgtgcttcctcatcttaacatcgagatttttttcttttaccaataaaaaccaaaaatatatacacttaaactcaaccaaatagtcttatgattggtgtcaatgctactagagaaggtcttggagattagatactcgcatatcaccgtcaattcaatgacg

SEQ ID NO: 14078 - DNA, 3935 bp, Oryza sativa
  unsure (1)..(3935): unsure at all n locations
ccgcgcaattgaanctcttctnaatncactacaatataaaattaatttacatatattatagaagtaacttaaaacaaaatgaaggtaacatgtcacaacattagaaataaatccgttgtgggggtaactatgatatattgattaaatctaatttctggatagatttatgtttttacccccacaatagatttcttttaataccattggatgggtttgttgacataaaaaggaataagttcacctgtgcttcctcatcttaacatcgagatttttttctcttaacaataaaaaccagaaatatatacacctaaactcaaacaaatagtcctatgatagtatggggcccacatatcttatttctaccagcaaaaccacccatatatactgcttaggatcttgattgcacgatttgtttgagtttagggatactcatttctggttttatggttaggggacctcaaaaatctcgctgttaagttgagggaccttcggtgaacttattcctcatagaaaaagctatgaggttggacctttaaaattgatttctcgatttagggaaatattttacctcgatagtgatgagcacgggttccgatcttgtaaagataactgttgatttagcaaaaacatgatacacattacctcacttcagatcaatattatctgaaccctgcaatcgtagaaccatgtcccctttggttatcatttatctcgccgagaagactaatttctacatgtgaatcgaataatacaagaaaaacatggtagattaaaaaaatattgtttagtttcgagtttacaattcattaataattttttcttcattgggaaaatttaacatctcggtgtaagatgaatattatatgttcaaaacttgtcgtcaaaaattaaaaacatagagtgaatctttgtccggtggagggatgccaccaccgccttgacatcggccnnnnnnnnnnnnnnnnnnnnnnnnaaccacctaggccacttctccatgactgacgccctcgaggcctcaccgacaatgaccgactatgtggctatgcggccgcactccttgctccctatgcggctatgcctcatccttgtgacgcaagagcgattatgttgtgttgttaccgtgctctctcatgtggtatgtagagcaccatccttttcaaaacgatatctcactcatagaacataaaggtcgtaggacaaaaactgatttatatggttggtctattttaaagataaaatattgttgggctgggcataattcttttattttattatataaaactaaagttacatgtggtgtttgaatctcctgaagatgaagatgaagttttttacgcaaaacgaggtggtaataacgtgtgattaattgagttttaattattataaacttggaaaatgtattaatctgatattttagaacaactttcatataaaaaggtttcgcatgaaacacaccgtttagcggtttgaaatacgtgccatgaaaatctttatctccatccaacttttgttggactaacgaacagggatatttacattgcacaggacgcaaggttcaaggaaagatgtaactaattgtccacagtgttttgtaaattgttcttcattggttcattccatcagtatgtaagagaacggccttctttttaaatctctggaaccatttttttgtggcacatcccctggaaaattaaatctttcatatgcttccaaatatgccatctaactagcaaaaagacctgcataaaacctgttcggttgaattgcattcttgcgagtaacactaccagaaagaagtttaattagatatggtattttctaagtattattctgaaaataatatgggattgcccgacctttatgtagaatcactccacagacctaaccacgcaatctgtgaaaatgtgactatggaaatgtattcctctgacattggcttaaacgttgtagacgtgtatgtagttcacttcatctctgccgttgaagcaatccgggggcattccaatcctgcatcttgccttctgtatcatgcggctcagtagcgcaccacgccgccagcaatggaaggacaaaatctaattcgtgcgctctctctgtattgccctatcgcgtgacatgttcaccggccgtccgcccgatcccacaagcactggtgcgtccgtctaaaccacacatggcctggcgattcacgtatgtggcattatcgagaagaatctgaatctgaagccatatgatgctctaggctacacctgcgagagggacacatccacctatacacctctacttcaaaaaattttttttcttaaactaatcatctgatctacgatctgattacaccgttgtgttcgtaagaattgaatctttataaaaagatctcacatgattatattttgataaaaaaatataaattacttttataatatatctaaattacttttagatttcactaaattacttcttagtcataaaagtaatttacccatattatagaagtaacttaaaacaaaaagtaaaagtaaagtaacttgttatggtattaaaagaaatctattgtgggggtaaaaacataaatctatccagaaattagatttaatcaatatatcatagttacccccacaacggatttatttctaatgttgtgacatgttaccttcattttgttttaagttacttctataatatatgtaaattaattttatattttattgaatttatttttatatgtctaagattcaacttaatgaaatctaaaactaatttatatttttttattaaaataaacatgtgagatcacgttataaagatttaattgttatgaacacaatggtataatcggatcaaagatcggataagtaagttaagagaacattttatttgaagcataggttttcttatacatttataatgttgtgagttgtttattttataatcatttttagttaatgacgtaatttatgctgatttaatttaatttctatatagactcatgtttttacctcataacggatttacttttaatgtcatgacaagttactttctttttgttttaagtttattctataatatatgtaaattacttttaggctttattgaatttacttttatggatccaagaagtaatttagtgaaatctaaaagtaatttagatatattataaaagtaatttatatttttttatcaaaatataatcatgtgagatctttttataaagattcaattcttacgaacacaacggtgtaatcagatcgtagatcagatgattagtttaagaaaaaaaattttttgaagtagaggtgtataggtggatgtgtccctctcgcaggtgtagcctagagcatcatatggcttcagattcagattcttctcgataatgccacatacgtgaatcgccaggccatgtgtggtttagacggacgcaccagtgcttgtgggatcgggcggacggccggtgaacatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccggccaacggtaggaatccccttgccaagcaatttgttgtaaataaagttcccggaaccttaccgggggcaatatgggattaaactggccttgatgacacctttttgccggtggcggtttcttttttgagaaagagttgttcaccccggaaaatgcattaaacgctttacttt

SEQ ID NO: 14079 - DNA, 1144 bp, Oryza sativa
  unsure (1)..(1144): unsure at all n locations
acgtcattgannnctggctgtctcttcctaattttgtgcaccacttcctgattcatgctcatgatcttcatgttctagattttgtgcaccacttcttgatccttgatctccatgcttcacccaacatgtgtagcccttcatgaaatctctttgtatcagattagcgtgtacgtccactctgctgtaaaacatattctcatttttgcaatctgcacatggacaacacatgcaatcgttgtttcttcttttcctatcctcctccgcggcgttaataaaattcaatatgccatttctatacaccttggtatgacgtcgcatagttttcccatacatctaactttgatccatccccgagcttcataaaagtagaaaaatattagatatacattttgtaggtaagtatttactaaatttttgagaattgactactatttttcaattaaatttgcaatttatgattttcttggagaaaagagacaaaaatcaccgcctcatactcccaccaaaatagtgaacagtgggataaccattacactaggtagttggggtatttatactgtgcaataaatatctgtaacggccaaaaaaaatacgacggtaacaggtattttagttatctttgtcgggcctaagtaaaagctcatcaccgataacattcatcgtgatgggcctaatataatagttatttcaaccaagcctcaagttggagcccgtcaccaatgatggacatcagtgacgtgcttcttgtagggccccgacaagaaatcatcaagtatcttttgtcgccctcaagttggagcccgtcacaaaatggtgtcattcgtgaccggctcgatttttatgcacaatctaacatgtcttgtgcaagtattatctttgtccgcccttggtttgggccttgtttgagatgacttcaattgtgacggccccggaaaaacttagacttgtgaggagccgtcaccagaataagaatgatctgtccttgtgtattaaaagggaccgaatccaattgaattgntggattttttccaatcccgcagtgaataaaccctattatggaatcttaggtcaaaacaaaatcaagggctcattccataccggttnggttcaaaaaacccatgggaacgtgtaatttattttcttn

SEQ ID NO: 14080 - DNA, 2079 bp, Oryza sativa
  unsure (1)..(2079): unsure at all n locations
ggaatacctcttttatctcaaagtaattgtccccacttagggtttaaaacgtgtttacacacttttgacacaaaaaaatcccatatttattaagaatttagttctcccaaggtccaaaggggcaaaaatccctctttataagagggatggaggcccttattgtgacacaatatccctataccagaattttttttgggtagaaaggtctccgtaaaaaccattatatggggagcctaaagatgaaccgccccctttttaaaaccttgcacgggaaaaacccggccaaattgtgcgaataatggaagggcgaataaagccaaaagaacggggcctttaagaccctggcaaaatttaaccgtttcccccttggggggtaacaccagaaaaccgggggggattatattggcccgttacaagggaggggtccctttgcccatttaagccctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgtgcctcttatcaagctcaccgccgccgcctctttagcccgcggcactttaaatgacaacgtagttggtagaacagtatctcttaaatctttgacaaaatattcctaacgggggacactatcgccaactggtattgagtattctatagcggcacctaaatcatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttttaattctcccttcccgcggggagtagtctttccctcaaaacgcggataacgctcgacagaacatggagtgaatggcccggctatggcccggacccgaaaaaggccggcgcgtggcgttttctataggttcccccccctgcagggattacccacggaagacatgtgtgctatgggccgcacaaggccccgaccggtaaaagcctggccgctcgcgttcctcaattccccgtcacaccgggcgttttgatcctttcaataatcccctcatcacttcccttcttcccggccggtcacgcgtccctttatcccatgggctctatgttccccctcttttcgcgcggggttccgcccctgcgtcggttctgggctacatccccccggtttaaccccggcgcggtccctattggggtaatatacgctctgggacccacccggacgaacaccattttccctctctgccgccctccttttatccggtgtttccttaccgggttcttggccggcgcttctcttacaaatcccggttatacacgggggctccaccaaaatatccccttttgctcttcgcggctgatcacaatcgctcgacataaaacatcgtgcgctctaatcatcaccg

SEQ ID NO: 14081 - DNA, 1506 bp, Oryza sativa
  unsure (1)..(1506): unsure at all n locations
acgggccatggcaatatggggtcttcatggcgagtttctcccgaaagcacaacggtaagttccgggaaccttatattacacaaacgtcctgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagatgtctacactaagcatacagtagatgatctcgatgacaagcaaggtcaaggtttcatgtcagccgatgatttggaagaaatagacataggtccaggcgatcggccaaggccgacatttattagtaaaaacttatctctggagtttagaaccaagctgatnnnnnnnnnnnnnnnnnnnnnnnnnnnnnnnnnnnnnnnnnnnnnnnnnnnatatataattcttatgtcgatatatacttaaatcaagtgattgggatagatcgatcgccatgccgagacagtataaatcacttagatcaaaatatatattaataacaggactatatatgtttatagcatagccccatcagatagatctagcatgtatcggctaattccaagccctcttggaatgaaagtgcaccggcatcaccttatttgaactgattgatgaagcgatgagttctccttcaaagatatgatccgatatgagtgcccgatgatgataccagtcttgctcggggacgccaggctccactatggcgatgcagacatcctcatgacgacgaggcggacattgagggacggtaagatcaacacacagcacgcgcaagttaccaccgtgatgaaccacttgcccttgacgaaaaaaatgtngcggnnnnnnnnnnnnnnnnnnnnnnnnnnnnnnnnnnnnnnnnnnnnnnnnnnnnnnnnnnnnnnnnnnnnnnnnttgagtatttttagngccacataaatagggtggcggaaaaatggacatagttgttttctgtgagaaattgtaatcccttacantttcccacaacattacgagccgggaataattaagagtaaaccctggggcgcctcatgagtgagctacactccaattaatgtggtgccgctcaccggcccttttcaggnaggaaaaactgcctgcccgctttaataattaattcgacacccgcccggggaaagggnggtggttattggcccttttccctttttttattaatgaattaataanntcggggtnggggggggggggcggttttccttctttaaaggggtattcgtgttcccaaaaagcgggggaaagcga

SEQ ID NO: 14082 - DNA, 1581 bp, Oryza sativa
  unsure (1)..(1581): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtttggttcgtggctttaggctgcctaccccatgtataaatagagatgtgaatcgaataattcaagaaaaacatggtagattaaaaaaatattgtttagtttcgagtttacaattcattaataattttttcttcattgggaaaatttaacatctcggtgtaagatgaatattatatgttcaaaacttgtcgtcaaaaattaaaaacatagagtgaatctttgtccggtggagggatgccaccaccgccttgacatcggccnnnnnnnnnnnnnnnnnnnnnnnnaaccacctaggccacttctccatgactgacgccctcgaggcctcaccgacaatgaccgactatgtggctatgcggccgcactccttgctccctatgcggctatgcctcatccttgtgacgcaagagcgattatgttgtgttgttaccgtgctctctcatgtggtatgtagagcaccatccttttcaaaacgatatctcactcatagaacataaaggtcgtaggacaaaaactgatttatatggttggtctattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgggttacccacggaaagactttgacacaaagccgcaaaggcccggaccctaaaaaggcccttttttgcttttctaag

SEQ ID NO: 14083 - DNA, 1088 bp, Oryza sativa
  unsure (1)..(1088): unsure at all n locations
gtgttggagtcaccgtggatggacgctcgggttacggagaatcgcacgatcgntatttcatgtgaccggtcagactgggctctggtagccggtcagaccggcgtgttatacgcggtcagaccggcgcagcccgcggtctgaccggccgacactgtgtcggtttcggtttcgggttgtttagttggatatccgagtttatttcatgattatgacttctagatggatactatacgtatgtaacactattgtttgctgctaatgagtcaagttagagatagcttggtcaaagaatatggtttctttgtttgttccatgagtaggtgtctcgatgtctccggagagtatttgcggtgatggaccgggagtcggcttggggataagacaacgtccgtggtggtcagagatcatgcgggatactagggctagagttgatgcacgtggttgatggagattccatatggcatacgatggagttattgtgtgcgtgtgggatgcggagttgaatttggaaggagtccaaatttggtacgattggttatgtaaaggttctttcttgtactagagggttttctaaggtgtttaggactcctagtatgagtttggttcgtgggtttaggctgcctaccccatgtttaaattgaaggggagcggtgggctttcctgtattgctttaaagagcaattgagttgagttttgagtaagggttcgaggttatcgcaaaatttttggatgagtgcctgtggtgcactttgtcaaaccgtgggatcacttaaggtggcatctactttaaaggtctttcacttgggttaccgggtttcgggggtttaacgggacctaccggggggcaaaacgacggcaatcggacgtacaccggtgggaacagggcggtaaaaccgctgggtgcgatgctcaccacaagccaatccgggggtataccggtaataaaacctgtgcaaaactgcgctctctttgtgtaaaccggttatttactttgtgtcgaccattcttatcgaaatgggcggaattttattttcctttaaacgtttggtgttggtgtttacaaacatttacccttccctttctggtgg

SEQ ID NO: 14084 - DNA, 1523 bp, Oryza sativa
  unsure (1)..(1523): unsure at all n locations
cgggatgactccgctttcgatggaccactaggacgatctatgcaggcgctgaaccctcttcttcactgccgtcttcaggtgccggcttctcaaccaaaaaaccgaaaatacgcacggttcccatgccggcaataggcgccagcagcggctcctctggtgctgctccaacatcggccgcctctggccctgcctcaaccggtcgcaatgccgctgcctcggccggtgcagcggcttctgcagccgcctcttcctctgcctgatcatcctgtggcggcaatgccgctgcctcgttggccagcgcaagcagcgccggtgctgcaacttctgcacccaccaccattgacagtagtggtggctgatcaagtggttccgacgaagttacctcagcggcggccggagtaaggtccggcaaaggtggtggtccaagagagatgtgcttgctcagcgacattcggctccttctcgttcacggtcaccgtctccttagtttggtgcttcctcatgtggccgccgagcgcgaaacctgtcttccactccatgccgcattctctgcaccgatgcttgctgctgtcggcgccgccgtggcacccgtcggcccccgctccgctgctgccctgctcggaggccgccgccgccgctgccttgctcctgttctgggggccggcagcgtggccacctagcccctggtgcgtggggaacgccctgccgcagccctgcatcttgcacatgtatggtagacttttttgcggcgccccttcgacgacgacgacgacgccggcgttcggcgcggcagccgctggttggtgaccgacggcctgattatgattgggaggattggccggcgctggtggcgacggcggcgcgctgctgctcccgtgtggaccggaaagatcaagatcggttctgggctcagcgaccacagtgacacgagagntgtctgccgcattatacttgggggttgcaatggattgttgaccgtggacctcttatgtgccccgtcacgggcttccgggtgtcgaacttcttttcggcagatgcggnacgcgaacaccttccgcgccattgtcgacgccgcaacttcttgcgcggcngcaaccgaggccaatgcgacaattgcgctttccgtgcttggtgtcanaacccgccccgcagaggttggcggcccccgtacaacattgttcaaggccgcaccgtttgtgcttcccgcaaccatctccattgttcggggagggagcccggnccgttttggggcctgccgtcctcgcttcggaccccgaacgggaattgtacaaactttcctcttgattggcaatgncgccaatttggccgcgggagggtgaacacctccatgggccctggttggatatccacctctatagcgccaaatatttggggcttcttttgtgggcttagggggctcaatccaaaaggatacaaaaaacggcctcgccgaaaagctttgggnagaaaaaatctctcnctcgcggctgcgggtgttggtgtccacatataaacgtcggcgg

SEQ ID NO: 14085 - DNA, 1181 bp, Oryza sativa
  unsure (1)..(1181): unsure at all n locations
actggtgacactctcactgcgcgattgcaagncaggaccgtcgnggtgttctcggacaccacgagctcgggcggggtgccgtcggccaccgtcactaagcggtactccgggggatgcgccgccgggtccggcgctctgagctcggtgtggaggacggtgatggagaagccacgggagcggagcacggcggcgaggtggaacatggggatggtgtggcccgggtacggcatcgggaagaggaccacgcggccgcacggtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaagttccttgggcgtttcttggtcaaccttcgtttacggaacattggccggtttcttctttggaagggtggagtttttaatataacctggagttttaaaccgggaggggttggctaaggtggttggtgcacaacacccgtacgccgactngcgctatnggtattatttttagggacagcggaaagaattttttccgtggtgtcccctgtaaaagaattaaaggcgagtgtcgcgcggctctcctttttggagggtgggctaacagctgacctctaaaacacaatatttttcttctctcgccc

SEQ ID NO: 14086 - DNA, 3453 bp, Oryza sativa
  unsure (1)..(3453): unsure at all n locations
ccgnnttttttttgtgggggccctcatattttttcctattataaaaaaatcccacaatttggtggggccaacaacaacagtgtgttttttttcccccccgtctttgaaaaaaacgcggggcacaatttataacccccccccacggccaatttataagttggggaggttaagggtccccctccctttgggcgcccccccaggggttttacacatttttatagccttcccgggcttggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgctagtcaagcgaaggggaaaggggcggccatcgagacatctgtttcggagtattctcttgcggcgccccgtttcgcccctggcgattttgagacccgagcagaccttattccctttgtggagggagtaagtaatcttgtcttacctgccagcaccccgagcttgttcaccgaactgaatgagttcgatgaggtgtgttctgctattaaaagcttggcagttcgagtatgctttttctctattcttggttttcctctgcttttttacatgtcccataattaacatttgctctcttcgccgttcctttcttttttttgcatccagattcttgcagctcactgttcgacagagcgaaccgtgcgggctcgtcttgatggatttaagaaccgtcttcgggtcaaggatgacgaaataggccgtaagaacttggagatggaggccctcgccaacaccctgaaagaggcgaaagccgaaaacaagcggctccaatccgagttggagaaaggaagtgaggctacggccgaggtcgatcgcctcaaggccgaactggagaaagggagagaagccatagctgaggttgatcgcctccagaccgaattaaagaaagaaaaggcccattccgccgtgctgacggattattataaccttactgagccgaagatggaggctcttcgcctggaggtcagcaaggccgaagcgagcgctatggaggagtcgcggcggttttcgcgggagatggcgaaaactaccgaatccgcaagaacggcgtgccaaacgctttgccttgcccttactgacatgggtgcaaaagtgccgaggggtccctgccgaagatgcctcggccttcaacttcttcgagtggacccaacaggttagtggttcggtttcggactgcgccactacgtacggcgattgctgtgcgcgtgtatcagcggcctttactatgggtctcctgcaacagttcagctacgagcacgtcgccgagttccctaactatgcgaagggggattgggagattggcgcacaggacatttcgcccgcacttcgtgcatggcggaagcagttctggcagaaggacggtcgttctaccgccaaggcgcgccttttggagcaactagcgaaggcagaggcggcagacctttgcgaagaagaggacgcggtggctgaagggggtggaggcgatgcccaggatcacctagaggtgtgatgccctccgccctttccttagatttttgtagtttttctttttcgttttgtgttcgccagatgtggcgaacgaagtgtatttggcgggctgccgccaatcctccttattgtagctgaaaaaggggcccttggtcattttaaatatatatgactcactcttagccactttttgatggtcaaaatctttggcgtatttatgattacgcccatttctcattatgcattacttttttctttctttgcctattcttactatgcaattcgtcttttgccctttttgcactgtctaccagggtgttcgccaaaagttgtgcattcggcccccttctgggagttggcgaaaccaaaacgagaaatttgtggcattaaaggatttgccaaaggtgcgatgcccatttcggcctgtttatcgtgaaatggtgataaacggacgcagctataaggtttttaaggttgccgggtggcttcgggcgcaccctgggcgaaccttggaagactacgattttgttcattcaagacgtttggaagacatggctcgcttttggcgaaaccatcagaagactgatcggcaggaggcgatctcccagcgtcgttacagtctagtctctatttcgctcccttctcctcttagggttgtgtatgatattagtagtgatgacgaacctagttcgcccgatcgctccttagagagagagagagcgctggggcgaagatgtaatttatctgtaagccaggctgtaacgccattgctcctttctcttcatttgcaccattgtgatgatacatttttatttaaaatcaataaaggtgcgttttatttccttttcgctatttttgcattgtcacttcacgtgcttttcgttgggtccgaacatgtcggccccttttcatatcttagcgaaataggttttgactattcagctttcggcttccgttttcgatccgttttgttctatgttgcaggaagcactcgtgctttcctttcgatcgagtgtgacggtgttcggctaattgttttccgaaacaagctgttgcggtttcaatcgttcggcgagcgatgcttcggctgattcgtttcgccccgtggcctttttcgctgatcaggcgtttgtcttggggtttttccgcaaattgtcaatcgcacaaacaaataaaaatgaggcagaggacacaaagattttatactggttcgggcctccgttgtggataatagccctacatccagttttttttgtcttttttcattttcctcttttttttttctttttttttcatgccgaaaggcttacatagtgccgaagggcttacataacgatatatacatttttacaagttggcgatttgggtgccacccgttctaaacatagaaacgcttgagagaggcagcgttccaggaatggtcgaactcttcgccttccagtgtcgccagtcgaaaggatcccgtcctggatttgtgcttgatgaggtacggtccttcccatttcgattcaagtttgccaacggctatcgggttcgcctttttccttaggacaagatgaccaggcaatagctccgttggtcgaacttttttgttgtaagttgccgaagtgcctgtggcatacttttgcatgtgttcgagtgcttcgactcttaccccttccaagagttcgagcgacacctcgcgcccccccttcgtccccggagaacgtcacccttggtgagttagcccctagctctgttgaggtcattgcttcgtcaccataaagtagcatgaacgggctgaacttggttggtcttgtgggggtcgttcgcagggcccagagataacaggngatcaacagggcgcgg

SEQ ID NO: 14087 - DNA, 3539 bp, Oryza sativa
  unsure (1)..(3539): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctttagcgcttctaggattttgccgtttgtgcgttcggccgccccgtttggtatgttccagcttcattcggtcatgcatagagatgccttggtgaattcacccctgctgcttacgacgactgttgagtttgttaaacatgaccaagggccaaactggcgtacttgccattttaaccgggaaggctggttccttcttttggatttgctgctggatttcgttgatcatcaccatataaatctagcggttgcctcttttggttagctcactttctggctagatagagagtgtttgtgcgagcaaaatttagggatcttgactctgtgccccgaaagatagtgttgcaggatcctttgggtaatggcggtggaggtgaatcttggactatttcggtttttgtcctggatggagattttgttgatattccacctgaagaggatttacctactgctgggccgcagccagggcctaatgatgatgatgctaatgacccagatgatggaaatatttggcagttaggacaccctggtaatcaggggggtggtgattgggataactttgtgcagcaacagtaggctgcagaagcaaaaatagaggatgcttggggtaaggatcacccaatgggccagattgaggaaaaccctaggcaactgattgtgttgcctaatcaagtgttagaagaacataatctgatggataaggatcaacaggtgcagcttttcctggctaggctcaaaggagatagctgacagggaagggccaaagcatccatccttttatcctatggaaggtctattggaaaagattgatcatttgtgcaaagctagaaatcatgcatacaactttgaattctggcccttcagctctgccctatggaagccctttcatgaacttgatcatgcccctcctgtagttaaaagagcacattccagctgggccctattgccttcctctcctgatgatggacttactcatcaagagatttagatgccatgactttgcaagcccagtcttcaagtccagaagtcacccctgcagtgattctgattcctaaagctcatgtgaagaaaagggatgagaagactactttatacaaccctaccagaaggcacaattccaggattcttaaagccagccaagagcttaagatagatcatcgaatgggaattggcaaaccaagggggatatctgctaaaaagttgaacgagttggtaggtatatcgaaaattcttattcctggcagcaagattaatgaatctgatttctctgctctggatgatgatataaatttagattcatccccttctgattgttctttgtctttattgtaaaagttgggggtggacctatgtggcctacatcctgaggacgtggctgaatcgagtttagcgggagagaaaagaaagacgcttccccgggcagacatggatgattaagaatgaatagtgttaatttgttcagaactatgtcttttgtctttcagtgctgttggactttggacagtgtgagtggactttacaattgttctggatttatgttatgtgggcctcttcaggctaatttatttagctcttcttctttgtgcactcccatatgttttttttatcatgcgtaatgtttttaaatcttggaatgtgctgtgctggaatataagaggcatgaatgctgacacgaagttgttatctttgaggcaaaagatagaggaaagtggttgtcatgttttctatgtccaagagaccaagaaacaaaatttcactattcctgatataaagacttttgctcctaaacgttttgatgcttttgcattctcgccttcaagaggcgcttcaggtggaatcctagtggtatgggtttcaaatgtttttttgggaactccaggggaaataaacagtttttctgtcacagttaactttgtttcaaggcagtcttcagaagcttggaccctaacttgtatttatggcccatgtagtggcccagaacgttcagattttgttgcttggctaaagaatttttcttttgggtcagttgataacatgattctcctaggagactttaatttctacagattagttgaggacagaaacaagccgggagctgatatgaatgatatattcatttttaatgatataattagttctctcggtctgctagaaatccctttaaaagaaagaagatttacttggagtaatatgcagagcagtcccctcttggagcggcttgattgggtttttacaagtccatcttggactttggcttttccaaacaccactgttcatcccctggcccacaatatatcccaaagtctccaatttttagatttgagaattattgggttgaaatggaaggcttcttcgagcttgtcagcagagtttggtcaatggacactagttatgaagatccggcaagatgcatcagtttcaagctaaaatttttgagaaaaagtttgctgcaattgagtaaaaacttgtctcagttaactgctctcttggtcaattgtaatgctgtgattaatttcctagacctaatagaagagcataggcccttgaccatgtttgaatggaatttcagagaaattgtcaagtcgcaaacttttaagctccttgagtttaaaaagctttattgcgaaaaaaggtgcacgaataggtggatgctgctgggtgaagagaacactaattttttcaaagccattgcatccatcacacggcggcgtgccacaaagcgct

SEQ ID NO: 14088 - DNA, 2115 bp, Oryza sativa
ttaataagaaaggtttcttcagctttgcaaaaaagtttgtccaatggccctagttataagatcgcgcaaaaagcaacatttcaagcttaaatttttaaaaaaattttgcgcgaattaataaaaactgtttccagttaacggctctttgggacaattgtaaatgctggaattatttgcctaggcctataagaagagcaaagggcctttaccctgtttaaatgaatttcaaaagaaattgtcaaattcccaaacttttaagctccttaattttaaaagctttattgcaaaaaaaggtgccccaatagttggatgtgttgggtaaaaaaaacactaattttttcaaagcctttcgacttaaaggttcagatcaatttctatcgcacaggtgctggatcaaaatgaataggtagtcactttacacaatcagaaaagctgatatgttattccatagtttcaaaaacagaatggggatttttcttttgcctcaaatggactttaatctaatggatctttttcccaatccggtgaacctgaattgcttggtggatcagttctatactcaagaggtggacaatctaattaaggtaattcaaccagataaggcacctagccctgatgggattaatgggtattttcttaagaaatgttggcccatcatatcacaggaattttactggttagcagcacacttccatgcctgttatactgatctgcagccgataaacaaatccttcataactttagtgccaaaaaagtcctctccagaaacagttaatgattataggccaatctctctgatgggtattagtttaaaggtattaaccaaattgatggtagatagtttgtagagtgtaatgcctaagctggttcatgagaatcaatacggcttcattaagggtaaaacaatttaagactgtttagcatggtcttttgagtatatccatcaatgtcaatagtcaaagagagaaataattttgttaaaacttgactttgagaaggcttttgattctatacagcactctgccttgatatccattatgaaaagtatgggttttcatgataagtggctgcagtgggtacaaatggttttttcttcggcacattcttcagttcttctcaatggggtacctggaaattcttttaaatgcatgagaggggttaggcaaggagatccactttcaccctttctctttgttcttggtgctgaattactatagagaatagttaactaagcttgctcccttggtttgttgtccaagccaattaatgaacttgatgaaaggggtttcccagtaatctagtatgcagatgacactttaattcttctcaaaacatcatagagagaggtgttttgtttcaaggcttcgttgaactcttttgcaccttctactggcctcaaagtaaattaccatatgtcttgtctctacccaatcaatctgtctcatgagaatgctgagctttttgctagtctgcttgggtgcaccataggtacaatgccttttacttacctgcgtttgcctatggggacaactagaccaagggtagtggactttgcaccattggtagacagggttgagagaagattgacagctagctcacaatttttgccacagggagggagactcactttgatcaactctgtgctttcctcaatcccaacatattacatctgttctttgcagttgcctgtttcagtggttaaagctattgatactgcaaggaaaaactgcctctggaggggaaacaacccaaactcaacttgaagatctcttgcttcttaggattagatgtgtagaccaaaggaaaaaggtggcctaggagtcattaacttaagaattcaaaacacatcacttctgcttaaatacctggtcaaattttacgaagggcaggatctgccatgggttcaactgatctggaattcttattatgactccaaggtgccccatttagtttggaataaaggctctttttggtggaaagatatagtggctctatctgatatcttcaggggaatttcaaaatgcttcatcaggacaggatcctcagctcttttctaggatgatttttggaatgacaagattaggtgcagtacattgcaactgatttcaaaacaga

SEQ ID NO: 14089 - DNA, 2015 bp, Oryza sativa
  unsure (1)..(2015): unsure at all n locations
ggaattgtcgggcataacggaggatcggtgcctaatcccagaatgaaacgaaatacccaccccgaattaaataaggtaccgcggaagatttaaaaaaggcccattcttccccaaagaaaaaaagcgcccaaggtatcagtaaaccccaattttcggaccaggaaaaccccaaagagaactttcacagagaaaacccctgtaaccttaaaagtccgggcggtttccccaccctccaatttaaggtcaaattttttaaacccccaaagaggccggacgctaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactaatttctcaacagcagtttgaacttttgccctctgcagaacactccctacctccatctccacacccaacctccaaacagcacaaacatacctcgcatttcccatctgatctccaaaacatggcctacatatcatcggcacgccttcagatatacctctctatcgtcgagttccatccattatgcgtcatgaatgcccggacagaaggatgacctagtaccttttcttgcggtgcccaagagactatccnnnnnnnnnnnnnnnnnnnnnnnnnnnnnnnnattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccctttaacgggcctataaccggggcgggggatgtgggttaccgcccggtgaacgattacattggcaacgctctaacgcacggtccttaggattcttcccttctttcctacgacgttagcgggtttaccatgcaacgctaacaacgggtgctccctttagggctcacagttagggttttcgagaccttcgcactctaaaacctgtaagagcggaggcttacgtcgggtcccttgccctgtagaaggctttttacctatgcatggatgacgcactcttatagtgggctcgtgtcgaacatgttaacacttaacccatcgggcaatcctctgagtataggagatttcgcgttggcgctacgtaact

SEQ ID NO: 14090 - DNA, 2076 bp, Oryza sativa
  unsure (1)..(2076): unsure at all n locations
nagacanagtacctacttttagtcgaaagagggacgtagtagagcgagaacactctctcttataagatgaagatataccgacaaccggagcgtgatcgtggtggcccactcgtggtacaagagtacttccactaaagaagggtggtcgtcnccgcgaaaagagggataaacccttctctaagagggtaggagccacgactagtgaccactcgacccataaacattgttttggtgggagaggggctcgaataacactatatcggagcgcctcaagagggcgcccacatttataacttattcgggtgaagctcgggtaaactttgtatataagtagagggaaaaactccacagagactggggctatagggcctctgcacagtgtgtagcggacacgattgtgcgtaaatcgccacccccccccggccttatatggcccgttcaagggggggtcctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaccaaggacaaggaatgtgttactcggcactataataagaaagtggtgcctaaagatttttcagaaggagaacttgtatggaagttgattttgccgattggtacccgtgattgtaaattcggcaagtggtcgccgaattggaaaggaccgttccaaatttataaggttgtgtctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccgaacccgcagactattagataccagccgttccccttgaaggtctggcgcttttctgttccaacttgcggtaacgggtacttgtcccctttttcttttggaaccggggcctttcttagactcacctaagggtatcaattggggggaggcgtgctctacaaatggttgtgtccaaaacccctttaacccacccttgccttttcggaacatttgtttggccaacccgttagaccatttttccccgggcaaccccttgttacagttttccagccgggttttgccggttccaaaattttaaaggggccccaccccttctctaaaaa

SEQ ID NO: 14091 - DNA, 2641 bp, Oryza sativa
  unsure (1)..(2641): unsure at all n locations
cacggattcgactcgctgctgatgacgtgaccgattttgctcccccccccccccacaatttccggtggagtgatcgattagaaggagtaattccaaatattttttttctacctttatctactattgaaaaaaaattgagaataaatgaaaatacaataatgcaattgttagttaagaacataccgtagactttccccctgtaacgtagcttacttgtaacactttccctctttcggctaaattattggttagtcttttttgcccacaagctatgtgcagcccatttatggcccaactcataatacatacaaatgttgtatatatgcattttcatatagaaacattaaacaaagtatagaaacttcacacaatttatttttaacttttaagaaaaataaaaaaaattgtctattttgggccggatacccatgctgtgttgcagccactcgctgctggcccgttgaattcggcccaaaacatccgttctcacaaggccggaaaaaataggaataagttcagttttgtgaccctcgaaagtgatcgaaatctattctgtgaccataaatcacaaagccggatatctcgaacccctaactcttaaaactggtgtaatttgactccctcggcggttttggagggtagtttcgcagacgtggcatctacgtggcagtattgattcggtcttctttccacgtggcgttgatgtggtgcttaggtggcattaaaaataaaaaaatatgtgtaggtcccacataaatcatgctctcttctcttncttcatcctcccccctctctctccctttctctttccttcggaaggcacttgtgaggagcggaaggcggcaatgaggagctgtgccactcgtcgccagctaccgcatcagtgcctatatcgcatctgattccaccaccatcaaccaccaagatccggcgncggtccccttgtcctccactggcacgaggcgtcggcgcccaacaaggactcgaaggtcgaaggtgggcgagggactcgaaggtccactactacatgaaatatttttccgtgcgggtggaatcgattttcgcgtgcggagctttcacctgtctggaaggcggcgtctgcgaaaatcccgattttttcatgcgggtgacgcacccgcacgcgaaaatcgtgtgcggacgatggatccggcctccccacggtggcaggccgcggatccagcctccccacggtggcaggccgtggatccagccttcccgcggcggtcggcgatggatccggcctccccgcagcagtcggcaatggatccggcctcccagcggtggtaggccatggacccggcctccccacggcggccagcgatggatccgacctccacgtggcggccggagacggatccgctccgccaacaccaccgtagccgatgccgccaccccggccgccgatgccgccgcctccgccaccctaaccgagtgcaccggcgtcgccgaggaggagagggggagagggagatgggaggaggagagggagagggagagggaggatggcaggatggggaggaaatggcagcgcgcgcccatgatgggaggatggggaggaggataaggatggtagcgtgtggggtggattattttcctgcacacgaaaatatatttccttgtgcgggggacggactggtgtccatctctcattttcttgtgtccagaaaaatgtttcatgtagtagtggtcgggagcgtctcgccggcagcatcgtgcacgcaggcggccacgtcgtcgaagtagacggtctccttgctgtccatggcggcctcgatctcctctcgcgcctccgccgtcgagaaggcgcgcatgtgggggcaccccgggaaggggcggccgcccgctaaaaagaaggaagcgccggcgtcgcgtgcgctgggccggtggtggcacgaaggagtagtctccgtgaaatcccatcaacaaccacgggcatcatacgcttggaaggagttgttcgtcgctgggtgggcgaatgctgttcgtcacgcgaggctgctccagatcgtacgaggcgaacaagtatccaggctgccgccgccgaagccgaggagcggcgatgccactgctggccatgcagagacagcggcaagtggctggcggctgccggggacgtggacaagttcttgccggagcaaggcccgttgaaatactcaccgccggcttggtttctccagtaagagatttctgctgatcgatttggatgagatgtgcttacctcacatcgaggtgtccccccagtttttttttttcatgaatgataaacagataccacacatatttttaaaattataatgccacgtaagtgccacgtcaatgccacgtggaataaaaccatgtcaacatcgccacataggcgccacgtcagcgaaaccgctctccaaaaccgtcgtgggagttaaattgtaacggttttaatagttgggggtcgaaatatctggtattgtcgtttagggatatgaattagattcgacaatagttaagggagtcaaagtgaacttattcaaaaaaaatactccctccatgctcgtaaaggaagtcattttggatagcgatacggtctactactcgaagtccaatttatgcgnngntnntatcagnnagtcatcatcaggnacat

SEQ ID NO: 14092 - DNA, 2678 bp, Oryza sativa
  unsure (1)..(2678): unsure at all n locations
atggntttgntttgannnattggacggccgccgtgtgatggatatgcaaaaagaaagaaaaaaagtgctcatacaagtatggagcatgatgatgagaaaaaaaaagaaagaaaaaaaaagagatagccatgcacttttcaaaatttcaaaagagaaaataaatggaggaggtacacaaaaggagttattattttcattccttttcacccacaaattaaccatccacatacacatgcacatttttgaccagaaagtatgtctcgtatttctgtggatccattatttgactttgtaatatatgtgatgcaagtagtgctctactcttttccacaccctgagctccacataagccttattagatggtaggaaaagaaaggggcatttgcaaatttgccaccggttttttcaatattgtaaggatgccactcaaatgacagttctagtggtatttttgcaattttctagtggcagttttgcaatgatgattcaaagtagtttcagagaaggcgcaatcatatgccattgtgaggaatcatacactttgagtgatcgagagaatcaattgagcaacaaagcagagttataattttgtgttacatgaaaaaccctaagttgttcttcatgaaaagttagggtgacttgagtcaagattgttccatttctcaattgctcaggattgcatggaagacactataaagatccacaactataggtatgactttgaataatttgtttgcatgattattagtaagaaagtcataaccctgttgtagagtccatagccttcactcggacgagtgaaggttaagtgtggaggtgttgttgacggtccttaaatcataatatttgaccgtcaatacttgcatataatgaaataaaatatggtatccaacttagtggtaggttttattactaatcatttccactagtgttggtgaaatatgtgtatgcgggtattttgaggagaaaacacatctgtcatgcgacaaaatgcacctccgcatattcaggacgcgtttacactgattcgagggccccatatgtcaaccaaaaccacttagaattgagccaaatcaaagtacatgatgttggaggcccaataagctacctacccgccaaaggagaggccgggaagacatttttttggtccggccgaaccgttgttgtggctgttaatcaccagccttccacgtgtacgctcctgatttcatcccaatgacggttggagggtagtttggtcgtttcccatacttgtactatcatatggaggctataaaaggaggagcttactctcattccaacacacacaactttgagctgaattacaagaggctctattgtatcttttgtacattagaataaggtcgagagtgaggggaagctctggaggagtgcccggaagtttggtgctcatccgacttctacctcgacgagtgtagcttcctaggaggaattcgggaggagtaccggagctgtcggtatactctgctatgggttcggagaaacttcttctattaagtaagcatccatgttcctttcttatgttatttaattactttgtgtaagtaggatatattttcatctttgtgggttcattgtttagtattcatactaagttctctagtactaggactccggaaagagaaggaagttcctgcgtaagtattagagtagtaattaataacttagacatggtgtctaggttagagattacctttgtttgttgtgtatcccatggatttgtcaaaggtaggtggcaggtggtgacagccctgaatcccgtcctagtaatcctccacgttcgggtacatcatagagctatagccggaaacacgctggcagaccagtaggggttggtgcccgaagcaacagataggaaattatctttgcttagcttagatagttaaaacacatagaaagtcctctctaacctacctaccattaggtagattacacacgttccttgagttcgatatccttttagggtcacccgaaggtgaagtgctacagcggtattccgtgcacttgcggatttatatgtgatcgtaagaaataccaacagcggctgacgcggcgacgggctcggggacggcgtgaaggaggtcggtggaggacggcggtcggctcggggatggtgtggaggtcggtggaggacggcgggggacgtcgatgcggcagtagcaaggacggtggcaaggacggtgggggacggcgtggaggaggtcgacggcggccgacgcgggctcgaggaccggtgccggctcggtgggcgacggtgtcgggctcccgaccgaggtggcggcggcatgagggctcgggaacggcggccgatggcggcggtgggcttccaaaggtggccgtgctagggtcagagagtggcgaacttcaaaaattttcatctagatctgacgagagtgaccctaatcaaatatgggcaagcatatctcaatcgggctaatctagacccctgacggcattaaagtatgcccgtagagtgacatatatctttgagcttaactaaagccgtacgatgaatatttgtgagggcctaaactaatcccctaaaataagtatttttttagctttctttaaggccccccggaagatttgccatttttcacttgaccaattttttttatatggtgctttttagggcctgtgtcaaaaattacttataa

SEQ ID NO: 14093 - DNA, 1697 bp, Oryza sativa
  unsure (1)..(1697): unsure at all n locations
ccttgaaagggaatagtcattttggtgcgggcctttaaattaatcccgataaaccctgaggtattcggatccaggcaattcctttagaggcccgtccaccgaaggatttggctcattttttacaaaatgaaacaataaattttttaaaaattgggtggccaattttagagttgaccgggaagtccaaatatattccattaaatattttaccagaattaacctaaattcactataaaaattattattttcatatatttcactaaataattcactaaagtacaataattcactaaataattcatttatttcactaaataattcaccaaactcactaaattcactaaaaaaactattttcatatatttcactaaataattcagtaacgaacaatagttcactaaataatttatttatttcactaaataattcaccaaattaactaaaatcactataaaaattactattttcatatatttcactaaataatttactaatttcatataacagaaaggcttgtttaatgctacaatagaaattcataggaatataagtacttcattcgtacaaaaagtttttttaataatacaaaatatttcatccatcacatgaaattcctaaaagatctatgttcggatattgcttgtggtacaatatgtagtggtttggacaagcgtgaattctactgacctctaaccccaggggacacaaaacctgattagcttcatatgtcatctcggacaatgtgttctcattaggaagcatggccttcaaaattcctataagatctatgaaaatcttgcccgtccatccactacttgccttcaacttcattaggtccaaggtagctgacaatttggtgtgttttgctttgcacccggcatacagagacatctccgagtcactggccaacttgttaaactttatagaatctctctcgttgtaagctaggttctcaacatcacgtaacatgtcttgcagtagattgtgatccacatcaaccatttcaccgcccagtggagaatgtacaaacatgtcatgctcatctccatcttcctaattttgtgcaccacttcctgattcatgctcatgatcttcatgttctagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagccccccttttggccggggccgtctccgtattggggagaaaggcttgtttacccccggaaattgctcaaaaccccttacctgtggtctggggaataaatttacccctatggaatggcccctccttaccgcctttaaccggggggtggtggtttcccccggggccctactttccgcccg

SEQ ID NO: 14094 - DNA, 1456 bp, Oryza sativa
  unsure (1)..(1456): unsure at all n locations
ttgggntntttgtttgttttccgcttgcaaatgncaattatgggacatgtaaaaaagcagaggaaaaccaagaatagagaaaaagcatactcgaactgccaagcttttaatttcagaacacacctcatcgaactcattcagttcggtgaacaagctcggggtgctggcaggtaagacaagattacttactccctccacaaagggaataaggtctgctcgggtctcaaaatcgccaggggcgaaacggggcgccgcaagagaatactccgaaacagatgtctcgatggccgcccccttccccttcgccttgactagcggcgaaataacccgctgacgcatagggctgccgaagaccctcgccgcagctgtcacgatccgttccgcggaggctgaagccccggcggcggcgctaccgcctgctccatcggcgccaagtgaaagaacgggggcggtcgaaaagtctaggctgcggccagcaggcgaagtcggagtctcgtcagaagactcgtcgtcgctgaagacgcgagcgacatcgacaagtccttttttcttggaaatccttttgaccgaacctcccttcgccgccatgcctgccgaaaacgcaattagcgccttcgccccatccaactcttttcagcgaaggggggagctgttcgactccaccccggtctcattgtgacccgggcttggagtaggagtatagccaggggtgtcgacgcggttttcgaccgcctcatccacggccttttcgacctcaacctcctcctcttcctccccttcctcttcgacgtcgtcctcgtcgtcggcgtcggaatcggacgaaacaggaacccttcgtttcctgggcgcaagctttacttgtccgcgcgttcgctttcacgaaggtcatgcatcgtcgtaggcctgtgggggttcgcccgaggaggcagttcgccgtcgtaaacccggttcgctcggccacccgcttgtcgcgttagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccacttgtttatgtattggcacaccccggggagagggtgggattgggcgctttccgttttcttaactaaccttgggctggggtagttgggggagggtttccttctaaagggggttcggtttcccaaaacgggttacccggaaaacttgtcaaaggcgccaggccgacccaaaaggcccttgggtttttaggtccccccccaggtaaaaaagct

SEQ ID NO: 14095 - DNA, 4482 bp, Oryza sativa
  unsure (1)..(4482): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatggaaaaatcgattttcccgtacaggcctcttaagaggacagtatgcaaaaatgagatcattttcgcttgcggctcacttaagcgaccgcatggaaaaatcgatttttccatacggaccacttaaggagccgtatgcaaaaataaaatttgaaaaatttaaaactagtttatctcactcatatgaactttaaattagatgattatttttcctaaaagtttctaaaatcatgctctgtcatgttattatgttcatactgccattattttggccttttttcttgtgactttgttttatcaattaaaattttgaatttcaaaattttgaagcagtaatgatttcagctgaaaaagtcatcaacaacaaagttgtataacttatcaagatctataacttattttttggtcatttcttcatcagacaaagtgatagtaacattttcacaaaatttgcatatctcttatatagtttataaaactttataagagagatatgtgcattttgtgaacaatcttacaaatcattttgtcggatgaaaaaataaccaaaataaaagttatagatcttgataagttatgacactttgttattgataactttttaagttgaaatcatttagtatttgaaaatgttgtttgaaattgtcataatttgaaattcaaattcaaactgtcgaaaaaaagtcatatagaaaaatgaccgaaacaaaagttgtagatcttgatgcattttacaactttgttgttgacaattttttcatttgtatcatttactacccgaaaatttatttgaatttcttatattttaaaattaaaagtaaatttcacagaactacagatactatgaccaaattatcacaaaactacatatttaactcggtgtatcacaaaactacacatttaacaccaaatttatcacaaaactacacatttaagatgaagtgtcacaaaactacatatttagtaactaaattatcacaaaactacaggtttagaatcaatttaataaaaagtaaagatgtttatagctccatcataacaatggtgctagggatttaaactccaaaagttttagttttgtgataaattcaatattaaatatgcatttttacgatatttaatctaaaatctgtagttttgtgataaatttggtgctaaatgtgtagttttgtgatacaactccttaaatctgtagttttgtgataatttggtcaaaatacctgtagtttgtgaaattgactgtgaaattaaaattttctatagttcaataaaactcagatagagaaatgaccaaaagaaaaacaggacacctaaatgagttctacaactttgtttttgacagctttttcatacgagttgatttagtgccataaaaatcgattagaaatttcaaatgaaaattttccctcctcaccacttcaaaatatttcatctttcatcctcctctctctctccccccctgatatttttcccttctcctcactctttctcttcctctctctcactctttctctcctctccctctctttctcttcctctctcggtaccgagcacgagtgggcggcgtgcgcgtgctggtggctagcggctgccgcgtcgtccccgtcgctcgggctgcccccttcgcggcggcgccgactgatgtgcttgagggtgtcccgatatttcgatgagagggataagtagattggatggagtgacgttggcgatccgactacaactatccagggatgttgcgccttagcaatcgttacaccaactccagaggcggtgtaagcaatcgagaaccagcaagaacaagatgaacaagcaactaaatttgcgaatcaaagatgtttgattgaatcaatagaagtaacaagtggggttcagtaacaagcaatccggcaatctaatcgaccacgggatcaactcggcaaagtagcgacgctgtactttgatctaaacaaaacccgattattcttggtggcggagaaagctataagaagaggaaggggacaaccacagggatgctggggtcgttctctaaccctaggacgcatccctaatggacccaacttgatacacggcccattgggcccgaagaggtgacgcaacaccgtggacagaaaagaactcggtagaaaaatgaagattgcggctgctccagaactgatatggacaagaggctagatccatttgaaggtagacttgatagtacttgcacgcccaaatcagagttcgcatgaagtcatggcgaccgtcaaaagttgggactgtgctgcagtccgaatccaccccgcgcgaatcctcacccatttgattctctccattgttcctgaataaaacaagagtgcacgtgtctccggggaataaataagaatcatatgaatttaagaatgaatgcacctgatagttgagttgacgtgcacgagcgcgagtaataggacgttgaagttgtacttgtggaggcgtggatatatcgttggtgttgatgttctcatcaccgaccctgacgacgacgaggaggcgccgaccctgacgacaatgagcctgaccccgacggcaacgacgagtgggcggtgacgacaacgagtgggcaacgacgataacgacgcgtgggcggcgacgcggcattgtgtgtttagatgatttattatgagaatgagtagttaatgcttgtgtgtcactctacccttggattatcttaacccctgcttagaatatgattatcacaagtaatatataaattattagtcaagttctctctacattatcttcccacgggataaaataaatacgatacccttggaatattctcgggtgaaatgctacaatggtatatccatgcgcttgtggatgaactctgtaaccataatataccaggagtatttctgggccattgctgggaattatatttctagtaatgtcgttaagaaataccaacacacgggcggggctgttagtgttatggataccacatacctaatagtagttgactaagcacgacaaggcccaccacataccatatcttatacggaatcatacctcgtatatagaaggagattcggataaggaaggacaaatagagttctatatgaaaatgacaaggactacctggattgtatccatattggtctccctagttcttcttggacaaggggacacctatgggtataaatacaagccccccaggaggagaaaaagcaagccacaagaccaacaagacacaacatatacataagccaacacacaccgccagatctcgacatcagagattagcctagacataccgcatccggtgcctacggaggccggctagagggatctagcgctatctctgatctcgacgagttcatgctcgaggaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14096 - DNA, 1807 bp, Oryza sativa
  unsure (1)..(1807): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagaagcacgtcactgatgtccatcattggtgacgggctccaacttgaggcctggttgaaataactattatattaggcccatcacgatgaatgttatcggtgatgagcttttacttaggcccgacaaagataactaaaatacctgttaccgtcgtattttttttggccgttacagatatttattgcacagtataaataccccaactacctagtgtaatggttatcccactgttcactattttggtgggagtatgaggcggtgatttttgtctcttttctccaagaaaatcataaattgcaaatttaattgaaaaatagtagtcaattctcaaaaatttagtaaatacttacctacaaaatgtatatctaatatttttctacttttatgaagctcggggatggatcaaagttagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttacttatttagagcgggaatacggttcccagaattgggggtaacccggaaagaccttgggcaaaagcccccaaagcccgaactcaaaaaggcccggtttgtgctttctaaggttcgcccctttggggtttaaaattgcgcttatttaagggtggaaaccccagggatttaaaaaccagggtttcccctgaaacctcttggggttttttttaacccggcgttacagaaaatttcgttttttttttggaagggggctttttattaaaccctggggtttaatgggggggggtctcaacacatggttgggcaacaccc

SEQ ID NO: 14097 - DNA, 937 bp, Oryza sativa
  unsure (1)..(937): unsure at all n locations
gcgtcatgaaatcactgcanatncccccctgttcttgattacaggacctaatctttgatgaacaaaaacccttgtctgccttagccgattacccttattatatgatcggcttgagctctcgacaatatcactgcacccagggcagttttcaatagatggcaacctcatgccttcattccagcagaatctaaaaaattcacaaccccaatgaggatcaaaaccatcatcgtattcttcataatgcttctcttgctgcttgtcatatttcctctgatatttgttgataatcttagccgaattcacttgaaaaccccttgcgcgggtcctatcggctgtctggccagctgtatgcaccatattaacaggaaaaggattaccatcgaccttcatcggttttttggaatcatcaaacttaatcttgcccccctcaatggccacctggatctgatgtctaaaaaccttgcaatcgttagtagaatgagacccaaaattatgccatttgcaatacctctttttgcctaactcctcggccgatgggattgtatttccagcaggaagttgaatttgcttctctcggagtagcagatcaaagatcttgtcagctttagtaatatcaaaatcgtatttctcttcttttccagaacttttcacccattggcatggtatgacctttttactccttacccattcggccgcagctatttcagaatcatcctcattatcatcctacctatacatgtatggacaaacatgattaactctcttagagttcttcctaacttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14098 - DNA, 2380 bp, Oryza sativa
  unsure (1)..(2380): unsure at all n locations
ctgttatganttcgcatacgcttaaccgntttgcaattccgttcttcgagagccgattctaacctcccacggcaaaacagccacatgcccataaacaggtttgtaatgagggatttggatcgatccatgacaagccatcctataagaccacaacgcttcggccaaccgagtatgccattgccgaggataatcagaaattttccgcttaatcaatttgatcaaacttttattagacgcctcggcctgcccattagcttgtgcataataaggtgaagaattcaacaatttgatacccatgctatcagcaaactgaacaaactcatcggacacgaagattgaaccctgatcggtagtaatagtttgaggaataccaaatcggtagattatatgttcttgaacaaattgaatggcatcccgagaatcaactttcttcaaaggaatcacctccacccacttggtgaaataatcagtcgccaccaatataaacttatgtcctttacttgatggtgggtttatcataacaatcatatcgactccccaacctctaaatggccatggcttaataataggattcatagccgacgccggcgctcgctgaattgctccaaacttctgacaatcttgacaccccttataatatttgaaacaatcctccagcattgtcggtcaaaaataccctgcacggcgaagtaaccacttcatcttatgaaccgattgatgagtaccacaaattccttcatgaacttcgccgattgcaactttagcctgatcggcactcaagcacttaagtaatactccatcaatcgtccgataataaaactcatcatccaatagtgtatacattaatgccttataccttaatttcctagaagccgattgggatggattactcaaatatcgatgcacatcatacctccaatcatcggctatcattgctgcaatttcaactttaacatctttgatcattggcttatatcccgatgccccttgggctaaatcattagcatcaatattttgctctcgataaacatgctttaaagtaaccagccgaaactctttcattagttcttggcacttctcattataaaccatcaatgtatcattcttgcattcatactctcctgccaattgactgattactaacagagaatcccccatgatttcaatggtatcggcttcaacttccctgagtagttgcaaccccttgagcactgcctcatactcagcttgattattagtcgcatacggtttaatagtataagcaaactataaacatgcccccctaggggagattattactaagccgataccacagccatgagtacacaccgatccatcaaagaataaagtccacggtactatttcaaccgagccgattgaatcatcacgatgttccacaataaaattggctatagcttgtccctaaattgcctttggagactcataccgaagatcaaattcggttaaggaaaatatccacttcccaactcttcctttcaatattggagccgatagtatgtatctgactacgtcggctttacatataacagtacactcgttagatagtagataatgcctcaaccttgtacacgaaaaatacagacacaagcataacttctcaacaggggagtaccgagttttagcatccaagagccgacgactaagataaaatacgactcgttccttcccttccaactccggaatgaagactgagacgattgacttctcaccggccgataaatataacctaaacggtattcctttctgtggaggaatcaaaccaggagtagagctaagatatccttaatatcatccaaagccttttgctgctctgcccccaaagtaaattgctgatcggctttcaatctcaacaatggtgtaaaaggttctaaccttccaaacaaattagaaataaacctcctaacaaaatttaccttgccgatcatctcctataattctgtcttattctccggaggctgaatcttcttgatcgcattaacactcctttgagttacctcaatccccctttcaagaacaagaaatcccaaaaactggccagccgatacaccaaaagcacatttcgtcagattcatctttaggccatattttctggttctctcaaaaaccttcctcaaatcggctatgtggtcctctatttctttagacttaacaatcacatcatcgatgtagacttcaaccaaccagccgattagatcatgatatatataattcatggctctttgatatgtagctccagcactcttcaagccgaaagtcatgacaacccattcaaataagccaattgcaccagaacacctaaaagctgtcttatgaatgtcttctgcggccatccatcacacggcggccgccatcaaaacgt

SEQ ID NO: 14099 - DNA, 2106 bp, Oryza sativa
  unsure (1)..(2106): unsure at all n locations
aggtggcccacacaattatttttccaataaaggcccgtcggtcagaaataaaggggtgttttccccccacctccagttttganccgcccccctcccccatttgagaaacctcacgcggtgacttataaaaagccccccctctcccgaaggaaaaaagccggccagggttcccggtaaacggccaggtcggaacaaaaagagccccaagggggtttccaagggaaacccccgggatacttaaaagccccggaggggtttcccccccttggacttagggtccattttttttaatagcttgccacgggggccgaggtttatgaaaaaccggcccctttcccggccccttttccgggtcttggcccgttttccggcctttttgtggcgtggtgcctcccggggggccttctaaatggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccagcagttggccccgtttgtgctccgcgcagccatcgccattgtcgcgggaagggagcacggcgcgtctgtggtgctcgtcgtcgtcggtctcggagcccgagacgtggcagtcgtagcagatctctccctcctcgatctggtcatcgtcgtcgacgtttgggcggcggcagcggtgaccaccctccatggcgcccttgctggaattaccaccctccatggcgcaaatattcttggcttcttcttgttgctctagggctccatccaatggatacgatacggctcgcgaaagctagaggaagaatctactcaggctagggtttgttccactaatccgctcggtggctgtgggcggccgcagcgacgcagtgatggttaattatatatatagcggcgtgcgtgttgcatgcgttttttgcggcgtgtctgtgtgcgtagagagagatcgagagagagaggagagaaccactcggatacggtcgggctcccttcctcccaacgagaacttagaaagtttgcctctgttacgaatcgactgctgagagagagagagtagattttatggtgggacatatttttccttaatatttaaaatcttttagagattgtatgtggtagatatgtagtgtttaaaatttctgagactgaaatttggtttaagattgtaccgcaagaaattatttaaggaaataaaatgtctgatagatggttactccacgataaaaaaatggttagatgtttaattaattaaataattctagctttatggatattcctaaataaaaatggtttaatttcaataattaacctattaaacttttttgtctgcaccgtaagttgctttttgggtttttttggttatcatgtggttcattaatctatgtttaaaatttttctaaatacccctcttttcggaaagttttttgccaataatgtgtttgggctatgtctttaaaaaattattttttttctttattacacacactccttcctttgtgtgagaacattacaccctcttgggggagtttttttttcttccctcaagacgcagttcagacgctgggagaagagtatcattatgngccctctaatttggcacccgagtcgaaattattcccttactcacaaaattggtacccgcgttcccacatctttaaaacaccccaaataaggccctatgcgaatatgtgttcacggtgccacacgggccctcccaaggataatggcctcttctgaacaccttaaataatttgaaaacgtccccagaaaag

SEQ ID NO: 14100 - DNA, 1938 bp, Oryza sativa
  unsure (1)..(1938): unsure at all n locations
actgtcatgttgacnctcgtgcgggcctcncgctgtctggccagctgtatgcaccatattaacaggaaaaggattaccatcgaccttcatcggttttttggtatcatcaaacttaatcttgcccccctcaatggccacctggatctgatgtctaaaaaccttgcaatcgttagtagaatgagacccaaaattatgccatttgcaatacctctttttgcctaactcctcggccgatgggattgtatttccagcaggaagttgaatttgcttctctcggagtagcagatcaaagatcttgtcagctttagtaatatcaaaatcgtatttctcttcttttccagaacttttcacccattggcatggtatgacctttttactccttacccattcggccgcagctatttcagaatcatcctcattatcatcctacctatacatgtatggacaaacatgattaactctcttagagttcttcctaacttccgcagacctatgctcatgcagggttactttctgtatcagatgtgacaagctatcaaagtcttcagatgagaacttctccctaatcagagcaatcataccctgaaaggccagatcggctaactgggcatcagttaaactcaagctgaagcatttgttcctcatctccctgaatctctgaatatactcgtgcacaggttcatcatgcgctgcttaatcgccgtcaagtcagatcatttcatctcatgaaccccactatagaaatagctgtggaattgcttctccaaatcggcccaactattgatcgaaccatatggcaaagaggaaaaccaagtaaaagccgatccagacagagataaccagaataacctaactttcagagcgtctatagccgatgcttcaccacactgagccaggaatcggctaatgtgctcataagtcgacacatcatcttgtcttgaaaatttggagaagtccggaactttgaactgattgggaagaggaactgtctcaaaccactcagggtaaggctgccgatacaagcttccagtctcttttggtttaagcccaaactgttccctcatcacatcagcaatcacatcagcccacggtcgttgctgagctgctccttgtggctgttgctgcatgggctcgaactaaccatattgagatgcaaaccgaggttcagccaatccccctggctgatactgggcttgcggggaaggaggctgatattgataactcaagttacccccttggtaattatgaaggttcggctggatattgcgcaccaagtgctcaggaacaacctgaggcattactgtgccgtcccgctgtacgtggtgaaacaaatgttctgggacaacttggtttacaaattgttgtacaggctgaccaccaggcgttgcaaacccggccgatgcacttattgacccctggtgcttaatcggcttgacgatttgctgtcttaacggagtcttgtggatccgctgcagaagcttgctgcttggtggtgttgctgaatccgcttgaaaagctgcttgcttgcacgacctgttgctggattggtggacaaccagctgaantgtgggtgtctgctgaatcgcttgttgctgnatggatcaaacacanngtgggtgtnagaaacatgcaagcacctgatcttggtcaaccgattgcaanctgcccgcatgctattgctgttcctcaataacaaccgagggtactatcttnccttgcgcctatctgatgtacaaatatggaattgttcccgnccccccgctgaatttgggcaacggagggaatcccctaaaaaaggtgaaatctggaccaaaccttgtaattgggagaacattcttgtaatacacgcgccccggcccgtgttcatttttgacactaattttggttctaagtttgagggtttgccaaacccccacttttttaaaacttggtcccccg

SEQ ID NO: 14101 - DNA, 2232 bp, Oryza sativa
  unsure (1)..(2232): unsure at all n locations
gattgcnntttgttgancncccnctngngatggatttctaagtcgaatgctttggtttcttctttttcctctttggatgttgttgacagaaaacacgaggcctaggagatttgcttaactccagtgcaggtccaaagctcgccttcgggtgcgctagcgtgccagttgatttgatcctgtaatcaacaagaaatagaagcaaagaaaccgtggttaaatctataaatgatagccgatcggctaggtgccgatgacatatcatttatctttgagccgatgtcatatgtgaatctatcggcagttgcaaataaacaataaaggactaaatctattcgatcggctgtagatatttccaatatataattcttatgtcgatatatacttaaatcaagtgattgggatagatcgatcgccatgccgagacagtataaatcacttagatcaaaatatatattaataacaggactatatatgtttatagcatagccccatcagatagatctagcatgtatcggctaatactccgatactactctatatcaggatattaaaacaggtaaaatatatcaaacagaagcctaatatacttaaaaaagtaatatcttgacataaagggcagatttaacgtgtcaatgaagcatatagagcaaatataattaaatcagataagatcggctgacactccgatgctaccctaatcgacaaccagaagacaggctagagattgatattctaatcatgacttaatagatcaaactcaactgatgcagcattaaatatgaaaagaagaacaatatctagacaatcaagccgctggaagtttcatagagtggtagatatcttatatattccgagtcaacgtcagaatctaacctaatcggctgccttcctcgatagatgttagccgattgtaggttagatagcgatattgctagagattatgtaagatatatgataacttgacgaatcacataaacaagattagagtatcataaagatggaagcgctaatctcaagaacgcaagccgtcataacaagttttacctcttgttgaagatcgaaaccgatgcagctcaacccgaaagcaagaactcgtcgaaacaaaactaaagtaaaaaagggtggcgatgcaccggaattatattgaacgtgtgtttttaagttacatagggctcggttctatttatacccgagaattacaagatatgtccataatggacacgattaccatctctaacaaactctaagatactataagtctttgcggcagacttttgcccaatcgtatctctaaagaaattacataaagcatcctaattaatagatagaattgcctcctcagagactctatccatgtgcggcaatctccttgaagcacctcaatccaacccgacatcacacgtcaagttgtattatcagaatcagctgtatcggcttttctaatccgactcagacccagccgatcctagtcgtagccgatccggactccagccgattccttgctctgtttccgaactcgatctccgcctccaactttgcttcgatctaatcttctttcctgatgctgatgttaccaaatctggttggtaacacatgccctccaagtccagaatatttggaatgtttcggatttgctgaaatcgactccgagcaaatttcgcactttgcttgtttccgaccgttattgccgtgctttaaatactaaccgtcaccttcgagaaatctcacaccgtgacttccatttncaccgctcaagcgaaaccttgtcctctttcttctccgccattnctncaacgcanaagcgactttcaggcgacttcatcttcggcgagatttccgcccgcagtgatgtcgttctccaccaacccatttgatacgccatcaaccgagtatgctgaggtaagtcctattcgggtagatcccctttcttaacaagagatcgaatttttcctaattttacacccctctcttttttctcggtggttgtgtatttgaagcaatctttcacatctagatggggattccaggctnttattcgaaaaacattaatttttgggcccggtgaacaaccccgtttccactgggtttattattggggaaaccaaaggggccccttcaaatttacaaccccatatttgtggcggggagaaaacccttaaattgggcgccctttagaaaagactcccccaaaaaaggtgcccctcgtggtaaagattttttaaacaaaagagg

SEQ ID NO: 14102 - DNA, 1216 bp, Oryza sativa
  unsure (1)..(1216): unsure at all n locations
caaaaagaggattggttggttcaacaattcgcccctatgaaatgccagaacagaaaaagggtccaaagtttcttgaaggggtcaatgatatctcatcggatgtcctagctgggaaggcaaaaaaaagcaaaatggtgaaagccacaatacaagccccacaccacaagccaaaggttcttaccaaggaggaagattgagaatctaggagagcttttcaacaagtttgcccgctttgaagccattattgatgtagtgtgtaaagtgagatgattattaggaaaagaacttctcggatttttgcttcatggcgcgtggtgaatctgacacagagtatgaagataatgaggtgagtgatcttgaggaagctattaatattttgagtgcaaaaaataagaagtgtgagaagatatatagaaaacaggaatttatcattgaatctcttaaatctgaaattgataaattaaaatctcttattcctaatgataatgattgtgaaaattgtgaggttttaatgaatgagatttcaaaaattagagatgttaatgctgcacatgatttgaaaaatagatcttctcttgcttgtagttttgctttgcacacacgcacattggatgagttgtttttaactaaaaagttgttgcaaaaatatcaaattgcttttcatgctagtttgatgtttaacatgatttctgctaaaaagttaaaacaacctcatgatgttttggattgctcaacatgtaatttgaataagatgaaactaaaagatgctttaggtcgtgttgagtacatggaagatgttgtgaaaaacaatgaactgctttcttgccccaaatgtcgtaaaagcaaaggtgtcatggtagattgtgaaaattgtgctaatttggaaaaagaggtttctcatttgaaaaattctttgctaagattttctgatggtaaaaagaacctcaacatgattttagatcaatcaaaggttagcacacataaccgtggtttaggttttaatcctttctcgttatagaagagtgtttaaagctgattttgaaaatcctgtttcacctgtgataacatgtttggttgctaagtttgataaagatgtgatgttttggcatcgtagacttgcacatgttggttttgatcatctcactaggttaagtggtttggatcttgttcgtggtttgcctgnnctttgcaagnggnagtcaatatcagggcggtg

SEQ ID NO: 14103 - DNA, 1725 bp, Oryza sativa
  unsure (1)..(1725): unsure at all n locations
accctccccccccccccaaggaaaaaagggggcggagtatcccgttacggccgggggggaaaggaaagcccaaagggctttcctggggacacgccggtattcttatgccctgggggtttccccaccttacctgaggttatttttggaaggcgggcagggggcgaaccttaggaaaaacgccaaattcgggccctttgggggtcagggccttttggaggctctttgccaagtgtgtttccgcggttaacccggattcgggggatcccggattccgccttgaggtgagcttatacggctagcttcaacggacgatcggagccaggagttcagtgaccagaacctgaatgtgcgccaaatggcaatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttgctctgcttggaatacctctagaatctcagcacaagatcttccctaacttaccgcgttccctttcggagggaaggtaatctttcccaagcttgcctggcacatcgacaatatgcaacggattctcgcgggtcatacgtatccgtctagtagataataagcccggagatggcaggtaagacctgggtggataatagccgatcgaattgttaagtcgaaggaagactttctgggatagcaggagcaactagtcacagccgatgtgatgccttcccacagccgatggagtctagtcacttgatgattgccgtacagtggaacaagcaggcgaaggctataaaatagacaagtgttatatagacgccggttgagtttgattaagtaaaagaattaaagacatcttactggtggagccgacttgggaatcattgctgctggctttttcttcacaacagttttctttttctacaaccacaaagtctatgggtaattagccgaagagggaagtaattttggtagaagtcaaaaagagatgcttactcttgtaaaatgaactagggcggaaggagttggaggcgtttgcctgggtgaaaccgatggtgttcgttctgtatcgcttacttcggctgcagcctcatcaacgtcatcttcaattatttcttcatccagagcttgttcactggatggatctagagcaggtagatcatcagctggtgtagtcttctttgtcttagctgtcttagccggggctgaaatatttacagtcgatgatttgttgtttcttttcttggcagcatcggctggttctctgataagcccttggagaagagctgaagtcttgggggcattatagccgatgatggggggagatggcccacctccgttggggatcagtcctggggcatactcgatatccctgacgttgttgctttggtgagggaacgaagattctgttgtctgcaaatcaggagaaaggttagctaaggactaatcgaccaagtagtgttcnnatngngcnttgaaggggattcaaaanccgt

SEQ ID NO: 14104 - DNA, 2084 bp, Oryza sativa
  unsure (1)..(2084): unsure at all n locations
ccccccccccccaccatatattacctccctcaataccccttccacctattgtcaatactcctagtgttgtaaaaagcccatttgtctttattttaacacacgcaccgttttgaattgccaaaccacaaacctttcacccttttttttcaaagccttttcattactgtttttaacaaaggcgccatccgcccccatggttttattggcctcattttctttcaatcgaaccccggcaaaaatttttgtatattttggggccaacctatccctccatttctaggctttttggctggtccccatggtttttttttagttagctctaaaataccctatgcgagtctaacttcctggagagcgcatgcccccacctccttattgcccttcaattcccatttaaattcaaggtttattttttccacccacctcattcttctcgaatccaaagccctagatttccaccttgaattgattgtttacaaggcacaaaaagtgattgattcccataccgcccatccagtttaccaatttaaggaagaaattgtacctttcagtctccagttccgcagaagccagtgatcagtttaaaccaggctgcgggtgaagaacaagaggtagtagtggagaaaaccactaagaagttgaaggatattcccatagtcagagaggtatccaaaggtttttcccggatgatctgacaacaatgccaccaaaaagggatatcgagttccggattgacttggtacctgaaactgcaccgatccacaagaggccttacagaatggaagccaacgagttggcggaagtcaagaagcaagttgatgaacagttacagaagggatacatccgcccgagcacgtcgccttggggtgctccagttatttttgtggaaaagaaagataaaaccaaaaggatgtgcgtcgactaccgcgcactcaatgaggtcactattaagaacaagtatccgttgccaaggattgatgatctgtttgatcagttgaaaggagctacagtgttctctaagatcgacctgcgatcaggctatcaccagtttaggatccgcgaagaggatattccaaagacagcattcatcactcggtacgggttgttcgaatgcacagttatgtctttcggactcactaatgcacctgccttcttcatgaatttgatgaacaaggtgtttatggaatttctggacaagtttgtcgtggttttcatcgatgacatacttatctactctaagtccgaggaagaacatgagcagcatctccggctggtacttgaaaagttaaaagagcaccagctatatgccaagttcagcaagtgcgacttctggcttaaggaagttcagtttctcggtcacatcgtgaatgctcaaggagtagcggtggatccagcaaatgtggagtcggttaccaagtggaccccaccaaggacagtcactctggttcggagtttcttaggacttgcgggctattaccgtcggttcattgagaacttctctaaaattgccaagccaatgacacaactattgaagaaggaagaaaagtttatctggtctgctgaatgcaataggagttttgaagaactcaaacgacggttggtgtctgcaccagttttaattctgcctgatcagacgaaagatttccagtttattgtgatgcatctcgccaggggctangatgtgtgttgatgcaagatggcaaaatgttttctaatgcttcacggcagttgcgtcctcatgaaggcactacccacccacgatttggaatggccgaagtgttcatgctttaaagacttgcggcactattcatcggtaaccgtgggaagtttttacagacaccaaatctaaagtcatcttaccccaactgacctgaattntgccaaccaagaggttggagctaatcaaaattttgattggaaacacatttattccgcaagcttaaggggttcacacccctgaaccggaaagaacttgaccttccagggtaaagaactttcttggggttcaacggattggaactatgaccttgtttattaaccacgatttgggttgttttaggcacccccacacggtgacaggtttn

SEQ ID NO: 14105 - DNA, 2155 bp, Oryza sativa
ggtttcccccactctttggggcgccaccccctctataaaaccccctgtggttttaaaagagcccccttcttacaagagaaaagaggggggattttcctaataacgggtgtttttaaaaagggcccggaaatttcttggggaaacccgtgtgattttaatattcccggggggtcccgcctttaatatagacgctctttttttactccctccggggggggacacaatttggaaaccgccaaaaacggccctttttgggttccctccccttgggaagcctttcggcacagttctcttatcggcctggcacactaggtggtgggaaaacagaattctcgcctttaaatgagttattcccgcccccttccccgtacctctcgagaacggggaatatattccctgagacagtggaaaggccccaaatcctcacaccactgtccacggtcggttgccgatatcattaagcacagtggccggcaatggtttcctgctctaagagcgcacagtgaacgcacgcgcactgaatttaagttaggtctctcgatcagcagcccaagcgtagtcttgtaagcatccgcgtcgtatgttgtgcgcaattgtacacggacaactctttctctcatgaaactccttttgaccgtacctcccttagcctctatgcgtgccgaaatagcaattagagctttcgccccatccttgtcttttaaccggagtccgcagctgttcgactccactccggtgtcattgtgacccgtgcttgaagtaggagcatacccaggggtgtatacgcggttttcgaccgcctcatcccgtgcctttgggacgtcaacctcatcttcttcctccccttcctctttgacgtagtcctcgtcgtcggcgtcgaaatcggacgaaacaggaaccattagtttcctgggcgcaagcttcactagtatgcgcgttaggtttcacccaggtcctgcatggtcgtgggctttgtaggggttcgcccgagtaggcagttcgccgtagtaaacccggttggcacggccatccgcttgttctgttagcagctgtctatactcgacgaccgacacgtcgccgatcatcatacaggcttcggcgtcagcctggtcaagggttaacactataaaaataaagggagtagccacattaagcgtcgaacaaagcaaaataacaaagcacagaagtgcattgcgaaagggcagtcttaccgttcgtcccttcagggagaaccaactttggcaacccatcaacctctttgccttgctcaactgcgatttgctacgactgggagaggggaaagatgcgaagcatgcagaattcctccaccaagtcgcggcagataaggcgggagcagaccttacgcagtaaagtgaaccgcgcctccatagcgcccgtcacggcgaatctttggctttttgggttaggggaaatcgccctacggcccactttcaaagggctttatgcgggtcagaactaatcctcgacggtgatgtctgttataaactcttccacaatcgctcagctttcccccctcctacataaagtgttctaccgacttctctatctaccatccgtcccaatccctctcaagcacaccttacatatccactcgtctatacccttaccctctttctctcttaaccctctcaagtaatcctcggcccttccctcctactcttctacactatgttctaccttactctatcattctccaacccttctctattcccatttctcttctcctctagccttccctatcgctctcccctccacctattttatcgtcttcacactgtatccctcacgttaccctctccttccattaccctctcctccaactcgacttcgcaagctcattctctcctaccctcctccatccttctatctctgctatatttcacttctactgtcgttctcatctccctcttacgtctgactctcttcttatcttccgacatccctcgtgctctctcttctcctgcccatcatactgtatgtcaccatactatcgctctactctattatcgcctatactcgacatcgctcaaattctctactcgtaatcacctacactcttcttctctcgattactcaacattacttatatcatcataaacctaacgttactcctcttaactcgtttatctactct

SEQ ID NO: 14106 - DNA, 2053 bp, Oryza sativa
  unsure (1)..(2053): unsure at all n locations
tggggggtgggcccctcttcccccggcccccccaaaccgttataattttttacagggggagaaggaaaaaagtttttaagggggcacaaaattattcccataacccccggttggtaaaggggtttcacacacccctgttggggaacctcctcccgatttaacacccacgggtatttaagaacgccccctttccagaggaaaaaggcgcacagtttccggaaagggcaagttgaaaaaagaaggcgcaaaagatctttcaggggaaaacgcctgttttataaaagccggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggcaacaaaattagaggaatggagatgagcatgacatgtttgtacattctcactgggcggtgaaatggttgatgtggatcacaatctactgcaagacatgttacgtgatgttgagaacctagcttacaacgagagagattctataaagtttaacaagttggccagtgactcggagatgtctctgtatgccgggtgcaaagcaaaacacaccaaattgtcagctaccttggacctaatgaagttgaaggcaagtagtggatggacgggcaagattttcatagatcttataggaattttgaaggccatgcttcctaatgagaacacattgtccgagatgacatatgaagctaatcaggttttgtgtcccctggggttagaggtcagtagaattcacgcttgtccaaaccactacatattgtaccacaagcaatatccgaacatagatcttttaggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttacttgaactcctttggcctcggncggttcgggtggnggcgagaccgttatcaacttcattcaaaaggcggggtatacccggttatctacacgaaatcagggggatataaccgccggaaaagaacattgtggagccaaaagccccaccaaanagggccaggaaacgctgaaaaaagcccnggctggctgcggttttttcatataggtcccgccccccctggcgagagatatcaaaaatatgcaccttcaaattaaagatgtggcgacacaccacacggacatataagataacacgacggtttcccccgtgaaaattctctctggcgccttctcttgttcacaccttccctn

SEQ ID NO: 14107 - DNA, 2197 bp, Oryza sativa
  unsure (1)..(2197): unsure at all n locations
cggttcctgggtttggtgaagatgtcgtagaacgaaagatgtacgcaagggagaccggcaaattgcgtgataaacgaaggaaccgcgaataaggggagttttgtgcaaatagaaacaaaccacaataaaaggtgagacccgcgaaaggccaaaaaacgtatcggggggggggccgagggtgaaccccgccaaagcgtttttggggacgggttcgaaagcataaatcggagccaaagggagcccggattaaggctgacgagaaaagcgggaacgtgggaaaagaaaggaacaaagcaaaggagggacctaaggccctgaaaggaaacgggaaggcttgggggaaccccaaaccgccgcgtttattgggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatataaatgtaaaacagataattacaaaatacaggaatggccgtttgattagaccgtaggaaaaacaaagaaaaaagagaagagataaagactcaaagaaaagttttcatgaggtagaacctcatgttatttctcctccaaaacttgcattgtattaggcattccatatgtatttcataggatttccataggattcatttctttgattcaaagtgtaaaaatttctatagaaatgaaatcctgtaaaattcttacgaatttcttttgaatcaaggggggccttaaatgcaaacaactccaaacattttaaaacagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14108 - DNA, 1405 bp, Oryza sativa
  unsure (1)..(1405): unsure at all n locations
aaaaaggtattccaagtgagggtaacaaaaggtgacttttaaccaataaattaaacatgggttgataggttgggtttacaattcctgacccaacaaaaacttttaaaattttaaggaacccattaaaaaaataaattttatagaagctaccggacattgggaggggcacccattgtttttgtgtaaaagtaattaaaaaacccgtttctttcaaaaccacataaaaagaatatgttatattaagcaaaaggaaatatttatttaaacggtgaaatagacaaaagcctttaatanactgaatgttaatgtctatcacatgcaaacaaaaatcactttgtcactattatatgtaaactcgtctacaaccatcattcgcaaacataatataggttttgtttttttctttcttttattatacatctaattcacttatgccatggtaacgtacgaaggaataatttatattgtcatattatttacgctaactattaatactatttacatgagagcggcataatgcagtttcttgtgccatttaatttcgatcttggactgaactgttagtgctgacatacttgataaactgataactcactttgctgacaaggaattggtgcatcttttgcactgactttcgtgaatcctcatatgcttactttgctttgaactactcttgacccggaaacaagtatttgaagaagttgcttgatcggcatttcacctggattacgatttctccctgttcttctgtaggctgaactgttgacacggcagcccgggtgtacacgttagatttaaatctgttaacttggcaataggcttctttgagctataactgttctttccctgcttatctgaacatccaattgaaacggttacggggcatgacaaaaatcatcttcgagacttacccttaaaacaagtggttgagcatttgcctgaccgtgatcaattaaactgctatccttgaaaataaccaaacttcggttattttcctggaaccctgacttggagaactcatcgcttcatcaatcagttcaaataaggtgatgccggtgcactttcattccaagagggcttggaacataacactgatcagttgttgacaggaagttccacaaaagtgactctcattcagtttccgaacatacagactcttgattgacctttccatctgcatgactgttctgttctgccctgacttcggtgtcaactggttgaacgggctgcttagttgatatcttgaaataagcactgatcacttaatagatcaagctcaaaagattatttcctcgatataacatttcacttctttgcttatcctttattgactcctctgggttgatagactataagctctaaagttgctttccnncgatnnctgcgagaggtgatcataagggcg

SEQ ID NO: 14109 - DNA, 1898 bp, Oryza sativa
  unsure (1)..(1898): unsure at all n locations
cggcgtggattaagggttgtcttccccaccccgtttggagaaccctctccccaatttaataccagaggtttattattaaagccccctcttcaaagagaaaggggacaatttccgtaacggcaggtggaacaaaaggccaagggacttcagggaaccccgtgttttttaagtcttggggtttccccctttaacttaaggaattttttgtaacctgtcagggggggaaccttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatttgatccggacttgcctgttcctcaggaactctcaaacatttcttcaactgggagacgtggaacacattatggatgccaagcatgttggagggaagctcaagctggtaagcaacttcacccctgcgttccaaaatccgatatggtcccacaaagcgtggtgccaactttcctttggtttggaagcagtgtactcccctgagcggagtgacacggagatacacataatcccctgcttggaaaacgagctcccttcggcggttgtctgcatagcttttctgccgagattgcgcgattctcaatctttcatgacagctctaactttttcttctggctcatttaaagcttctgtaccaaacaactggcgttcccctgtctgatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14110 - DNA, 2029 bp, Oryza sativa
  unsure (1)..(2029): unsure at all n locations
aagacttcaggggaacgctgttctttaagccgggggttccccacttattagagctcatttttgtttctcgtcggggccgaacctataaaaacgcaccacccggcttttaaggtcgggcttttggggcttttgtcaatgttctttcgnnnnnnnnnnnnnnntggaaaancgtattacgctttgagtagctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatagaacttatcctaatatgttttttcgtatttgttgtttcactgattcaatcatttcaatcaaaattcaacaagagttattttcccttatgtgcaaaatctttactgatactaaatataaccccttcatataaatggttctactccatctatctgttcatccatttctccttattttagatgcccaaaaggacactctagtcgacattctcccccctttccgagtgaaggatctacagcgcattgacacgacaaacctctacagcttcgccaacgtgcttgccaatgtagtcgccgcagcgcggctgtcatcagggctcatactcaacaccttcgacttcatcgagggtgacaacatttgcaggatccgcgacgagctctccatccctgtgtttgccattggtccactcaacaaactcataccactcgtcggaagaagcagctttcttcccccagattgtgattgcctgaggtggcttgacacacaagcccctagctctgtgttgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14111 - DNA, 1786 bp, Oryza sativa
  unsure (1)..(1786): unsure at all n locations
aaaaggaagaattttttagacaaggtggacaagaaggcgccaagagttttcccggggaacccctgtattataaagcccgggggttccccccttatattagagttattttttatacctctcaggggggggaataataaaaaaacaacacagggcgtctttttggggttcgggctttgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcctagtcgtagccgatccggactccagccgattcctgctctgtttccgaactcgatctccgcctccaactttgcttcgatctaatcttctttcctgatgctgatgttaccaaatctggttgttaacacatgccctccaagtccagaatatttggtaatgtttcggatttgctgcaaatcgactccgagcaaatttcgcactttgctgttttccgaccgttattgccgtgctttaaatactaaccgtcaccttcgagaaatctcacaccgtgacttccatttccaccgctcaagcgaaaccttgtcctctttctctccggcaattcctccaacgcaaaagcgacttccaggcgacttcatcttcggcgagatttccgcccgcagtgatgtcgtcctccaccaacccatctgatacgccatcagccgagtatgctgaggtaagtcctaatcggctagatcccctttcttagcagcagatcgattttctcttatcttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14112 - DNA, 1513 bp, Oryza sativa
  unsure (1)..(1513): unsure at all n locations
caccgcgcttctctccttctactaatattccgtctcgccctgtatcttctnctaccccactgttactttctctcncctccttttcccctcnntngcgttngatatacttnnntcnnncnnnaagatgtccgatggtggacgatcgctccttaccacccatnctncctctttcatttaatcctaatctttcattcatttcccaatcccaaggcgagtgccatttcttattattcaaacacaccctaacagtctaccgggcactcaatgaggtcactattaagaacaagtatccgctgccaaggattgatgatctgtctgatcagttgaaaggagctacagtgttctttaagatcgacctgcgatcaggctatcaccaggtgaggatccctgatcccatcggtcgcccactcacaagccagggtccttgtgacttggttcattgctcctgacgttacaaagcgcatagctagtgattattacaacttgggaagcaactatcaaacatgtttcaccaaaggtattcacaatgtttcactatgtatatatataatgttgtagtatattgaaatattcttttaactaaggagacggtgaccgtgaacgagaaggagccgaatgtcgctggcaagcacatctctcttggaccaccacctttgccggaccttactccggccgccgctgaggtaacttcgtcggaaccacttgatcagccaccactactgtcaatggtggtgggtgcagaagttgcagcaccggcgctgcttgcgctggccaacgaggcagcggcattgccgccacaggatgatcaggcagaggaagaggcggctgcagaagccgctgcaccggccgaggcagcggcattgcgaccggttgaggcaggggcagaggcggccgatgttggagcagcaccagaagagccgctgctggcgcctattgccggcatgggaaccgtgcgtattttcggttttttggttgagaagccggcacctggagacggcagtggaggagagggttcagcgcctgcatagatcgtcctagttatgatatttgattttgtgattttctttagctatcttcagagccattaggatacttgatttagaggctttctttattatgttcaccgcatagtagttaagataatttttgcttttcgatagcagaagtgttttcttcgttgtactagctagttggccgggttttcgaggttaaagactataagaaacttacagttatatatggtgtgcaatgtggtctcaggtgttcggttgacgactggcaactggcaaggctgttttgtttggggtaatcctgatcctgaaggaaaacatgaaaagaccatgggaagtgaggggtactactatgtcccggacatctgacacgaggcatatcatcagacaaactgtggatcatccactgcatttgggcttttcatttgctctctctttgttacttacgaatatatacctctcacattttcttttagctggagcaacaagcatcaaaancccgt

SEQ ID NO: 14113 - DNA, 1134 bp, Oryza sativa
  unsure (1)..(1134): unsure at all n locations
tatcgcnggtggacgnctcctttgtgacggatactatgatctgctcgtcaaagaccacgaagaaaaaatgatctacagatgtctgtaacacactaattcttgttgatatattagcaacaataaccttttggtatgcacttgtgttacaaattttataacatactcgatatccctgacgttgttgctttggtgaggtgccgccagccgatgggtccgacagtgatgaagctgacgagggagattcatatttgtccaagcccgaaatggcggacgaaagatgatggtgaagaagacgacgaagactacgtccttcgcaagaaagtggtaggtttctataatgtcatttgagttgcaactgtacgagtgataaatagtagttcgtactaactcaaccattttttaattaatatcgtaggaaatgacacgtcgccgatcatcctacaggcttcggcgtcagcctggtcaagggtcaacactataaaaataaagggagtagccacattaagcgtcgaacaaagcaaaataacaaagcacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaactttagcaagggcccccaagggccggacacgtaaagggccggttttgcggttttctaaggattcgccccctgtaaggtttaaaaaattgggcttcagataagaggggaaccccgcgcggttattaaaacacgcgtttt

SEQ ID NO: 14114 - DNA, 1152 bp, Oryza sativa
  unsure (1)..(1152): unsure at all n locations
ggagagccatgatgaccncttgtttgagctgcttggaatttggtgatagcgtcatggtatgctgtttttgacagatccttgttggatccagatatccgatagattgctttgccttcgcagcatccatatattgtatcctataaaagcagcttgttaataataataacatgtttatgtattatatcaattttttgtatgataaatgtgcactcatactcataggcaccatgcaccgagaaagtttacatccatcttttcccgacgattgatggcatgcagatcagcgaaatttagccagaagaaacctttgctggcgacagcatcaggtggtgatcgaattgttaaattagttaggccttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacttttgcatgtgttcgagtgcttcgacttcttaccccttccaagagttcgagcgacacctcgcgcccccccttcgttcccggagaacgtcacccttggtgagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaccttttgcttgtttgggatgacagaggaatttatgacacccgggccatgatggtaaccccttgcccatgcactttgttcaaataaagtctccgtgaacttacccgtggtgatattgggataaaacctgtcattatacaccacatgtccgtgcgcgctctcctttgctggaaaaatgttgctctcccccccaaataaattaaaagccttcctcaatttctggaattataccaccctatagaaaaacccccctttcggcttttctcgggtctttggtacctaacgtccattacttctccccttactcatcttttttttttttttt

SEQ ID NO: 14115 - DNA, 1185 bp, Oryza sativa
  unsure (1)..(1185): unsure at all n locations
cagtccttgtgaccctgtanancnccnnnnnnnnnnngnggnncgatgctttcttaataaactctacatatacaaaataaagatatatcatgtatcataatatattctactgaattggatccgccgctaccgaccgccagcctcttggctgcacgcggagccgatcgcccgcactgatcacctgtcccggccgcttgcggcaccgccgcatgctgtacggcaccgcaagctgcctcaccagctcatcgcttaccaccgccactgctgtagcaacagcacagcgcgagcgagaaaccctaacgaaagaataggaggggagaggggaatggaggttgaaatatctgaccggtcttaaccgaagatctcatcgaaattaagggtaacttttatttccgctaaaagttttcggtttttgggtataccaaccattcacccccctctggttggcttagttcttgtaattcgatcctacaagtggtatcagagccttgttttcttctttggatttttatcgatctagagtttttgccatggctactcccgctaggttttcaactaagccttatgttttcgatggaacggatttttctcattgatgtagtaggatgcaatcttacattatggctgaagattatgatatttggagaaaagtttctcatgcttatgtgattcctgaagctattaatactgctgctgaaaaaactgcttttgaacaaaattgcaaagctcgcaacattcttttgagtggtatttctcgttcggaatatgatcgtgttgctcatcttcaaactgctcatgagatttgggttgctttgagtaattttcttcaaggaacaaataactttaaagagcttcgttgagatctttttaaaagggagatattaaatttgtatgaaccctgcagaagctttgatgacatctttctaggttaataaaaatttagtgaattagactgtggatcttctattgaactaatttccacatctgagattctcgtactttttgatggctcgacaggttttttggagatgaaggtcattttttaggagcggtaacaggtaacttccttgaatactcttacaaacggaaaccatggaggaaggtttttctcaaaggactcaagcgagcttgggctttcttttcctctgagggggcagaaaaccgagccagagaatgttacctccg

SEQ ID NO: 14116 - DNA, 1332 bp, Oryza sativa
  unsure (1)..(1332): unsure at all n locations
tgctaccccctcctaacgtcttcagccatcagtttccttgttgttctctctatttccccccccccccccaagagcttgtgacactgtagaacancccnnctgctggcggaagcagctctggcagaaagacggcgnactacggcaaggcgcgcctttaggttttcttgcgaaggcagaggcggcagacctttgcgaagaagaggacgcggcggctgaagggggtggaggcgatgcccaggatcacctagaggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccgcgccatacaaccctgcaggtgtagtgggttactcacaccttgaccagttcactttgccacgcccctaacgcgtagcttcatcaggatgattcacctttcctatctcaccacctcgcctgctcttctccgccaacactctaacagttgggacttcctctaggggacacgatacggcgcttaacggacctctccctccaaaaactctggtctgcgtggcacagttacttaagtggcccttgctttcagaatgcgcgctactttatccttggcgatcgcgagacccagcctgtaagtaggagttcctctcccaacctaggcacacccgcaccccttctctgctctcnccttgattcaaaagggacattgccatacaccgctctagtctataaactaaacgtgtcctcacaaacctgttactcatatcacgaagctatcctaagccttcacgttacgactcgcgctcttatatgccgatcgcgcaacgcgtaatccact

SEQ ID NO: 14117 - DNA, 2821 bp, Oryza sativa
  unsure (1)..(2821): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcagagagacaagagagcatctttttttcttctgccccttcagtcagcagtgctggcagcatttgggaattgtgtggaactctagtcttaatttctttcaggtggtggtttcggcccgcattcagttcaaccggaagggttttttttggaaattttatttattgctgcttggcacatttggaagcaaaggaatgggaaaatctttcgaaatgagcttccctcattcagttcttggaggcctttattcaaggccgattttcttctgcatatgtgtagaaaaaaggatcccctaaaacacacagtttttgattggttacgaacagtgtaatcattttgtttccttctcggtctctcgtaatttgtaaataacctatttattccttttataaaatcacactgcaaggcaaagtcctggcagtatttctagtaaaaaaacaaatcacccacatattttggaaaacctctattaagtaaattcgtttcattttttgttacacaaaaaatgtttcacctagtgtattcacaatgtttcattacgtatagatctaatttgcagtgaattgaaacattcttttgcaagaaatcacccacatcttatggaaaccctctattaagggaattcgttccattttttttcaccaaaaatgcttcacctagtgtacttataatgtttcactatgtatggattaaatgttgtagtgaactaaaactttttttcactatttgctaaaatattttttttatataaggtgaaactgcgcccgatttaaacgatcgaaacattttcgatctacttagtgaaacaattccgatatacttggtggaacaacgtgcaacatttaaaaataattcaataataagctaatattttttcatcggaatatatacgcgtgtgattttgttttaaagatttaattgcaacgaatttaatggtgcaatcggattatgatttagataaataatttaagaaaaaaaatagtttaaagtagttttacatgcatgacgtgggtatgacatcagcatgactgtgggcgcccgattttcccacccccggatcgggcgcccgatgtgtatttgctttcaaatcttcatctaaatctttcggggccgggaatgatggtgaggaagtcttagacgattgctttcagtagcaacgcaaaagactcataaaagatatagataggattggttcgactgcagaggatccgtttccgttaacagtctactgaatataaccacacgttcgattaacgactagcaagccccattagtcgctcagtcgcacggtactccacaaatattctatcgacaaattgaattggcgagagttctgaatttgtggccaacggacgatgacaagtctaatcggtcaatggtgatagttcagggcgagaaagatgtgttggcgcatgtatatatgtcgacaatgatagttaagggattgagatggtgtttcaacacagaaaataacagaaacgccgtaatgtagtaaaatatccatgacgttggatcggagagcatacttctcgacagcaacacttcgtgtgcacatactgcacacacgtcagccaaaaataaaaggaataagttcattttaggtctcttaatttgtcatcgaatttgcaaccagtgcaaataaaatcccaaggcggttttggacggtggtttcggctgacatggcatctacgtggcacttaagttatgaaaaaccgtgggacccacgtgtcattgagtgcccgatggaaaataaaaaagcagtgggtcccaccttcattgtttttcttccacttctgtcctttatttgctccttctctttcacagcatcggatggacagccacaactcgccacccttctccacgccgaccagccacggggtgggggagaggaggggaccttggtctgacgggagccgccgatgctgggacctcgagagctgacgctagggatccgtcactaagagtgcatttagggtg

SEQ ID NO: 14118 - DNA, 3070 bp, Oryza sativa
  unsure (1)..(3070): unsure at all n locations
aaactaaacccatcgtcgaaagaacagctttcttccccaaaattgatattgcttagtgtgctttcacccaaggccccaaagtcttgtttggttggaagcttcggcccccatgcccacctttattgccaggagtttcgtgaagttgacaatgggcttgnctggcaacaaactnaccatttaaatgggtgtgtcgnccaaagctttgtccgtggggtncgnctgccatccaagtgagctccctagtgattgcaagaaagagatcaatggtcgagcaagaatagtctcttgggcaccgcaagaaaagggtactaggtcaccttcgtgtcggcgcattcatgacgcataatgnatgganctcgacgatagagagtatatctgaaggcgtgcgaatgatatgtagnccatgttttggagatcagatggaaaatgcgaggtatgtttgtgctgtttgaaggttgggtgtgaaaatgaaggtagggaagtgttctgcagagggcaaaagttcaaactgctgttgagaaattagtgaatggggagaaggtcaaaatgtgaaacagagaatgagaaatctgagaatagaagctgaaaaatgtgttagtaaagaaggatcatcagacaccggtctacgtaacttagtagattcgatattatcttttggaaaatgttgattatctgcacagatataacgtagtcatgtcttcgactaatacttgtagcctctttaaatgcggatggtattgagaagatcattaaatgttgtaatatctagttttcatctactactaataaccaggttcaaaaattgccgaatagaatttccaaaatttcagaccgcatcaaaataggaagctgtttcgcctgtttttctttcgaatttcgcaaaattagttcaaatatgacctaattttgtgcaaattctaaattattttggaccgttatattccaaaatatccaagattatttcggtcacatcggttgcccccggtggaaatagccaaactgatatattacattctgctataccagaaaaaaatgaaaatatatttgttgtgaatttgcataaatatacaaaatttgaaaaaaaatatatacagaaattacctgatttgcctggcagcaggatgtacaaaaataatctttaatatgtgaaaattactaaataatctttaatatgttttttcaacaatcaagtaaggaataaacatgatattagcatcaaatgaaactgtttgtcaaaacatttttgttgaaagatgaatttaatagactctttagaagattgcagattaaatattatattgttgaccaagatttgcttcgcaagaagtgaaagatgggaaacaaatgaaaagtagggtttttcatgaaacaaactaaacaatattccactaacacggaatatatggatagatatatgctaagtattataaaaataatagatagatatgtttaaataatgtgagaggagatgattggatatgtttacatgttgatttgtataattcaataaattatagataatatttaattcttgcataagtaattatttctacttgcatgttgagctttagattgagtatgttgtatttttataatttatttaggtatattcataaaacattgcgtgaaaaatagtatattttagtgtgcgctagaaatgttactatctaaacaatattgtgttggtctaaaatgtccaattaataggcctagcagctcgggcagacatgattgggccagagagagcccagtctgctgtaaagaagcgaccaggcccagctgcagggagcaagtgcttcggaaggaaaaactccatcttgactccctcaagtatcttaatagtaaaaatcgagtacattgactcactcaactattaattaatactaagcattttaccgagctcattggtttgcgaggtggttttggctgacctggcagcctaagcatttaaaaattaaaaaatagatgtggggcgcacatgtaagtgacagaaaaaagaaaatctatagccacaagtccgacatgaagaacttgagatagaagcttgcccaagcgggggttgccggcaagccctcttgactccgaatccaacaccatgccattgatgatggacaacggcggtggggtgccgcatcaggatggggagttcttcgagctagtcgagtcgatgattccgctcgaagggaacagtgcaaagcgccgttgttgctttggcagaggcaacagttcatcaacgggttgatcgatattcacgatcctggcagtcgacgtacgacagaacatattttggaaaccctctattaatgaaattagtttcatttttagttccaccaaatatgattcacctagtgtactcacaatgttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcgcgacgtatgatgccgaaaaagttgtctggacttactcggcgagcattttgcgattgaagtagggcatgatgaacgctttttggcaataagcaaactgcttttatacggaagagtagcttgattatcaacccattatgttaataataaaccggttcccttgttcttggccaactaaagcctggcctgaaaggcaatgacaccactgtatgaacactaaccttttggtttttagagaacggccacgggaacggtcaattggcaaaaacgacaagccgtccatccggtttacattaattcatgccggcccacgttttttctttaaataaaaaaggggccacctgttgggtcctttaagtttacccacaccccca

SEQ ID NO: 14119 - DNA, 1196 bp, Oryza sativa
  unsure (1)..(1196): unsure at all n locations
cgtaccaagggcacactttcctgggttttggtgtttacccaagggggaatctgggggaaagaataattaggtaagccgggccagttccaagacataaccgttaggcccttccgatgagcagagccaattttctaaagagcaanatncncaggttaccttggttcgcaacaaggttcttggctctgccagcngaccaaaagttgtgnccacgtaaaggaagtttgaaccatatctaaatgaaacaagtggtaaggtgttaccnctcttctagtttacggnnaaaggttgtccgttgnaagagaatgagaagtgaatgcggggcatgagagcccggaaaaggcaaaggggagggtagggaggatgttaccgcccctttataggtcagagaaggaaggggaacttctagggggagctcggctggtcatcaatggtggcagtttggccagagttaaaagattaggcagattgagacaattaatgcaccaattgaaggggaattcggtgggcattgatgcccatcaaagatgaaacctatttttgcagttcataagaagacgaaacgcatgtggagacatatctagagggtcggcaatgtttgggtttgtgggtcaaggagaggagcggtcggctgaaggtggaataaaaaaaaaagtacttcctcagtttcatattataagactttctagcattgcccacattcatatagatgttaatgaatctaaacacacacgtgaatgtgggcaatgctagaaagtcttataatatgaaacggagggagtagtaagaattttagttacttcaaaattgtgtttatttttctttttctattttcaaaatttattttatttttattttgagttctaattaatctcgtattatgttatacatggactattttttcaatattacttatctttattctgaattttaaccttcaagtctagctatttgatgtatggggcatcgacttcatgggacctttcccaaagtcctatgactgcgagtatatcctagtggccgttgatgatgtgtccaagtgggtagaggcaatgccatgcaggaccgcagacgctaagcacgctcgccggatgtaaaacgagactattttccctcgttttggaactccgtatatggtgataagtgacggagggtctcatttcncgnntngcnnantggannatgaaatcaaaancaat

SEQ ID NO: 14120 - DNA, 1199 bp, Oryza sativa
  unsure (1)..(1199): unsure at all n locations
cgatgtcanggtgaagcgcctgttggtggcgnnnnnnnnnnnnnnnnnnnnnnnnnnnnnnnnnnnnnnnnnnnnnnnnnnnnnnnnnnntgaaaattttggatttttggagaagcatggtgaatttttgaagagttgttgagaagagcatgtttttggttcaattgggaatttctttcttttaaaaaggggaagaagttttcttttggattttttagcacgatgtgtacatttgtacgaagtgtgctttttatttttccaaacaccaaaacatttttatgagtttgccaatgtgttcatcaagggggagattgtaaaattaaagatgtttttgattattattctgtgatgaacaattgggcattggagattattggttttgttatttggaatttattcacgaagtggttttgggttcttcgtgctagtcgagtcgatgattccgctcgaagggaacagtgcagtcccgaagagagggggaaggggaaacgggccggcccaaggaaggaatctaattaaggtaattcaaccagataaggcacctagccctgatgggattaatgggtattttcttaagaaatgttggcccatcatatcacacgaaattttactgggtagcagcacactttnnnnnnnnnnnnnnnnnnnnnnnnnnnnnnnnnnnnnnnnnnnnnnnnnnnnnnnnnnnnnnnnnnnnnnnnnnttgggttttctatagtgtccacctaaaataggttggccgtaatcaatggcaattagctgtttcctcgtgtgaaattgtttttccccttcacaaatttcccacctacattccaagccccgaggccataaagtgttaaagcctggggttgccttaacgagcgggcctaactccccattaatttgcgcttgcgctccactgtcccgttttccagatccgcaaaaccggtcccggccacgctgctttaatagaaattgccccacccccccgcgtggaggcgcgtttttcttatgggccccttttctcgcttcccttcttcacttaccttcttgaccttcggctctcggctttcgctcgacggctttatgacttccttcaaggggcgtgtacgcgttattctccataaatataggggttaccaccggggacaaaactcttttcgtcataaatgccccctcactgggcccccctccctcttaaatgccctctcttctttcct

SEQ ID NO: 14121 - DNA, 1605 bp, Oryza sativa
  unsure (1)..(1605): unsure at all n locations
tttttccccaattaggaaccggcaccgtgaccataggtgggtcatcgtggccacttttattcccaaaatgccccgcgtgttatgttcccggaacttttatctcacaccaagggtcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaaaaaaaaagagattagtactgacatatgggtcccatgagtgccacataggataaaaccgctatccaaacagtcgagggattcgatttgctccggtttttgaagatggaggaggccttacatctggtattgcagttgagggatactaatcaatcagaggcaagacttgagggaggcaaaatagaattattccaaaaagaatatacctccgtttcacaatgcaagtcattctaacattttccacatttatattgatgttaataaatctagatagatattaattaacattaatatgaatgtggaaatgctaaattgacttacattgtgaaacgaaggaagtagatatgattggttcgactgcagaggatccgtttccgttaacagtctactgaatatatccacatgttcgattaacgacaagcaaggcccattagtcgatcagtcgcacaccacaaatattctagggctgcttggttggcggttggaatgccacgccatggcgtaaaatgtgaaacagagaatgagaaatctgaggatagaagctgaaaaatgtgttagtaaaggaggatcatcagacaccggtctacgtaactatgataccccgcgtattcccggagnnnnnnnnnnnnnnnnnnnnnnnnnnnnnnnnnnnnnnnnatatttcttaaatggtgccttcccctctgcacgaattgtgtgttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttattaatgattncttcctcggncgttggttgggaagcggtttaattcattaaggggtaatttggtttccaaaattggggtacacgcgaaatacttggaccca

SEQ ID NO: 14122 - DNA, 1829 bp, Oryza sativa
  unsure (1)..(1829): unsure at all n locations
gaaaagtagagcaagagaagaaaagaagggtgtatgagccggtaagaaaataaggtatagggagaggtaccccacaagccggtgtgattatggccagaaaaggggtgacactttcactaaggagaataatttatatcccagaaccacagattaagggcgctgtaacgtacattttaagagggagaaaaaacactatctttcccgataaaaggagcgggcacgtgtccataagggtggtgaaaaagggacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctggaagctataactgttgccttaaattaagtaaaaccattcttgatccatgttcacaccactagggtgttgtttccggtcactattttccacataactttcaaggttatagagttctaataatccatatatgatatcactctcaaatattccatccatcttttcatcgtcttggggtacccctaacactgcacctttattgggagaactttaattggttttcaatttaatttaattgatttaatgaactttgttttatttaaaattacttcttgagctccaaaaattcaagagaaatttcagagaatatttagggcacaaaggatattgcaaaaatattttcggccatgattttaaaaggaaattttaattccctcattaatttacttgataaaattaacttttacataatttctagatatgcgctatttaataatttttgatcccgaacgaaaattagggtgtgacaaagagagaccaagaaagatgggaacggtggggagtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggattataaatacaaggcgttcttctggaaactctttnggcgtcttggtcaacctgccgttaccgaaa

SEQ ID NO: 14123 - DNA, 1757 bp, Oryza sativa
  unsure (1)..(1757): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcctctacccatgcgacgttgcagtgactcttcctgctcaaggcgtctgcaaccacattagccttgccgggattttagtgtattaccatatcataatctttgattagctccaaccatcttcgttgtcagagattcagatcaggttgggtgaagatgtactttagacttttgtgatctgtatatacctcacaacggttaccgatgagatagtgccgccagatctttaaagcatgaacaactgcggccaattccatatcgtgggtcgggtagttgccttcatgaggacgcaactgccgtgaagcataagaaaccactttgccatcttgcatcaacacacatcctagcccctggcgagatgcatcacaataaacctggaaatctttcgtctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccctgaaccttataaggccggctcttgcgtttatcatagctcgccccctgtgcagctttacaaaaatgcgcttcaataaaaggggcgaaaccttcgggctttagaaacccttgttttccctgagagtctttggcctctctgttcgcacctgcctttccgtaacgtgccgctttttcttc

SEQ ID NO: 14124 - DNA, 1239 bp, Oryza sativa
  unsure (1)..(1239): unsure at all n locations
tccatcgctctgcccgccactctaccctattatctgtgaagtcacacntctcctctcatctcacctttnnatacttcccctaactantganccttctangactnnnncnccccncncccccagcagcnattgatgccatctgatancacnccngnnnaaannngaaataaggaaaacaattggaatacattaagtgtgtggaggattaccggcaatatgtatgtactagcagcttctgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcaaaagggcccccccctggaacgggccaaataaacccccgcgggtgtggtgggtaacccccaaagaggaaccgctacactggcccacccccttaaccccggctccttacgtttctttccttctcctttagcgcaaaggtccccgggctttacccggaagactctaaaaggggggcccccctaaggggccccaaatagagggttaagggacacctggcccccaaaaaatggattgggggaagggtcaccgaaggggccaccccccggaaaaaaggttttccccccttccactggggaccccctctcttaaaagggccctttgggccaaacgggaacaaaactaaagcctaatgggggaaatttgtggataaagagggaattggccaattcgccccaggggaaaaaaagacgttttaacaaaaattcaccaaactccaaaaacc

SEQ ID NO: 14125 - DNA, 1835 bp, Oryza sativa
  unsure (1)..(1835): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaccactggcgtggtgacacacgcgggaggcggcggaaaaaggggaaagggagaggagatggaggggttcctcaccgaggggcgccggcggagctctggcgaagggaggtggcgttgcttcggcgacgggcggcgcttaggaagaaacggacgagggtggccgcgacctgcggaaggggaatgagggattaaggaggggaggaccggagcggtgcagctaaaacaatggccggtagcgacagtactaggtggagctcaccttgagtgatagggatggggtttcggcgatgattcacggaggatgagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccttaatttaagggtggaacccccacggtttaagaaatcaggggttcccccggagattctcttgggtctttggttgaactgcggttaacgggaacgttcggcttttccttttggaaagggggggtctaaaaataccctggggatattacatgggaggcggtccttcaaaaagggttgtgtcaaaacccctttaaccaaccctttgcttt

SEQ ID NO: 14126 - DNA, 1836 bp, Oryza sativa
  unsure (1)..(1836): unsure at all n locations
agccgcggaattctgccaataaagaaaaggtaaaaaccttaaaggagccggcgttttgaggccctggccaattgaaccggtccccttgtgggtgaaaccaccaatatccgcgagggtttaattgcgcccgttcaaggggggtgttcatttcgccattcgaggcctgacctttatatttcccccaagacactcaggtttaaaggccgtttttaatgtcaattttccccggtggtctaaaatcaaacctatttcttcccccgaataccgaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagataaacttttcttccttcttcaatagttgtgtcattggcttggcaattttagagaagttctcaatgaaccgacggtaatagcccgcaagtcctaagaaactccgaaccagagtgactgtccttggtggggtccacttggtaaccgactccacatttgctggatccaccgctactccttgagcattcacgatgtgaccgagaaactgaacttccttaagccagaagtcgcacttgctgaacttggcatatagctggtgctcttttaacttttcaagtaccagccggagatgctgctcatgttcttcctcggacttagagtagataagtatgtcatcgatgaaaaccacgacaaacttgtccagaaattccataaacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaggcttcaacaaaatgtgctcaattaagggggggaaacccgccggccttaaagaacccggggttcccctggagattctttggcgcttctttttacaccctgcgcttacggataccggccccttttttctttggaagagtgggctttttaaatccaccctggnggttacaatggggcg

SEQ ID NO: 14127 - DNA, 4355 bp, Oryza sativa
  unsure (1)..(4355): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcgcttttcgtgactcgcnaggtgcgagagtggggcagcttgcaagagccacgtggctggacggaaaggtaacttcccttcacttcgcatacccccgggcccatatctccgacaatcatcgatagagctctcaagcgtgcagagggcactataagaggagcatatatgcatatgattaaaaacagagggcactcgatcttcacatgaatgtagaaaatgcttattttgtgtacgacagtcgatacataaatatatattatcaataataccaagggaagaaagtatatatagatgcctcaagacgtactatatactctatatacgtactgcatgagagaagtacaatatatataatatattacgccaaattaacattatattgggaacaaactcatctaaacaagtataaggacagacgtccatgcgtatataattaacaaccctcgattttcacaatgatctggagcaaatatgtgatacatatatatatatatatatatatatatatatatatatcccttcttcagtcgcagcacagctcgcagagccagcagcaacagagcgcagcaatgctgaaaaaattaagaacaaacgcatataaatcagaatcattcaataagaaacatcagtaattanatagccactagccaagtgacatatatacgcacttgaagatgggaaaatttttttaaaaaaaaccctatagccaggatgagaagaaacagagattaattaactcagaattaatgcatggcatcaaatataatgttctgattatctaaaaaatatatatataatgttctggagtagtggagtatactgtatatatacgtaccatccttcaataaagctcgtctccgacgtttagttgaacggcggcaagatgatccacagcagcgtcccttcttcttccctgcctgctgctccgaatccaacctcgggtaacctacaaacacacatgattcgaagtactctagttcaagcgagttaagcacaaattaatcggacagctagtttagatttcagagatggacgaacaattaaaagtttaaacgataaagagagagatgggttaactagcttgtggtatttgtcatacaaatgtatacacggaggttaattaattgaagattaattagaaagcgagcaattaatagatatcaatggtcacctggaggaggctgcagctggctgttcttgttgttctccatcgagatcagagaattgctgttactacgtatactttgtgctagcttctaattagcttattgcatgagctgcagctaagctagcgatagcttcaagttgtttcggttgcttggtgttggtgtgtgttattgagatcgacccctccatgtgtttatatatatatataacatcgacgcacacgcgcactacgatcaccagaacaaactaattaacaaagcagatatgcttttctgtttctgaattacttgccatttaacttttcagatggttgctggatttgaagtccaaaggctagcagaaggctgacaaagtgacaatgccttcgaaaggggaaaagaagaagatgaccctgcgactataatgttgtaacgtaagagttcgtcagctatatagtgctattttgttgacaagttggagagagaatccttgtttgaaaataaattaaactagcagaattttgcgaagttattcgctagttaagtaccagtgctaacttattactgaaaatcctcttgtaagagctagtaaatctagtagatgaatccaaaattaatattttctcaatccaatgtacgttatcagtgcagtacgaggcagatatttttccttcaattaacatgcaggtaataaactttagcccttgggtttgtaattcaaacaaaaagtttggagacttcctttatatctctgtatttaatactatcttagtagtcgttctagacatatctaacatgggaaacaataacatttgataattattttttaatactgtgtattccttaaagttattaaaaatataatggcataaaaatggtttttgatcccctaccattttattttccttcatataactttgtctttaataaaaattttactcctgcatttaaattgtccttaatattgcatgcatcattgtattgtttctacaacaaacaaaatgatatttttcacaatgcaaatattaacacttgcattaattataaatcactgactatttgaaaacagaggattctcctatccaaacttttatgaacactaatttattctattttgtacactaaagcacatactgttagaatcattttgaattttattttaatgcagtggtgcagaatcacatgtttttataaattctgaaggaaaaaaattagtggttaaattttgtgtgtttattcaatattatttactgtcgattactaaaaaaacagaggtagctagtagatcaatatatagcctgctagctagctacttcgtccgtttcgtattataagtcgtttgatttatgttcttaatcaaacatctttaagttttaccaaatttgtagaaaaatataataatctttcaatacaaaacaaacatattatcaaaatatattcaatgttgaatttaataaaactaatttggtgttatagatgttactaatttattttataaatttagtcaaacatagcgaactttaactaggaaaaaggttaaacgatttataatatgaaacagaggagaggagtaagaggagtaatggtcttcggacttgctttagttttgacaatgtacatgtagacgaaagctagaatcatcaggtcgaacgtctaattaatattcgggaatatgtttaattctgttcggaacaaacgctcatgaagcctctcgacagtgtggcgtcgctggccggggcatctggcatctcccagcggtgaaggaaggaaagcacgcgctgcacgtatttgcagatgctcgatcgatcgatcgatctgtactgcatgtgcacacgcatgcaatatgaatgtacaaattcagcaaatgaccggttaattcattcacggtcgcattggatggatacacatacgaatcaagctagcttttggctcgccgccgaaagctacaatatacagccatgttgtcccctctgacctgtgctgtgtgtacgtacgtgcacccagctgctagctagctgcgtacgttgcttgctttggaacaaggaatcgattctatcccctctctggtgattcctctctctctctctctgacgagacgtgtttgcatcaggtcggtttcgacgacattatatatgcatccttttctctcgtacgtacgtcgatctgcaatgtcgatcgatcgatcgatcgatatctcgcgggcacatgaaagcatcgaatgattccaaatgtttttgcattgtggtctacttctacgtgaaagaaacttgctacacactttgttaacgctttaattttcctcgagatctgcttgtataaaagtcgacgatgatctgatgtcatttggccagctgatatactctcttcgtttcaaaatgtttgacaccattaatattttagtacatgtttgaccgttcgtcttattttaaaaaaatttgtgaaatatgtaaaactatatgtgtacatgaaagtatatttaacaatgaatcaaatgatatgaaaggaataaataattacttaaattttttaaataagatgaatggtcaaatacgtgctaaaaagtcaacgatgtcaaatattttgaaacgaagggagtatattgttggggactggctggtggttaggtattagtttgcacgtggatataatctccggataattccacgcaccgacaagagaaaaattaatccatcaagtcctactataaaacacatgcacggttaggttctatacgtggtgtaaccgcgcgcgccttgctcgatcatttggtttcaattgatcttagactgggccatataattaagttcaggccttcaatctgtttagacgtacgtatgcgtctattttgatttggattaagcgtagttctcaactacttagattttcttgtgataaaacttatctatccatattcaagtcctagattcaacgtaagtgcttgtacttatggctaattattttttcgatgatagctagacaacatacccgttaataataaggcatatgtagtgactttgttaatctcgagatgtgacgaccctatttccttggatgtcctcatgagtcatagcgtttccaaagggcccatctc

SEQ ID NO: 14128 - DNA, 705 bp, Oryza sativa
  unsure (1)..(705): unsure at all n locations
tgtgctnnngnatcgtcggccgncgtgtgatggatacagtatcagtgcttcttttcccgatcaaaaccaggagatcaagaacgaaacataacaataaagcggaggtaggcctaatgcggaccatggattaatttgtttaggtagatcatggatgtggctcatagaaaagaattcagaatctctggatctccagatattgtttctccagactggcaccaaaggtccaaaggcatggatgaccgggcatgcgaacagcgcgtgacaggagacgatcgaggatgcttcatgatagatcaacgttgtcacctaggaatcaacgacacagcacagcttgattatggtgggtcgccgccgtcgtcgcagaccatatgcagccaggtcgatggatcgacgcccaggaagtgccgcgatggacgatggcaccaggtccagaagcaagatcgacgcatcaaaaaccaaaatgtttgcaagtcgtttttgggaatgaatgctctgctgctatggagactttaacagggaaacaaaagggaaactcttcatctgcaataaaagcatataaaattggaaggattaaaccgtcgccgggtagatccgatggatcaacaccgtcacctggtaatcacggtagcaatggcctgttgattggtcgaccacctctcaaaccttgcgatggatttacttggaagaaaacggcgccagggccag

SEQ ID NO: 14129 - DNA, 2606 bp, Oryza sativa
  unsure (1)..(2606): unsure at all n locations
agctgtatgcacccnctngcnacnnncnnngnngntttataataatgtcgatgcaagttgttttgaatcagtccaagaccatacatctgaaattctgaatcgaatcgttcccacaattaactgagataatggcactaaaacatacagaaaattttaggatgcatgcacttagctagtcgatatgatatcaacagctgttagccactcggtacagcaccctgtcaagcttgcattcaagctagatgaatgaatccatttgctaattttcccatccggaacagtgattacggaaaacggagtgatccatctggaacagtgattacggaaaacggaacgatctattagcgcatgattaattaaatatttgctatttttttcaaaaatggattaatttgatttttctaagcaactttcgtatataaacttttttaaaaaatacactatttagtagtttgaaaagcgtgcgcgcgaaaaacgagaaagaaggggtgggaagaggggcatccgaacacaccgttcacagcaccctagcaagatattgaaatgcacaagttgttacattattatcgttacatttatgtgtgccatactgtcattttctattgacattgtgccaatgaaagagggaatttcctggacatgtgcgtattactgctaaagagatatttggtgaagcgagttctgttatgattgggtttatgcaacaatgcagcgaatgctcattgtactttcactggatttattgtgataatctataaagtaatagaaaaagtagtctccacgtccgctctcacggtctagaaaatcccacgttaattaaaataaaataagaaaaaaagaaaaatagaagggtattaggattaggttttgtgtaaacggaaaaaaaacaagagtaaacggacaaaaaaaaagttggaaacgaaaaaaaaaatccaatcggacaagaaagataaaaagtgaaaacggacaaaaaaaaaacaagaaattccaatattaatctctacttccgttgtccgtgtaaagaaaagggcgaaaaaaaagtctgagcgacaaggaaaaaggaaacaccatccggaaaagaaaccggtggaaaaaaagccggctgtaaaagaaactaaaaaggtggaaaacaatccgatctggatgcaaccgaaaaaaaaaacaaacgccgtaaaaaaaagccaaaataaacgaaaaaaatccgatctctactcaaaacgaaaaacggaaaaaaaggaaacgccacagtaaaaaaagagaaaaattcccatggaaaaaacggtgaaaaaaaacgccgtctgtaaagaaaataaaaaaagtcggatctggatgaaaaaaaaaggaaaaaaaacaccgtccaaaaaagccaaaagaaaaggaaaaaaatatctgatctctatgtccctaatacctactattataaaaattaaatatatttttaccggtattttggtacgtcatctgtgtttaaatcggttttaattttatgtttccattttaatctatatctctacttaaaataagaaatttctgtcgtatgtagaaaagaaagaaaaaaaagtccgacacaaaaaggtaaaataaaaaataaaaagtccgactcaacgagcgataaaaaaaaagcttctgatgtaagtaaaaaaaagcatctcatcgtaaaaaaacgtccgactcaaaaaagtaaaaaaagaaataaaaagtccgactcaacaagcgataaaaaaaaagcttctgttgtaagtaaaaaaaacatctcatcgtaaaaaaatattgtccgactcccgtagaaaaaggaaaaaaagtctcccagtaaaaaaaaagtccgcttgtatttttagcacagggtatttttttttccgatttttgttgcacgcgaaagagttttgtatgctcacacgcaagtcttttggttttttttccggcctttttaagccgatctattcaccgcgcgcctcccgggcgcctttggttttttttgtcaatttttttcaccagttttttctaccgtgcgctttttgtttttctcatctggttttttaatccgatctgttcgccgcacgccttccgacttgaatctagcactccgtgtcaccgccatattgattgtacgttttctcctccaatttgattgaaaaatcgattccccattcctctctcatctttttctccatgattttcctttcgattcggctttaatttgaaaaagcgaaaaatagaagggtattaggattaggtttttgggtaaaccggaaaaaaaaacaaaaatggggtgtggttttaaatggacaaaaaaaagtgggaaatggaaaaaaaatttgggaaccgcccaacaaagttaaaaaaaagtgaacaccggccaaaaagagaaaaattccattttcatatcagtaaaaaaaaccgtgtggtcattataagacccacaattataaccattgttaatattataacaggggggcgttgtatatatttaaaaaatattgggggaaaaccaccacacaaaatttttcggacactatgttggggacaaataaaggtgggacaaaagacaacacaaatcctcctctttttgtctattatatatggcgcacacatatctttctctacct

SEQ ID NO: 14130 - DNA, 1472 bp, Oryza sativa
  unsure (1)..(1472): unsure at all n locations
tgggcccaaggaagggttggggaaggttggttttaaccaatggaggggaagggttgtagaatagttattctagggaaggggtgtaaaatagatccactatctatatatatatgtatatatgtatgtatatatggacatatatatgtatgtatatatatgtataaagaaagtagttcaagtgtaggagtagttacgttgtcgttacattgtaaatatacaactatgctatagtacatttgacactttttagcaattctgaagaaaaatggtaaaataaagactttggctctaatgctgacgtgttgtacggtcctaattgggtcagaaacgagaaattgcgtgtgcgagagagagagggggaggaccaaaggaaggctcatcgactgcgagagagagagagagagagtggggggaggaccaaaggaaggctcatcgactgcggatgcgccggatagagtaggcttcctcagctgtcagctccgagaatctctagtgccagcgggcggccatcgcagcaaagaatatggctgccggagcggccgccggccgccagccatattggagggtggagacgtggaggcgaccgatattacgggagcacaatctccgtaactgctatcccaggccgttggattggagaagatgggcaggatctggcccggcgcacttatccttaaccattgaggattcgaggttgtgttatttaccatggtctttttttttttttttaagatatgatcccgtttcttgtttggttagagatgagaatggataaaataaaaacaataacatacaagtacgtattaaccccacaaaaaaaagtatgtccttttcaacgaaacaaattatcaatagagttgttttcaagtatagctgtgagcctgtgaccagtgatcacccaaccacagcacttcaaagttcaaaccgaaatctacgcattcgtaagccaacaggaggttgtcttcattcctcgccttttggagctagcaggaaaactcctaggcatttctcgtatctatcatctcctggatatgctaatgatatacatctgtgaatatatataacacattaacaaaaaatattggatgtgtatcgccaatttctctgccatatagtcttagctaagtatttagtcggaatcctggagtggtgcttgcattaagaagtggtatgggcgtatggccagtccggcctaacgtggtggcacacggctcgcgcggtgcccccaactggcggcggcggatgccgtcattgccatggcagaggctagcactcgacggaggcggcggcccgctcggccaactccccccgcgaagtgcgactccaaattcctcggcctcttcctcccccttccgcggtggcgaccacaaggacggcaagggacgcgcaccgctcctccccctctctccctgcaccatcacaagctttgacgacgattttatccatgcnatatcggagtgcaatcaaggcca

SEQ ID NO: 14131 - DNA, 1120 bp, Oryza sativa
  unsure (1)..(1120): unsure at all n locations
cgggagtagtattttataagataggctcacccggtattctacgccctctaggattaaatgttgagttgaacagcctttaatttactctgtttaagagagaggggctggtcttgacaacaatgagatataggggccacaaaaacatacacattaccacggaaagaaaatattgccgggggtgtaacgctaaaggagggcctacaagggggtcccttaataacagcccctttttaccatctcttacgcgggccggtagagttccttccctaagagaaacctcccttgggtccattttgaagggcgagaaacgggggggtcacaaaaccaatgctcctggtgggaggtcaacaggccatggaacatcccccaggaaagaaccaccttgtcccaaagcaacaatgcctttgtgataagatttatgtttaaaaggcttctgaggacttcatttttgccgcagatttgatccaagtctgtattcatgtcagttctgctctcaaattgcaacaaacattaaagtatgggaccaaatctatagatgtgcaccaatcaaatgctcaatctagcaacaccagcacattgtaatgttcagtgtttactgtcgaagcagcatcaacacaagtgacattcttttgctatactgaagtttcaatccatttagacgtactgatttgaaaacgaaaaattgatgcaactacaatcttcacattcagtgttgagttacaatcccaattcacatcaatttacaacatccatttatatcaatttacggtctcgatctaggtgtacactgccggcagcaagcattcagtgatgcaattacaatcttcacattcagtgttgacgtacactgccggcagcgagccagcaacatgttcaaggagcagctcctcgactactcccgtcaccgccctcgtctccattgtcagcgctcgcgtgcaaggtgtagctaggggtgggcatatttagaccgaaccgaagaaccgaaccgaaaagaccgagaccgagaccaaaaagaccgagaccgagaaattcggttatctgttcggtccctgccctcaaaataccgaatttatttcggtctgtcggngcnanngnnntnganggtccacaggttcatcca

SEQ ID NO: 14132 - DNA, 4146 bp, Oryza sativa
  unsure (1)..(4146): unsure at all n locations
cagcgccgatagcacnctacgtagcaccncaccggttatagtatatatctgcaattgacaacctcccggaattgaaggagcttgagttagaaggcaaatgttgtttctcttcaagtgtggagagatatcaatgcacataacaagaaacttatacacaagagaacacaggttcaggatgaaccaaaaggaggaccgacactagctaacaagaaaaagtctgcattcttctccatctttccgtccactcatcgctgattcccggtactgctaacttgtgtgtgtgcaagctccatcgtaaatatgtgtgcttcgcgccatgattctcttgttcttgcttgtgttctgttgtgtaagtgtgtgtgtgtttccttcatttgttccgcgcggagcggtatgccgtatgcttacaaaattactgcaagcttgctcctgtgccgagtcggatgtgattgtgttgtgcttggctcttgttcaggatgccctgcatgcatgtctgaatgcatgcgagtgtccatgtctcgagtgagtgccgctttgtgtgtgcgggcatatatggctgtgcccatgcgtttttcctttgaatttggatgtgtgatgtgtgtttatggttccatgaaataagtgacaccttgcacgtcaatgtaacagttgtgttgtgtgaatgtggatttataatactctagtagatgatatcccgcacgttgctacgggaatttgtgagaaataattacaggagaagatgcttacaatggaccaatatataagagtttacatggatattgtttcttcaatcatgtggcagtgatgagagaacacaaaactaaaccggaaaacaatagcagctgagttcgtgaaatcttcttgtgaagcgaaaaaaaaaaaagagagaccagtttctcgaaaaacaaaaacacggttgcaccaccacgatactgaagttctactccgatattcctgaccagccaaataaagttacgcaagttacacatcttttatgtttgcatacgtgcgctcactgcgcatgtcttagacatctcaatcagcagtggttgaacaaaattatgaataacaacaaaacactacttaatcatttggtttcacagtaaaccaaatcacctgcacataagaatggaagcacaacttacctacttgtgaaatctgcgttcgttgttcctagttgggaactaatgtgcggtgcacgcagaatggagcgacttattagcgcataattaattacatattaactttttttgaaaaatggattaatatgaattttaaagaatggctcaaagaggagggaggcaatatagacttattacaggcatataaggcgcgtcctaaagaggagggagcaaaatagacttattccaaccatatgtaagacacggcccaaataggagggaggtataatagacttattccaagaataagcatgatgtgctgatcgtgccatcgggtcggcccgacgcggcccgactcttattgggtcatgcctggaccgctgtgcctcgctgtgcccgggccaagccgagctgggtggcccatttggccatatatacaagcaggcgcctgaagcttctttaaacatttaactaactatttgtcactctcagcaagtttggcatttaaatatttatcacccatatattaataacatgtgaatatttatgtgtttatgacatgtgggtttaggtggtaaaccgttaattgtcacatctaagagtgagaaatagttaaatattcccattttcgatggtttggaaaggatttgagtagtttataggcattgnatgcctgagagcggtaacactgagtttaattttttgcgtgaagcgaggacgagagcacattatgtttatctattgaacaatagttaggagatatctacagttgcaggaaggtattatatataatcacgggagagtatttacaatcgttgataataaattagcagttgcgatgaaactcctgcatttattactttggactagaaaaatacccctgtgttgcaacgggtactcataattagtttttagctacagactagtctgctacctctcttcgctcgacctgcctcttttcgctccagctcacacaaccgattgccatcttcaaccttcaaaagacaatcatgtgtccatacgataccggagccgatcctccccatcgattctggtgaattaaagacaaattaaaaggggaaatcattctggtgaattaaagacaaattaaaaggggaaatcatgaataaaatgatgagaaagtagtggagaatcgatttttgtaatcaattggagaaggaaacgcatgggaaggctgatcgacgtggcgatgacgctatggttttccttgacgatggaaaaaaaaccagattttttttaaaaaataaatccttaccggtgacgtacatccttccgcgtgcgaaaaaaccatgacgtagaaaaatggcgacgaaaaaaaccgcataggaaaaacccagaaaaagaaaaaaaaagtggacgaaaaaaaagggagaaaacaacgaaaaagaatatcaattaacatgctcgtgggttgcaatggaaaaaaatgcagtaaacatcggatttgtagggttcaagtttcgtcatgataaaatcatgtgtttctcgaatactccagcatggatgcacgcacctatcaattattgtgttctctcctactcctgtgcagacaacggacaaagcggatagtatgagaaagcgggatgacgcacaacgacgtaataaaggtcgacacatgtaaattttctagaatacttgtgtattgtgtatttttaagtaagtaggtgtattttagaccggtacgtgtagaattaaatctaaatatggtaagtgtttttattaaattctttatgattaaccacactctctagatttgttttttgaatttttcaaaactcaattgctaattttaataattaatttaaaaaaacaaactgaaatccctctcctaagtatgggccaaatctggcccattcttccttcctcctcccccgagccagcccgcttcctttcctccctcttgggtcgccatccctctatccgcttaggcccagcagctgccccgcttcctctgctccctcttgggccttcatctctatgtccgctcaggcccagcagccgcaccagcccatgaaaaaagtggacgggaataaaaccgagaaaaatggagaaaaaaagaaaaagagaggtgaaaaaaaaaagaaatcggcggaaaaaaatacactaacggacgaaaataaaaccggaagccttatgtattttttaattaggtatatagatatagatatagatatgtatctgtggtcatttacggatggaacttagtgaaagtagaaaatttagtactccctctgtttgataatgtaagtcattctagtatttcccacattctagatgttagtgaatctaggcatacatctatatgaatgtgggaaatgcgagaatgacttacattataaaacggatggagtaaatctaaaccatgcactgaacaacttcacaattcctcaagcaagatattgaagccagaaaaaaaaaatcgaaaattgcaggtttctcttaagagaagcggaatcgaagaagttgagccagaagaatacaccatcgaatttcttcaaatattttttcgtccataaaactaggcataggttgcagagtcagaaattttttgataaagattaaagaatatactcagattagttcgtaaaactaggtctaggtttgcaacagcctattacaaagtcgccatattgaaaatgtgacagccgccccactttgcacacatttattcccggcaaatgcaatatgcattttttggtgtgactggagtctatgctttcttggacggtttgttatctaaaactaaaaggtttggccaaccctactgaattagcgtctaccaaatgaactgccgaaagaagaaaaataccctctgctaagctgcaaaccaagcaacagctacctcagatatgtagccctacatcatggagctatcagataaccaattgtcaccaccttttctacaaagatgccaactcttcttcagatatttccaactcacactgccgaaatgagaagaagcctctnccngngcctctncaatgggctgatcttagntaagccg

SEQ ID NO: 14133 - DNA, 2259 bp, Oryza sativa
  unsure (1)..(2259): unsure at all n locations
ggatctctgaatttcggattgcgatctggtggatcgatgcggcagtagaggcgcggggtgttttattatataggaagtcgggggaacgcgtggagggaggcgtttccgttaagaattcggcgggttgggggggggggggggggacgggacggttacacgtgggcggtgaggggggaggctgacaggtggggcccacctgggatggctggactggtggtggtggccagcgcgcgcgcgcagtttggttcgacggtttttgcgcgtcgttttgtcgctggctcggctcgtttccgctgtttctggaagccgatacggatagagctgccagggagggaagacgcgacgaacggacacagggtgacggctcgtcggtcggctcccggggccgtgttctgcggcgggagccggagtttttgctgctgcaatagtagaaagcgacggggtcgcgttcgtctggctcgcttcatccgttcatcgtcccttgtgtcatcgcctcacacctcgatcggcgtcatccggtgaaatatcagccctgaggaagggagggaagcggcgaaagggaaggcaacaacaacaaaactaggtactccctccatccaaaaaaaaaaaaaagacacccttgtttccgtgtctgtccgtcttatttaaaaaaattataaaaaaaattaataaaataagtcatgcataaaatattaataatgttttatcatctaacaacaatgaaaatatgaattataaaaaaatttcatataagacggacagtcaaaattggacaccaaaatataaggtttgcctttttttttcggagggagtacagttcagtcgtaccgtttttgtactcctcgtcctgagcgtacggttgtacctgtgttgtgtgttgtgtactaccgcactttataggtgtccaagcccgttcgtttctatcgccccgtacgttttgactgcacatctaagagtggtaattccttcggtcctaaaataattgtttcgttatggtttaaaacctatttcacaatactatcttcgtttcaaaaaactatttctaacataacaactacttgttctaaaataaagttattttctcacctacttcttcttttaaccaattataaccatttccctctacctgctttatatttttaacaaatcacatacttctttcaatcacctcttatttcaatttctaccaattctttcacgtactaaatgagagagattttaattcttacttgctgaattttaatttgtgctagaactccctccgtttcaaaatatttgacaccgttgactttttagcatatgtttgaccgttcgtcttattaaaaaattgtgaaatatgtaaaactatatacgtacatgaaagtatatttaacaataaatcaaatgatatgaaaaaaataaataattacttaatttttttaataagacgaatgatcaaacacatgcttaaaaagttaactgtgtcaaacattttgaaaactgaggaagtaatatacagagacacgtatcaagagacggagtgagctcacgctagagtgggcagagctcgtagtggagttgagtaattcgatcaccccccagtgcatgggcgtggtggtggcgcgtcacttcgccgcgggtcgcgcgcttgatcagctgccgcgtcgccgtcgtcggtcgtcctcgggacgtggggagcgaccgacgtatccggtcttgccgtttttgtttcctttgctctgctgcggtttcaagatttttgtcctatccttacccgtttgctgctggtacggaaatgattttctcagatgagttccccttcagttttgtactactgcattctctttttcttttttttttcaatttttggagaaaatattgtgagccgggtgacttaacatgcctgctcatgaaaatagttttcgcttatggtttgtgagatgctcgtatgagaaaattccgatttatatnnnnnnnnnnnnnnnnnnnnnnnnnnnnnnnnnnnnnnnnnnnnnnnncctatagatgagtcgattacaaatnactggcccgtggttttcacacgtcgggattgggaaacccttgcgtacccaacttaattgcttgaagacattccccttttgccagtgtggtaaaaccgaaaaggccgnaccgtttgccttttcaaaaattggcagctttatcatcgcnagttagggttaaccctttaaaaagaaagccgttttcctttgttgggattcacaaaggtattttgcaccccccggcgacggttgggatcct

SEQ ID NO: 14134 - DNA, 4882 bp, Oryza sativa
  unsure (1)..(4882): unsure at all n locations
agcgcattgattgctngtcgagctggacaacggngatacagagaacagaagtttacatacggagagtatatgaacagcgatgttcgtgcattgccattgcatctagcatcaatgcacgagcgggaaacacaaagtgaagaaattacgagaaaatcaaagctcgatcacaccgagatatataggcagtcgtgtgcatgatggatggcatcgatcgattggccggtgtgtcggggtcaaattcagttagaccctggccggggcggcgggcttgtggtggtggtcggcggggtagtcgccgtcgtagccgacggcgccggcggcgtggttgccggagaagaggccgccgtggagcatggcgacgtatagcagctgcgtgaaggcgaggatgatgaccaatgccttgagcacgcggaggcgccacccgcggaagccgccgatgtggatcttcttgcaggcgaggccgaaggcgagcgctgtgatggcccaggcgatgagcgccgacgcggcgccggcggcgaggctgtgcgcgccccaggagcggacgtggtggacgccggcgagcttggaggcggcgccgaccacccccgcgaggatggcgaagacgaggaagtagaaggtggcgccgttgccggcgacccccgggtggttggtctcgccgttgatgtagtggttgagattccagctcgcgaacccgatcacgatcaagtacatgatcagattcagcaccagcagcggcgcgatcatcgtcctccctactccggccatctcgtatcaaaatcacaaatcaacacaaattagcaacacaattagcactggtttagctagctagctgagagctactgtgattaagtgaggagaaaacgtgctggttggtggagggatatataggcggggagaggggtgacacgtgtgggtggatggggatggcacgtgtcggcgtgtggcaaggggtaggggggacacgtacgcgcggggccacgccacggacgcccggcttctggtgatttccggagaggcgcgacgcgagggagacgggggtaaagaaagcgtaaaaaagtgcagcgcgcgcggcgtcggcgtgtgcggaggtggcgacgcgcgggcgggagatcgaggggaggagaagcagatggttccggactttcgccgcaagcgcctcggctcggggtcccagagacggcgtacgtggcgggcgtggttagagcacccgcaatgataaagtaaggtgctatctataaaacatgtacatctcagcaatagattcgattaatagtaaaccaccttaatagtatatctacattggtatctataaatctctcatgcattgtctgttttttctcaaagactttctttagttaagtagaaagcttggtttctttcttcctttaatcctttccaagtagaaaattatgctgacatggatttcttgtaagaggttattgatacccattgtggttgtccttaccggcttattttgggttaaagtgtgcgtggtttaccttattctggcgggtgtgccaccagaggcaagggttagctgcttgttttggttttaatgatgatggtgttgctgcttcttttttgttcctcctttctttaaggcctagtgcaaatgtgcttccctgttttgggtttacgctgatccggcatactcggtacttctattcgtctgcctaagtaatgcagcaatctgaagtctgtattccctgcatttcaaaatgtttgacaccgttgatttttttagtacgtatttgaccattcgtcttattcaaaaaaattaattatttatttattcttttcatatcatttgattcattgttaaatatactttcatgtacacatatagttttacatatttcacaaatttttttgaataagacgaacggtcaaacatgtgttaaaaaatcaacagtgtcaaacattttgtaacggagggagtagttttaagtagtgttgcatacactactatcaaacttttagtaaaatgcttactcctttcgaaatatgggaatattgtgtcttgaaaaagtatttttaaaatcttttaatcacagtatattttatgaatttattccgatacaaaattatgtttagattcacacactgaagatgtgaaaagaaaaatcaaaccgcgcatgttctttttaaccggagacaatattaatatgtgatacttgtaaaactacactttttcatggcctgatcaaatgcgaaaaatttaaccaagaaccttttacacatttgttgtgtccacagtacattcgaatctgtacgtgtgaacaaagctagtataatatttcaacgcaacaagaataacgtgcaataaaattaattaagatataatcagtacatgacaggcgttgggagttgacaaaccgaccgaaatcgaagtctcaaataatgtctcaggacgatgcccagtttgtacggccgtgtttctcttcatctttttacatgttctttaattatagtcggcagttgccacatcgagtcagctaagcaacgataataagcacgcacgtagataataagtccaccaaataagcgcgttatacctggcgactaattaaccccctgtaatataatcgtaatactacaattggtcgcggtcgtacgtgatcggtcaaggcagatccacgcgtacgtacgtggcagtactagcacgactccaattggaccaagtggcacatgttctttaaccaatttaggacatcctcaatgtatagtgtccaaatacttcgtaagatgtaccctttaaaaataggtaatagttgttgaatttatcataaaaatatatatattgctaaaagtaaatagtaaagtggagccatatattacaatagaaaaatgagatagatataggaggaaagatgaatggctgatggagtaatagggaatgaatggaagagagaaattttaatactatttgttaagttcttatgacctggtaataggtctattgctaccagattgtaggagcttcttactacccgatttcttcttacattatactccctctgtcccgggattttcagtttttgcttgcaacgtttaaccactcgtcttattcaattttttttgcaaatataaaaaatgaagagttatgcttaaagtattgtagataataaaataagtcataaataaaataaataataattttaaaattttttgaataagacgagtggtcaaacgttgcaagcaaaaatttaaaatcccttatattatgggatggagggagtattgtggttgcctttaacatagcaatgtgatcaatgcatacttcgctgaaaccgagcatgcacaaacgacacacgcgacaaaagggcttagccacgtgtcgtcaacagggtgattgaatccccatgaacttgctttactgccttcgttataaatataaggccattcccaatccaatgactaggatgatgtctaaactgccacctaggataaaaaatgatgtgacaagtgaataaatgaggaaagagaaggaaaccatgtcttgcatgagacatgatttctacacaatatccaagacatcatgtgagataagtaacattaaatttaagtatggaatagtatgtttgcattggaagagtagtgtataatactagtttcttgataatgtggagtttatagtaattatatctagtgttttaggttgggaatggcctaagggacttttacataaaaatcgtttatatattttagaatgagtataggctgtcgcatatgttcctcaacaaagtaatctaatgatttcaataaccgttattcatttgtccgaatttaccataatggttttatttaggtgtgttggtgtgccattagattgttctttctttttaacaaaaaaactgctaggtttttctagaaaaaaaacgcttcaaattaaataacaattatttgtcagtagaaaccatgcaaatgaatccaattgaaattatgggtgggatcgagccaacgtacgtggagagttttttttttcgtttttagaaacgtattgtggagaatttggatgaaccaatatatcttgcatactgcaaaatcaaagggctgctttcaggctttcagccaaccaaagtatcccggtcgaattaattactgatatcgctgacaggatggcgatatatatagataaaggacacggctagatagagcgcgtgttaacgaaatatcgctaaccagcaacaacacctagcttcctttcaatccgtgcatcaagatggatatttatcgccgtgcctgtgcgtgcatgcgtatgtagcataccactcccttcgttccataatataagggatttttgactttttcttgcattggttaatcgctcgttttatttaaatattttgtgcaaatataaaaaacgaaaagatgtgcttaaagtactttggataataaagtactttggataataaaagtagtcattaataaaataaataataatttaaaattttttaaataagacgaataatcaaacagcacaaagcaaaacttaaaaacccttgagggatttcattgacccgtccccgcatatatattgataccgtttcttgtcccgtccggcccaatagtgtttggggggcaagcttaaaaagtgtcggggtacccgccgccccatacctgggtttggcgggtttaataaaaccaatttgaagttgtttttcctcctaaaaaacaaacccgcgtgggtgggtatatccagacaataaatgggacaaggtgttacccgattatgggccagggtggcccgctttatagaagattttaaaataaattggatattttggcagagggagactggtttggctttcctaaacagcccagataggccccttaagaaaacttcatggggcaaatatttcatatccccagaggccctccc

SEQ ID NO: 14135 - DNA, 2025 bp, Oryza sativa
  unsure (1)..(2025): unsure at all n locations
catgcgcattgaattgcagctgcgagttggacgncaccgaagcccgtaagctggcgtcctctcgccgctggatgtgacgaggactcccgtcgccatcacgccatttccgctgcctccgcctccgcctccgcctccacctcctcctccaccgctgtcgcgtcgcagtgtcggagctcctccgcctccgcctcgcgctgttgccgagcgcagccgtctccgccgagcggcggtgaaggcgggcgcagcctccatcagcgacggggtcggagctctgacgaccacgccacagggggcgcaaagagctgacggctcatattctagcatcaggagccacgccgccgcgcccggcgaccgcgacgacgaggaggaggaggagccccgtctccgcgtccatcctgcggcggctgctacaccttcgtccgtgccgcatcccgccgcggcgggtaccggcgccttggctcctccgcctccgtgtccacggccacggatgtgattcgggtggtggtggggacgaccaagcgagagaggagcttgttccatgtcgatccggccgtgcttgatgccgggctggtgcagcgtgtgacgccccgattttcggtcgggattaaaaatcatttaataatgcattctctataaactaaataaaagttaaagcaatttattcaagtgaaataatgagggaatttaaaatttcctttaaaaatcattggccgagaatattttgtaatattctttgtgccctaaaatactctctgaaatttctcgcaaattttcggagctcgagaaataattttaatagcacaaagatcattgaatcaattaaaataaaaaagaaaacaaagaaaatcccccttcctctctttgggccattttcggcccaagtcttccttctctcccgcggcccgcgcgccccctttctctccctctcgggccggcctcctccctcggcccgctcggctctctctctccctcaagtctgttccgtctccccagccagcctctccctccctctctctccgacaggtgggacccgtggaccccacctgtcatccccaaccttcggcctcccaggccggcaaccgccatggccgcccgagccgcctcacgtcgccgctttccccgcccacctcctacaccctgcaccgctcccgcccgaccgtgggacctcgccgcccacgaccccgctcccctcccccactccgtcccgcgaaaaaccgccgacaccacccccacgacgcccgcccacttccccctcgaaatccggcggtccccggccctcctctcgcccccttgagctataaaatcaatccccggggcctcctcttcctttttccccattttcccgagtccccacgccctctaccgagctctccacgccgatccccatcgccgccgctcgccggcgatctccagccgcgcgccgccgctgctcccgccgtcgccgcgcctcaccgcgtgtgccatcagcttcgccgtcctgcgcagcacgccggcctccactcggttccctccaaacgccatcggaaccaccttcccaccgtgtaacctctctccgccgcttgcctccgaactccgggcggcttttctcgccacgctagccaccggcaaaccgggccaccggcactgtcgggttcgccgctccaagccgagcaccggccatcgactcgttcctctaatccactaccgagccggccttccccattaccaaccaaagccatcgtcgccatttctgccttcggtcgcgccgcgtcgcttcttcagtccgccccgtgttgtgtcgttgccctccccggtaccggagccatcgtccgtggctcagcaatccctccgtgttcggcggtcggtggccgactcatcttcccatggcctccggtgagcttcggcggtatttcggcccgcagttttccgcgcaccggaaactcctaccctttactaacctcgttaatttcttccccaggttcccttcgaccatcgactgccgttttccgctcgcggaacagtcgcggccattcgcgtcgtcgtcgc

SEQ ID NO: 14136 - DNA, 2756 bp, Oryza sativa
  unsure (1)..(2756): unsure at all n locations
nnnnnnnnnnnnnnnnnnnnnnnnnnnnnnnnnnnnnnnnnnnnnnnnnnnnnnnnnnnnnnnnttnnntcaccgncnttnnnnngggggnngncccccgggccttgtgtttggccaaccggttttggccgtgcctgccaaacgggacggccgtaccggtggaacgttttggccatcaagccaggggggggggtggttttcccccccccccgtggtgtgggagacaccacccaatttttccgtgggtgccgggttccagggtccccctgggccgggtggattgagtccaccgtgtgcctgccccttgtgccgcggacgagtggggcccgcctgtcggcgccagccctttgctgacgtcagcacatccttttcctttgagaaaataaataataattacgcaataattcgtgaataattttagaaattcatttaaatggctcaaaacttctaaaattcatatctaattcattcgaactccaaattgagccattcaacttgcaaaattcatctaaaattgagctctacatgtttgtttacttttgatgtactgttttcttggtttttattagagtttttcctcgttttgcgtgccagcgtgtagttcctgtcgtttcggaagtccgcggtcgcgaggaaaagagttcggaagatcaaagtgaagaagcgaggcaagtcacacattccccttgagcatgttgatcccaatttataaatgttttaccgtttgcaaataaatatgcatgttttgctaattacatggaatccgggtattacctgtctgctcgcttgtgccatgtttacttgatatctgtcctttgtcaaccgggagcaataaatcgactaactcatattacttatttgacctagctagaactatatgcttagccatgcttaattaccactagctcagttgatgggataattacagtattagacctttttagtatcagaatgagctgcgtgctcgagacatctggccatgcttcatggtcgtaattatcccactaaaatgcgactgaatggtgggctgtgggtgcatggttttgctagtcgcacccatggcaattaaggaccggttcgcgggaaaccctggaagaatttatcatgcttaccacaagccagcgtgggcaacggctgggcttgtaatgtagctttcctctagctgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacagtctctttccgatatgtcgtggtggcatgtcggcgcacgaaaacgtgtcgtggggctgtgtcttgtgggtacagttgtacacctctgatcagagtaaaactattcgaatagccgtgcccacggttatgggcggtcgaccagattcaccgtgattagtcccaccttaataaattgacccaatgcactgtagttcaggtgggttggttgggcctgttcaacgtggtgtagcgttgatcagtggagatttaatgttactttaattactcaactgttttactgttttgctcaataaaatattttacaactgcctttatgcaaatagcctcaaacccctttttgtatccccttgcacgtctgcatcattggtgtggcttgctgagtacggtagtgcttctgagctgaagacgaagttaaaagaccaatgctcagaccccagttgagttttgcctgtggagtggagctgaagccccgctaggatcgcctttttccgctactgtcgttctatatttagtgtgagagctaagtgcctcttctgtaagtattttacgctttatttacgtttggaactgtatatcccttgtcgttttgtgtaccctggctggtcctggatagggatttaatatacaaaatagtctggaaatttagggctaaatttctgggcgtgacacggcgcctcctcgcggcggccgggcagcgggcccgcagcggtgcggtggcggtcgcattggacgtgctgctgtggctgcaggcggccgggaacaaggggatgttgggctacgacgatgacgatgaatcagccgccgccgacctgtcggagatcatcgagttgtactcgcaggacgacgtagacgactccagccactgcgggtcctagcgccaactctctctttaaaactgcatatatttagttatgtgtatagggtcataatccctcctgaaatagaaataaggtggtgttctatacatagattaattacttctacgagttaaaaatatgcatctgggaacaaatcacaaatgataaatctggttgtatgtatgtgtaatcaatatagtagatagtaaatactgcagcctaatctgctctcttggttctccgaattaaaaaggacatacagctgtagatgtcgaaaaaagtgccgtttttcttgttgcttcttttggtgcattagatgcatgctggtgcccttcacccatctttcaatttttccaaggatgacataagtcatgatatgttacatgctgggcataaggttacgatagaacttatgtgccgcgtattgcataatgctgtctgtaaatatgaagtgcttgaatgatgatttatattcactctcttctcatattagttgaaaacttgctgctggctatctcttcttcnngcggtntgtccaaagngnggtctacctgcgcatg

SEQ ID NO: 14137 - DNA, 2261 bp, Oryza sativa
  unsure (1)..(2261): unsure at all n locations
aaccgcctcgaaaatatttttttaaataaggtccaatataacaccccctttttattttcaggtcgagaataatagaagttaaaaaattttgtgtattttgaaaaaccgtttcaatccttccctggcaggaaaagccaattaatttccacaaatttcatttttcaaagtatggttatagttgaanccctttttaaaagcccccgccccccgccgcaaaaaataggaacaaagggggggaaaaaaagaacccccaaaatttggtaagttccttattttttcaatcctgtaaagagaaaatattactcagccagatgggcggcacatatttttttttcttgtgggttgccaagcttcaatcaaaagacaaatgtcgtgcattttgttaaagtggcccgcttgagaagcgaagaaaacatataggtcctgctttttatgaatcgtgataactacatctgagacacctgtgctgtttttttccctcacttaaatttcttgcttttggtcttctggtaagctctaaaaacagtgaatatgggttttgaatttcagcatggacttatgctaatatgttgtttacatgccatttttattccttttgacggatatataatatctgatttttagattattgttattttatagaattttgtgattatgcatgctttagcgacttctgtaaaatactttctcccagtttatgagttatacttctgttaagtgtttgtcaatcggctaattcaacaaattttattggcacttgcattttgtagttaatcacgacaacaatttggtctgcaaccacatgaactatccatgaggcaaaaatcatatgttatcacgattgattctgagccttcagtccttcacttatttaatgtccatgttgcaaaactttgcatggcattgatttaagttatttcttgtgtttgtgctctctttgcctaatatatgtatatcacacgcatggtcttcataggaggacaggggagctataccattacatttctgtagcatgatggtgcaaatttagcatgtgggagggttcttagttaacctggtgggtggtgggtttaaacagaggccaggctgctgctcaaacaagggaaaattgtttttaggcacattttaaagcaatttggatagcggcagacataacattatggctattaccagaacctgattgcatttctgaattctgaacatttatgaagttttgtgagatcaggaaactcttttaccatttctttcttgctttttttatgcctaaatcatcttatcttatgttgttttctatagaaaattatataaccttctgtcactgaaactactaccaatttaccgcaaacttagtggaaaccacaactgtaatttactgcttgcagtgctgaaggtctccgcagaagatggcaagggcaacaagtcttctgtgactgttcatttgtatggcccaaatacagacttggtggttgatcggaagagggaattgcaggtgagcatttgaatagtgtgattattgataatgcgtgtatatcatgtcctataatgttccttcatggctgtgcaattggttcatctgttagtcctgctttattttatttggtgcatttttttacagcaagctcaaagaacctcattgttttttcaaatattcaagggcttcttgaccatgaaggatggtgacatttcagtcctattccacaaaaatatgttaatgaggatgtattattaggagcctcacttgtcggttgtcggtcttgattcttcatgtagtttgtagacaactaaggtttggcactaatagaactagactttcagttaaatggacgatttctatgaaggaagatctaatttgcttcgatactctactatctacatgccatttttaatgctcttatctggtagatcattgaatggttagtatgctcaattatgggttgtatgctaatatgggtgtatatttgtctgcaggatttttttcttccctttccctaccatgattctctatggtgaggtatagctttttatttgtattttactcatccaggccttctgctatctgtagtttccgtaattatattcagctatctgtcttttaaaaccgaattactagctatgagctcaaaatagcatattatttgctgtcgaaaatatagatgatttcttatagcccactaaggctgtgttcgctgctggtagttgggaatatttctcccgtgcatggaaaacggagcagtcgntggacacagcagtcatcacacgtg

SEQ ID NO: 14138 - DNA, 1168 bp, Oryza sativa
  unsure (1)..(1168): unsure at all n locations
cgcgcatgaatgccctcgnatgnatggaccccnctcggatagatagcaancaccccaccactgnanaacnnctcctatgatgaatgagngcnttttgttatttttcanacccaacaagccacgcagcaaatatgcaagtgcacaggataacaaaggatggcatagtagggtttcatttgcataaacagcatttaataaacatttcagaatttaataaagtagttaagtagtaattaaacaatattaatccaatgctatacaacataccctgttgcataggcccaaccattcttaacaatcatcccggttgcacagttctatcttcaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggccagaggtgtaccactgtacccacaagacacagccccacaacatgtcaccatgcgcctcaataccaccacggtacctcagaaaggggctgtgacagtacccctcgcacaacacaatccaccacagtgcaccattcctggagcataaccaccccttataaacaaggtatggactccccagcgacccccgggggcctatctccgccacttctcagtctgtagctcgcaatgaaaccagctatcaaaaggtaaagccgttgcccacgccggcttgaggttggcaccgttaaggttcacaaccgaacctccggacccgttcttaaatgtcaggagcacgaccatcaaaacatgtgtcccaaaccaaattaaaagattttagcgggaaattaaatgattaaccatacccgatggccctcatggaccttccttaagcccatcttcaatatagtgggtcaaaggtatccccaaatgggggcaaggtgatacgcgggctaacaaacggtcttaaatctacgggaccacatataaagcccaatgggtaagtatataactcacggttcccggaataagtatcccgaacaaggggctacacacacaaagggttattcccccaccgcccttaaaaaacagcaggcgctaaagacaaaaccttaaagggctcaaagcacagggtgttggaatccgttatct

SEQ ID NO: 14139 - DNA, 1466 bp, Oryza sativa
atggccttgatttgcttgtagcgtctgttgggagatggcaaaaaagaaattcggcagccgcttctctcgtcgcctccccagcccggtggccaccgccgaccgtgcctggcccttcgctgccagcctcgctggcagccgcccgctggccccgccaccgtgcacaggccgccaccgtgccccgctcactcctcgccggtgcttcgattattcctatataaaaggataagactctaagactagagagaatgaggaataggaagataaggagaggataagagtgtgagagagagaggaggaataggagatagaaatttttgaggataagtgcaaggaattatatatggtatattgatttttagtctcagttgttaacaccaaccggaattaaagatgtacataaactttagtcccggttaggaacaacaaccgggactaaagttaggatctttagtccactggggacctgacagcctctaacacgaggtggaacaaccgggacttgcataaaatttttgaataagacgagtggtcaaatgttggttaaaaagtcaacggcgtcatacattaaaattaaaataaagtaggatggagggagtataattctttttccgcttcatcaatacgaagcctcatattatcgtgggggttgtttaacaaaaaaagaagtaaaatttgtgcgaaatgcagcggcacgcggtcgtgccggcgactagtacgtacgtacttcccgtgagtaggcatgaatcatcatgactcgcgggtcgcacgcaaagttcaccgcaatttcatccgcacacatacgcacgtatacgtgttttctccgtccggtttggtactggctaaccttgatcaggaatttggattaatatttcggccacactggagatcgtctcttgaattcggcctcatctctggtgcagtttatgcgaaatgcactagccagctactccctccgtccaaaaatagaacaaatctaatactaaaaaatcaatctagtatagacgtgacacatcctagtacaataaatcgggatatacctctgtccagattcattgtactgaatatatcacatccattactggattgtttttttccggaggaaatagctagcttcagatttggtctagttgaaacccgaccaagccacgtttacgttccgtccggtgccacgacaccaattgttaagttggcaccccaaccacgtttgggttccgctccgttacaacatatcgggaacaattttatttgtcggtattggacaatgcctatccccttcaggctttttaagactttgggtggggctggttggttatttcgctttcttaaaaaatcaaaactttttctgttttttgttatacctaccttatttttccagaggctttttatttcacagaactttagaaacatattgttgtcttttatattttggcacaatatttataaaaaacccggcgcttatacacacg

SEQ ID NO: 14140 - DNA, 1254 bp, Oryza sativa
  unsure (1)..(1254): unsure at all n locations
tcctccgtctcctactattacctctactttaactnttctcccttctctttccgctctcacccctccnttacttttccaacntccgcccccccccaagtgatgcactctatanacccccnnnnnnnnnnaagaaaaaaannaatncgggcgtatacgtcacgccgtcgaagaagctataaccaattattatagatctgcagttcaaaataactgcaaattagagaaaataaaagacgagcacagtttgatggaacacaagagaactacttgctaaagagaaattttacgatccttgataaaatacctgaaggtatcaagtttaacattacaaaatgtggcattccccggtaccatccgaaggatggtaaatttacccattgctaaatcttcaccaatgatccgtgaaaatctgtataatctgcatacagtccttatccttctcaaaccttgaaacctgtatgtatgtctaatcataatcaatctgcataatgtcctacttggcgtaaacaatgcgtggaatttatgatgttggtggtgtgtcattttgccgagaatttatttcagtgttttaagatttgacaggagagatttacaaggttgggctacaattacagatttcattgattaagttttgtccaaggttgaagggttgctttcacgaagacaggttgaaatagactcataacagggtcgttttctttccgtctcttttgtcagagtcacggctccaagtacgcaattcagttgaatagtaagctcacatgaagcttgctcgctcctgtcacttccagaaaagaacccaacggctaggaatagttgaaaccggacggggaaatcacatctaaattgggtgggaaaatttacccattcaccaatgagaccattggggtacaaaggaagaaaggatgaaacgcaattgggagtccgaattccaaggccacaaataaggaccggaacttggaataaaatatttttttgcgcggaacacggaatacccattccaagggggacacccttgtgcaaaaaccaaacgggaaataggtccggggggaatcggcacctaattgggggaattccccccgcggaataaacaattccgggagattaatttattttccaattaaattctctaaggagagaagaactggacggggagggggcaacaacacgggggaggaggattgaatgggaataaaaaagaacctcccaaaccggcccgggggcaaaagaacttgaacacctaaaaggagaggg

SEQ ID NO: 14141 - DNA, 1117 bp, Oryza sativa
  unsure (1)..(1117): unsure at all n locations
acgttagatcccctctgtanccncnnccnggncaactgtgtatctcttatccttatcagtgacctcaaatccatcttttccattccaaatggcttcacagtttccagataagtcaatgtacttgttcaacttcttcaagatatttggacatatcctacctagccatccttttgctttgctcctgttctgttgtatcctgacataaaccttggtccttatgccctcaaacatagatatgattggatgtgccctgatgtcaattatccaattattgaagctctcacacatattgttgtctacactatcacaattggaccctatcctaaaccaagctctactccagtgcataggttcagtgctcatcatgtccttggcaccagcaggagttagctgtgcaagcttggctctacaaaagttgaaaaatggtctacaagatgccttggcacacttccaaaatggcttctggaatgcttgatccctatacttcttcctccaattagcatagatgtgtctagtgcacattctgtgctcaatttgtggcaaaaattcctcaactgcacttacaagtccctacattggtaaacgaaacacatgaggatcaatattcatgtatttttgttgatcatataaaaataagtagatatcaaggatgccttaccttttgttgatcaaaaatataacccaaccagctccatgaggaacaatattcaaatcttttttgaaggagtccaataaaccaactccaagngtcttttgtctctttctcgactactgcccatgcttattggatacaatttggtttgttggggtctccttctaatgcacattagaacttaaccatttgcagcaccttttgaaaaaccacccatttaatcctataacttttctggatctcaactataaaacccttctttggaggccttaaaacatacatatcattttttgtgaaaaacggccaattgttttttgaatccaaaaaatagccccccgctacacgaaaaatcctaaaaatttggttggtgtctaaacactttaaggcctccccctccagcctcaataaaactcttatgaaaaatcacctgattcttaaattgtggagggcccactcgcaacattt

SEQ ID NO: 14142 - DNA, 1670 bp, Oryza sativa
  unsure (1)..(1670): unsure at all n locations
ttttccttatggtgtgggaacgtggcccatctgggaggggggggagaggtaccggcctttaaggggtgggaccaggggaaccctttttgggcgagcacatggtccggatattggttggcatggacaaattttcctgggggataaagtttttcgccgtaaagcggggtccccgttaagcttccccacagttcgggggcaccaaggttggggtctttttcaggttggtcattgtgaagggtctcttgtggcccagttcttggcaacaggcttgtggccagccagattttccccattgggccaatgttcttctagctgtcgatcaccgccccccggggattggcctcggttagtttcctgttcatcaaaaacgccaggggccccgcctttcctttgggtgaatgcttttttcatgggcccaccgactaactggccttttgggccgcggtgcttcgacaagagccggctttcattgatatcttctcactggccaatgccgcctcctcatcctcctcttcggtcgccgcagtgatcacgcgtcgattgagcccaccctctttgccggtcatcacttccgatggggaattttccttagagaatttgatggctcttcttcgtagatggggattttggatgaaccctaacttttcgatagagggaagaggccgccggtgcgtggtagttactaaggtaacataagtgggctatataagttgccacatcagatttgtgcttgtgtggaggagagatgagaggagagagaataaaagtgggctacagatttgtaaccagctacatcacaagctccaatatttttaactatgtgagagagatggatggattatgcattcatgatgcagtatatttctacagctaactattgtatgagtaagctattagatagactataaatgatgttttaaattttgaagttagtagtgggctgtattattaaacttgctcttagagggaagcttaaggggtggctaatgggcgggtgaccaccccaggcgatcaccccccatcctcctatacgttactctccctcccttcctcctccccttcttctcttcctactacaccataaatttaaaaaaaataaaaaaataaagttggaaaaatttatgtatagaaaatactatatataaaaaatatttgaatttaaattcaaatttgaaacaggtatgtaaacttttaacttataaactttgggcctataaactaatatttgaattcaaattcaaatttgaatcgggtatgtaaacttttaacttataaactttggatctataaactttaaatgtatagaagtactatatataagaaatatttgaattcaagttcaaatttgaatcggatataactcaaattcaaatttgaaacgggtatataaacttctgacttaaactttaggcctataaactttagatgtatagaaatactgtatgtaaaaaatatttgaattcaaattcaaatttgaatcggatatataaacttttgacttataaactctgggtctctaaacttaggtggtggcttcaagagtgtctatgacattgnnngggggnnngggaaggaattgtagcacaacanaanggannnatgaaaagaaaagagagataagtaaanaaatcgacaaagttgagaaaagtgaaacgataataggatgagtg

SEQ ID NO: 14143 - DNA, 2738 bp, Oryza sativa
  unsure (1)..(2738): unsure at all n locations
cccaaggaaccaaacaatcttgtgtcacaggtatttcccagaggccgaatataaaaggcactctcatagccaatggcttaagaaggttataacaatgaagcgtgccattgtagggctcatgaaaccaattttacaagttctcatcgcccggtgtttgtaactccttgtaatcttagtgtgcaggaaaggtcaaaagctgcggggtagatggtctagtttatgactttatcaccaaaatcgccaagaaagagcacattttggatatgcgcctgtcacaacttcgggcgcattatttctccaccttcagtggtctttgactctgtgcctctgacaccattgacacggttgtggagaaactccctagatatttacataaactgcatctgctaaagttgctagatctggaaggctgtcaatatcacttggacaagaaccacctcaaggacatctgcagcattttacatcttaagtatctaagcctaaggagaacagatgttgctgatctgcctcatgaaatcaacaacctccatgagcttgaggtattggatatccgtcaaaccaaagtgtctgagcatgcaacaaaaaatattgtgctcctaaagctgaggcgcctacttgctggtcaagttgatccaagcacaagtcatgaaatgggcaagccattgcgctcagctgtcttgatcccacgcaaaatcaacaaaatggaaaatatggaggtattgtccaatgtgaaggcttattcaaggaatggagctgagttaaaagaaattagaaagctagggcaactgaggaagcttggtgtggttatcgttaacaacgaaaatcacctcaagaatctgctctgggccatgagtgacctaaaagaatgcctccagtctctttccatcactatacttaaaaccagaaatgagggtgatactgccaacaagcaaaaggtgctaccacatgatctgtacaatcacttgatacagccccccaaggttcttgagagcctaagcattgatggacccccaaaaaatgttcggcttcaaacaatgttcgctaaaggtagcaacgaacttgccaaggtaactctgagacacacctcattgaaaaagaaaaaatctggtccacatcaccatgtttcccaattatgttgcgtcagactccggcaaaatgcataccaagaaaagggagctcactttttagacggaagaattcccacatctcaagaattttcttgttgaagcagctcacgaagactgacatgatcaacttaaaaaaaggagcagctcctgagctcgagaagatcgtgctattccgcaccagcataaagcatctttgtggggtcggtgcccttccaaacctaaaggagctcgagttgaaggaaaacgagcagcttgttctatcacctgaagctggaacagtttccgctgatccagttatacttgaagattggacagactctactgatataattgtacataaagatggagcaacttctgctgaaaagagcgcactcaccttcaagaagaaagaattcaagcatctcaagtactttcttgttgagggtcaccacatgcagactgacatcaaatttgaaggtggagctcctgagctcgagaagattgtcttgtccaatacaaacatagagtctcttgatggagtcgacggccttgcaaaattgatggagattgacttgaagggtaataagaccattctttcattatttgccactgccaatcatattgccaaggtaactctttccgatacttgcctgaagcaaggtgatctacaaatcctcgcgaagaaaccaaaattgtgctggctactgctcttggacaaatcttatgacgaaagccatcttaccttcaacaaagatgagtttcccaagctcaaacatcttactatcacgtgctccaagatctcgggcatcaacttcgccaaggaatctgcctgtaagcttgagaagattacctggtccttcaccgagctagagtctctctctggaattgacaacctcccggaattgaaggagcttgagttagaaggcaaaagtgtccctcttcaagtgtggagagatatcaatgcacataacaagaaacttatacacaagagaacacaggttcaggatgaaccaaaaggaggaccgacactagctaacaagaaaaagtctgcattcttctccatctttccgtccactcatcgctgattcccggtacttgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14144 - DNA, 2061 bp, Oryza sativa
  unsure (1)..(2061): unsure at all n locations
ctgggctcgcgcgttccttttttaaaactactccgcagttttcattttccctttttgccagccccctctataactggcgcttcacgtccaggggaaaacccctttcacggtattgccttccctaccctcccctaccatttttgggtccggcccttaccctttttgggcctctaaaggatccccttttagctttgcggagaacccgctatctgtccaaaagaaggattaacctaagaccggcctttggccttccattttccgttcaccttgggttacccccgcccccccgccttaatgctcctttcagggcggtccctttccctttcgggcctgccttttttttccccaacctccgttttaagcctttttgttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgagggaaaaaaacagcacaggtgtctcagttgtagttatcaggattcataaaaagcagggacctatatgttttctccgcctcctcaaagcggccaactttcaacaaaatgcaggacatttgttctttgaatgatagcttgtcaacccagaagaaaaaaaaattatgtgcgcccatctgtctgagtaatattttcctctttacatgattgaaaaatataagacttacaattttgctctccttcttctgcatctcttcaagaggtcttccagcattacgcattcctcgaacaatgaaatttgtggaacatcaatagctttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacggactttaagaaacagagggttccccttgaaattcctcttgcctctcttgttcaaacctgcggtaaccgaatacttgcccctttttcttttggaaagggggctttctatagcacgctcgaggattccaatcgggagaggtgcgttccactggttggggaccaaccccttaaaccaacgggggcttttgggaattattttggtccccggagaacaattattcctggctaccccgtgtacaatataaaaagagagtagggcggcccaacatttgaggggcgcacaccgctcccccca

SEQ ID NO: 14145 - DNA, 1179 bp, Oryza sativa
  unsure (1)..(1179): unsure at all n locations
cgcgatgttgaccactgatggagacgagcttgccgtgacttgtccacgatacacggacactcagtcactgaggcggatgatttctgcgtcggtgtgcaggtagacccatttgcgctcctgaatgactgctgagacgcgatatgtgcggccttcatgcaatgccatcatgccgggcgtgacgcactggcgaatgagcggggtggtgccgtagtggttgatcatgccttcacctcaacctgttccaggaggccagccagcttcatatgccagcggttcatcgtcagcttttcacgcgggttagataccgacgtcagctgccactcgttatcgttgagctttttggcggtgtactgcttgccgttgtgggtgactgtcatctcacaccaccttgaataagaaccagcccataccgcacacaatcaggcccacaatggttattgcggaagacatgcgtacatggtcaatggctagttttgaaagtggctggcgatgttcttttttcgtcagcgagttgattgctatgtcgagcagaaacgtcccgacaaaccataatgcgtatatctttaagcccaactccaaatcactcataaatcctcttggccttatcgcggcgaacggaacgggtaatacaagacttcaacgcatttattcagtgtttcaatggtcggtggatagccggccgctgtcataacttgacccactcgaaatgaactcagtatgaaaaagcgctggttaggcggttttgagttcccgcggtttgggaccaattgggccccccgcagttattcaaatggaaaaaattctcgggccttaggaacccagtctaaaaaaaaaggtggccgtattccggccttatttgtttattgtaatcaaaaagaatggaattggctttttgagctttttggcccgggttaaaatgtaattattaatttggggaccttaaggcccgttattatggaagcgtttttattgtacccccccttttttganaaacaccttaccctttgggacccctttaagggaaaaagctttgtgtgtgtggggtggaaccttttacccgtgcgctttattttgcaaaatctctcgctcccctcttattgatatttctccctaacctcccacacctatatttctgttgtgacgccatcctctagtggtgtttttcatattattttgtcg

SEQ ID NO: 14146 - DNA, 1756 bp, Oryza sativa
  unsure (1)..(1756): unsure at all n locations
ggtggtgtttgtggcgataaaatatttaattcgtcaagacttatcagcttttgactcccccctttggtttttaaatagatagccccnccagtctcttgggtcaatttttgaaaccccctaaaccaaatacaaggcaccggtccccttaccccattgtatcgtttgccaaccgatgcgccaagtaaaggaactctttatttgtgggaatccggccataaaggcactcacagctttcccttggtttccccctttaaaaaacaacccatcaagccccgccatttttcttacaacaggttgtaaccctttttttgcatggatccagaccatatgtcattcctcttaaatactgttggatccaagccaattttcctattccccaccccagtgttgccagggttgtttttaaaaattcaagtttggtatttaaccaactttgggatttgcccttaagttaagtcaaattttttttcatcacaagccattttcttttttcagctcaaagacagatgcatatacaaacatttcttattgaacagttgctttcatatgagctattggccaggaaggattagcagctatgagattgccatacttttctgctatcataacagatgcaaccagcctactatccctcctaggtggacaagcatgcaggttgtcaaaggttactatttgccagctgtctgacctagaattcttggaaagcagacatacccagggacaactttcccaatcacactttgccctaaccctttgcccatcatccttagcaaagttgatcactttcctctctgcaatagcatatgttgtaatagctttcttgaattgcttcttacaactgaatttcatccccaattcaaatttagggaccccttggctcttcttataccttgcttgatggctgccattagtcctcatctccccatcactgccaagttcatcaaatgattcctcctcatcactatctgcataaggggtttcattccctgcctcatcaccacctgtatgcattcttggttcagccttctgaaaaaaaatgtcatctaggttctctagttgtcctgccttaaccttcctcttgacctccttgtaatgtttctctatctcaacagccttttcatcatcatctgattgagcatcatcccctggagtataatcactgtcttcatcactgtcagaaggtgggtggctagctatgggtgtactgtcatatgttggatggttaggaatgggtgcattggcagaaggttgatggctaccacagggtgcactttgacaaggttgatggctagcaataggtgctgaatcagagtggtaaataactatcctcctatcagtttcttcctctgccggttctttacccttacatccactaccatcaacctcatcaacccctttccctttggatacatctatatcaacctccattttcccaccctccttttcactttcaacttctaacttcatttctgcctcccaatcactgtcatcatcagacccattacacaaatcaacaatctctggctcttcaacatatacatctgctatatccaattctcctgtatagtcacacatcagtttgcaagccttatcattagaaagagcacgaagatctgtttgcaaatctttaccaggaaacaaccagtggagcaaagtcccagacatcacattgcaatggtcctttaggtggtccaaaaagttggggcaaagaaacatagtctctttgtgcatatccaaggggtntctattgccagtg

SEQ ID NO: 14147 - DNA, 1854 bp, Oryza sativa
  unsure (1)..(1854): unsure at all n locations
cgcccctgtcccaagggcgaggagagaacactgtttcacagcacccccacagagaggatgtggtgccgtgtgccggcctctcgcgcagggtcttcacccgtagtttttatatggagccttcccatccccccggtgttggggtcaaatatgaacccttaaggcacatgagtccggccttcgcgccttggggagtccaacctcctccataatcccgtgttggatggtcggccccaatccttgataattggtggcaaacacgcaattaaggtcgcttttatagacccaggtttaagcggagaagcgcaatttccgagttgggagggggcctcccctggcgcccccttctgggagaaggggattggcctctcacacgggaccgccgaccattctccgttgcatggacgccggttataaggttacttgcgttccggtctcacctcctcngacgccaccacttattgcacgtaggccaaggcacccccaacgtccacgacatgctgtcaccccacctcactgccgatcgctcacttccctctttcccatcaaccatggtttcgccacgcatggatctgggcatccacattgaagggaagctggatccaaaagtggggttccgaatctagtgtctccagcagcctctgtcaccctggctacctccaaccaccaaccctgcttccagtggcggatctaggatttaggatataggtagtccgacctaattttatttttctaaacacaacaaatctaatgatactaatatgagaatagaatagaccaaatcaccaaaagtttaccatgatatattaataaaatatcttaaaacatcacaatgcacaagagttcaaaattttaaaactgaaaactgaaaaaggtacccaagtacttcgtagaaaacataaaattgtcagcgcaggcagccgggcatcggcggcgacgcactgcagcaagctaggaggcaggtctccgtgactccatttgccagttttactcgactgatcggctcgaagacggctcctcgaggtggcagcacacactgcagcctgcaacactgcatagcagcagtgccagtgcggcgtagcggcgcggtgtgggcgtggggggcgcgtcacgcgcgcacgtgggatagcatcggcatggcgctattgcgtgatcagatgagatgagaaagcatcgctacgctaggggctagggcaagatgagagagatagagtcgcgcgacgccgcgacattctgaatgatcgatacacgcgcatgtggggcatgtgggaggaataggatcgctactttttttttcaatagtcgctatttttttaatagtgggtcgatcgcctttttttttggtggtccatgcaccacccggaccaccctctaaatccgccattgcctacttccatggcaagttggtgctggatatggcaccgccaaggttgagggggagtcaccatgtcatgtgacagcatcttcgtcgccgccttgcaccgcccattcttcatgccagaatcaggacatcagggaagccccgccaccaccgtccttgctcaccgcttgggttccggccgcagctccagcaacagcaaggtagagggggtagggtggtgggtgacgcgaggggatgagtagagctcgcacaaattaatttaacttttccaagggcccgccgtgttttgcaagttactttctgtcctgccatagagttgatttatttgtagcatttaaatctatcaaagagggtgatttgcaggcgcttatatgcacatcatcggcccaagaaaaatcgcattgaatggatcatacttcatcatatctcttatctaccaatttaattagtatagtcaaagccagaaaactttagag

SEQ ID NO: 14148 - DNA, 1589 bp, Oryza sativa
  unsure (1)..(1589): unsure at all n locations
aactgaattgactccncttgaaannncnnnnnnnnagctaaactcacatattatcagtacagtgtagcaatgcactgtggagtaccacgcaccttaagaagtagaagtgcataattaatcgttttatttttagtgagtacgtagttgtcgtcatgtcatcatgtggtcgtcctttcataagggaaacaagatgagtaataaagcagcgtacttgtgtggaattccttcttcccgtccagacacgtaagtgttcggctgtcgccgtcaacccatcagagaagggagagagaggttcgttcagtctttgttcagaagttctagaatgttcaaagagtagccacgcatgtttgaagaagcattagatcgatcgatacagggccttgtttacttcctaattttttttccctaaaaacatcacatcgaatatttagacacatatatagagcattaaatatagataaaaataaaaactaatcgtacagttagagggtaaatcgtgagacgaatcttttgagtctaattagtccacgattagccataagtgctacagtaacccacatgtgctaatgatggattaattaggctcaaaagattcatctcgcggtttctaggcgagttatgaaattaatttttttattcgtgttcgaaaactccttccaatatccggtcaaacatccgatgtgacacccaaaaattttcttttcgtgaactaaacaaggccatagtgggagatgtaaactttctcacaaaataggccattcacgtcagtggctaaataggttgtagccatccaatccaaccccctcatggtaaaattatcacataggtcctttgacaaagttctcccagtatatcccgacttcgacatttttaataatggagcggagccaagccaagccggagtaaaaacaactttcattcaaaatagagtaacttttattttaaaagaaaaccaaactaaagcaacctagacacaaaaccaacttaaaagagcttttttttcaatataatcgccactatggctcactagaaagcaaggggtcttaaatcgggccttgcgacatcgagggcaagtatatttaaatatccgtgtataaattaaaccagtttcaatgccctaaagatggcatgacactcttgaatcctaaacagaggcaccgaatcgccccttctcttcttggcttatctagctctgcctctaccccactgtctcccctttcccaacattgtcgctgctgccactaccacaatcactgcctcgtagagtggccataccaaacgagtagtgaaggagatactaggtaggaggtgaaaaaaagtccacaagtgtgaaatgaacggtggaggcaatgggaggttgtggtgacaacatcataaatagggaaggagagagaaagaccgtgtgtccgggagatgggaatggtgggagagggaggtatgtcgaggtggagttggtgcctatagcaaggatggggatggggaggaggtggtggtggagacttgaggagaccacatcggtagtgtaggcaggaggggaggagatgatgatgtaagaggnntgccantcgatnntcaaggnttcaangctc

SEQ ID NO: 14149 - DNA, 5530 bp, Oryza sativa
  unsure (1)..(5530): unsure at all n locations
cccatcgaagcacagctgtgtcgtccgggcaatgttagttcaacaaaacatttttggtcgggctccagtgtataaaatccggaaactcnaccgccaatgaagggctgtgccaattcaagccggcagaacgaangattgtgcttggccactgacatagagctataacaatgcttcaaggggtgaagttggcttggaggcgtccanagaagtgcacngcacaaattgtnggcagtaagaagncgccgagagcactttggaatagnatgagacagtgcatgaagaagctgcatcgtcggtcacgnncgacatgcaactgcaaactgtgctcaccaagaaacgtgttccattcacacaaatgctgttcctcgagnaggtttggcaggtgagacctgatcaatggctaaatcctatgcttgcnaattaattgaaatgaatnttagaatataagatgtgttaaagttggcaaacatcgaatagacactatatgaagattttgttgacaatatgatgttcgtctgtgactgtgagtcatgagatatgttggcagccgagagacttaggcagaataatttacatcgatatacctgtaactattttgcagggaacaaatttgatctaagtctacatgtttagttattgatcctatattgtttacacttgagttggcaggtttgcatgatatatcacaatgtaatttgtcaacctaaattggatcttacgatatatcattttcaagtagttgatagtagaaataagtgcatgccttggattagatataatatatcagttctagtcttctagaataatgaattatctttaagatgtcagttggaaagtaatatgaactatctattcatgatgctcagtgttgcaacatatactgagttattacttactacactagtaaacacatatagtcctttctatctcctataacttcctgctgtgtgaaatttatgtgtggatgttccatggtctgtacaatcaagtgctaaatttttcctcgttctaatatttacctgtcaatagtttatacttgtgtgccaatatcttgatattgctcaccttttttttttttttttgaaatttagcattgacatgctcaccatgcgttccgattcctgtttcttgccccactgacaatgagaaaaattgcaggagggtgatcctctgttaacagagagagtatgggatgctattgttaaagcctttgcaagtcaactgaaatctgcctttacagcgtcaagctttgtgaaggaaatttttactcttggatacccaagaatgttttcaatgattgagaaccttcttcgagaggattttaagagacaccgatgtaaaaagcacccttccagctcttactcccgtaaggaaaaaccacatgactgcagccattgagatattccagacagcctttctggctctttgtcatagtcgcctctctgattatatcaatagcatatttcccatgtcaggccgtggtataccttcaaaagaccaaatatcaaggtaatttctcgcatccaaaaggaagttgaagttgtgagaactcatgggcatttgcttgctcgtgttctacaagaaattggaaaagttttgcttctcctagcacaaagagctgaatatcaggtattcacctgctactttatagtgaagttatttatttctagtttttcctagggattttgtatgctttctcagtttgtcatgtaaatattagcatatgcgattcttatggaatggtaaatctactactaaactctgatgattttgatttgaaacttgtatatgttacttttacgtcatgacctgtttcactgactgttttgtagattttattctgttaaaaaaacttaagatttttttttctagcagatggttgtagctctatctgtaggtccttattgtgcattggattgttctcttttctcgactaagtttgtgaagctaatcagtcacctcacagacctcaatctatgttcaatatgcactgctcggtcgaccttttcattcacctcaatctatgtacaatgcatttgttggtgcctgtgttattctgttcttaggagctcctctagttataaaagttggccttttcattgagatgaataaaattctggaagttttttttgttagttttgtggttattgggggtcgcagagtgaaataagagagatcttaatctaacccagtgaatgtgtacttgtggggactgctggttgtttccaagaaaatagtgatatcatgttggtttggtgaactaaaatttgtgttcttaacttctgtctcaatttgaagtaaagagagtacagcatagaacttgcattatgaaaaaaatgatgtcctatagtgcactgctgcatgagaaaatgcgactgacgtcttaagcagaatagcagatcatgaaacatggacaacattcgctggtttaagccattctaaaatctacggcatagaagagttggatcaatgtgcctttgctggagagcaaaaatgcacgtacaatctaattatattgtttgctttgctgttggttgttttaccgactgagtactattttcaccatttcctcctatgtgatatacttgcttatttgtatgtgcgcgcactgcacgggttcatttatacacttgtcgtgcagtgcacaactgcaaaatgaccataaattggctgcaggcattgtcttggtttttgtatgcatctgctaggcgctgatgtatattttgcttcaatgcagatctctactggcactgaagcccggcaagttactggcacagtgactccagctcaactgaaaaactttgctctatgtcttcacctccaggatgttcacacacgtatttcaagcattgtgtcaacacttccaaatgttacctctgaaaaactttccaaatcccttgaggccatttatacagtcgcgtgtgattcagtgagccctctattcaaagaaatgtttgatcgtctcggatcatgcattctgaaaatgcacgagcaggactttggaactcatggaatggacgcaacaatggataacaacgcttcagcttacatggaggaactgcagaagtgtgctgtccacttccgtagcgagttcttgtcaaagcttctaccttcatcatcatcccgctcagagaccatctgtaccataatggttagaagtatggcctcaagagtcctcatattgttcataaggcacgcctctctagttaggccactctctgaagccgggaagctgagaatgacaagggacatggccgagctggagctcgctgttggtcagaatctgtttccagtggagcagctaggcgcaccgtaccgggcgctgcgtgcattcaggcctgtcctattcctggagacgtctcagcttgagaaatctccactccttcaggacttgccccctagtgtgatcctccaccacctatattctcgaggacctgatgagttacagtctccattgcagcgtaacaagctcacgccgctgcagtattctctctggcttgattcccagggcgaggatcagatctggaaaggggtgaaagcaaccttggatgactacgagatgaaggtcaggtctcgcggagataaggagttcagccctgtgtaccctctcatgcttcagattggatctgcattgtctcaggccaagggctaaacctgtgttcagttcaacccagcatcacatatgtttgtatcatcatcatgtaggcattgggtacttgagagatcgattgagctttggaatagtttatacaaatgaaatagcatttgcatttgttttttttatggaaataaaggtgttcaaagtacagactctttctcctagctcctattatgttgtgaagtgtgtgatatgattgatcattgtacatctattagtcctgttgttccatctgcctgcttgactacaagcatgggaattttgcatgcgcggcacgctgatcacttgccagttgtatgtatgatctttggtgctaaatcacccgaaatgaaggaattttacctactcatgtgagaactcccagagattccaaagtccaatttgggttctttaaaaaaaattccgtgtaaggcataatgcaattgtttttgtgcagtttttaaggtgtgcaatcggaaaacatatcaatatcgccgttgtgaattttcttttctatttccttgcatctccttaagatttgtgctttatttctctccgtccatgatagtagatggtagtgacagtggacatgtccctaaaatacaagagttagttaaagagggactgaggctcccattggttgctcattttgcctaataagccaatagatagaaaataaaaaataatttataattaaaacttttatagatttgtacgtagcgacttaaaagccaacattaacagaaattacgttaaaagcatctcaaaatcaactaaatcaagttcaaaaatttaaattttggtttattctttgacggtttaggccaaacgatgaggctctgagggagttacacgattttataaacttaataacattaattatttatttcttatattacagattttcagtatatttaacaaggatccgtactcactgcctagtaaacaaaagggatgaaaaatgtatgagcaacataaatatagaaacaaaatgaacatgagtcaaagctactccatcttcatgtcccaatccccaagcaatggatcgatcattcctctctctctctctaaaaaaaaaagaaaaaacaaaataaaaagcaagcagtagatcaacttgccgcggggggagagtgtcagtgactcagtagagagagaggggggcagcggaagaatggggcggtggtggccgccgacgtcggcggcggccgcgacggcggagccgcggtcggtgcagctgctgctgctgggcgtcgccctcgtcgctgcctccttctacgccggcaccgtcttccgctccccctccgcccccgcgctcttactgcccccatccgcctcccgatcgcccgatccttccagaaccccaggtacctcgtctacccatctcggagcgcagggaggtggcgcccgggggtgcctgatccgctgctggctcgcatttttcagttcagttcttggggggaactagaattaggcgcccatggcgttggcggtttgcgttttctggtagcttgcgcaactattgtggcggttttaggttcctaattgtagaaattttcgatgatcttgaattagtgtagaaaggtgattatttgttttgcatggaggactgctcggtttgtttgtaaccaggtgatataacattatgtattagacactgaaaagagtatagttttcacagacagttcggcatttttcagaaaaaaaagggaataaatcggttaggcatttgatcaggaatgactatgcggcgccagtatagaaaatcaaaagagtgcaggccactcctattcagttcataattcgtgacattatattttttagatcttgacacatttctgtatgtcttagatatgaanntcncngntgntcatnncaanngggnttcatgngcgc

SEQ ID NO: 14150 - DNA, 5055 bp, Oryza sativa
  unsure (1)..(5055): unsure at all n locations
tcaattcaatttcctgtgcaaacaaggattccttctacagtcacacatgcattgagtgtttgagttgaccttgttgcttgttccgttacggttgtgttacccatttataagctctggcccaagttctccaaagtcaatgtcttgattcctgacgaagtcaagatggcagtaatgctgcacacttgatgaagagtgcgttgtcatcatgtgctcatcttctatgaccccaggcgtacaacaagacctaaagatggggttaaagatgcaagatttgtgcggccnttccttgcttggaatctccacgcaatactcaaacggcggtttgcaacatcgctcaccgggtccctgagctcacgcagcgcaagggctgcgtttcgctggtcatgcatctttcgcacaagccaataggtccacaagatgtagcgccggacaccgccctggcgaaggtggaccgccaagtcgccgcttcgaaggtagtcgtcgacgcagttgctgcagtcgtggccgaggtcccggacctgtttcatccacgtgcggacctgcttgtcgtgcccgctggcgagatgcgccgtcctggacatgctctccatctcctccttgatgaactccacgtcgctccccatgcggcccagcagctgcgcctccttctggaggaggcccagcagcgagctcacagctccggacgcgagctcggccattgttgcgccgccactccaccgccggctgcccggcgtatgtctggctagctaggaagggtgtgtggatttgtcttttcttttatctttatgagctgtgctggtctttcatcaagattgatctctaatgctttgatttggctgtgtcatggtgcctggtttcttttctcctttattttggtggtggcaaccgggcaagcattatacttccatccaggattctttgagtcttatctttagattagtaccatgtcccttactttagttctttgtttattctttttttgcctttggctgtttgtgtttagcatatattgattctaaacatgacgtacatggagaacgctctacatttaggcttaagtggagagtactcatgtttctatagaaggaagaaatcaacttctttaaaaatggaaggctgctacagaacagaactctccataaaagcaaataatcaacttcctacttttgttactaaaactggaaattcactctcttccaagtatgttaaacttttggatggtttttaaggagctcaagtttttttttttttttggccatccattagaataggatccaatggaggatacaatctattaccttgatggaggtaagatcacggtctacctttttgccctattcttactaccgccctgttgcataattcttggtttaaagtgcgtaagacttgcagagtacagtgaattgtttccgataactatcgaggatacccaagcacatgttggtcacacatatcgagtattatcaggattaattcttccgcatgttattttgtaatgaatggccgaatagctaaataactgaatgatttccaataactattcaagggtacaaaggaattagataactattatgaagatgggaaatggattcaaaacaatatcataagaaattcatatatagaatatttttgcaacaatctcactgtttagaagtttgagaaacgtgcatgttaattcattcatccattaaacaagccgggtcctcacattggtggtgctctcccaactttaatttgttgtgacaacaccaaatggaatacctacatctgccttgatgtacatgtggaagaaacctgcacacaggaaaggaacattgcatcattgcaaaatttttttttaaaaaaagtgatatccaacaccaacacatcctgcagaaggtgaggcaaaataaagatggggacttcctatattcctattttttcgcataaatgagagatcatttagaagccgagacagctcattatctaaactagctggaccgagttgagccgtgctggcttgttgtcccagcctaggcaaccaggaaggcacggtactattccattctttgagtatttctttaggttagtactatgctccttactttagctctctggttatccttttcttgcttttgcctgtctgttacagcattgatttcacatcctctgacaaaggaaaacccatgatttttattgtgacaaattaaaggataatgtgcaagaacagcatccgacatggccctaatgtacatgtggaagaaaccatgcgcgcacatgcacaacgtgaggtaccatgataaggagcaggggaaggccaggttagacagcatgctgagggagcaaggcaggtagctagctcagccaactaaaaaaaatttcccctaccattgctaattttattgatgatctaaagctttgtttcaaagtgtagaatggaatggggagaacacctcacacccaatgggaggggtggccatgcattgatataggaagcacatgtacatgatcctcaattagaggagaatacaaggaaagagacaatacaatacaatctgtacatatatggcaaagtattcctaatacccgcccgcagtcgcagcgggaggctcacggacgcaaaggctggaccgaaaatctgtaaataactgcacaggcaagcccttggtcatgatatcggcgaactgatgtgtagacggaacatggagcacacggacctgtcccagagccaccttttcccgaacaaagtggatgtcgatctcaatgtacttggtgtggggtggtgaatcgggttggcggtcatgtagacagcactgacgttgtcacaaaagacgacggtcgcggtggagatgggagcatgcagctcctggagtagctggcggagccaacaacactcggcaaccgcgtgagcaacggcacgatactccgcctcggcgctggatcgggagaccgtcgtctgacgcttggaggaccaagacaccaggttgtcgccgaggaagatgcagtagccggaggtggagcgacgagtcggggcagccggcccaatctgcgtcggagtaggcgatcagagacccgaccggaccggtaccgatgtggaggctggcggagagtgagcccttgatgtagcgcgggatgcgtttaaccaaggcgaggtgaggctcgtgggggttatgcatgaagagacacacctgttgaacggcataggcgatctcaggacgggtgagggtgagatactggagcgcaccggcgaggctcctgtactcataaggatcggcgacaggagcaccctccgaggcggtgagcttggcgcgagcatcaaccgaggtggcattcagacatgccggctcgctacagaaggtcgacggcgtactatcgctgggacaggaagaggccgttgggtgtgcggcggatagagatgccgaggaagaaatggaggtcaccaagatccgtcatggcgaactcattgtgcagccgagccgtgatgtggcgaagaagatcagcagaggaggccgtgaggatgatgtcgtcgacgtagagcaacaggtaggcgaggcgatcaccgtcccggaagatgaagagcgatgtgtcgaaggccgatggcatgaaacccagctgacgaatatatctagcgaaccgttggtaccaagctcgaggcgcttgcttgaggccgtagagggagcgctggaggaggcacacagcgtctgaagcaggggggtcgatgaagccggatggctactggcaatacaccgtctcatcgagggtgccgtggagaaaggcgttcttcacatcaagttgattaatcggccaggagcgggaggtggtgatgctgaggacgacacgaatggtagagggcttgacgacggggctgaaggtctcgttgtagtcgatgtcgtgttgctgggagtagccacgaacaacccatcttgccttgtgacgggcgagcgagccatcggagtggaacttgtgcttgaagatccacttgccggtaacgacgtttgcgccaggtgggcgagggacgaggcgccacgtgccgttatcgatcaaagccttgaactcttcggccatggcagcacgccagttggggtcggcgagggcagagcggtagttggccgacagtggagaaatggcgttgtgggacaccgagagcacgagtcgatccactggcttgagagaaccggtcttggagcgcgtaaccatggtgtggacttgtgaagaaggtgcgggtgcagccggagccacgacttggggcggaggagtcagcgccagtcgtcgttggtagtggtacgggaatggctccaacgtgccggctggtcgtgaaaaagatgtggcggccggacagctggtgacgacggcgccctccttgaggaagatggagacgcggcagccggctgcatggaacttggcatcgtcccgcccgcagtgtggtgcgctacatgtagtagggcaggtgctcgtcctcagccgagggagcacccgtgggcagccgctgctcgacgttcacagggaatggagcgtgcggctgctcaacaccagccagtggtggagcgaccacagaaggagcagtagcaccctgcagtagaaagtccaaagaggaagcatcgacaagatctcccgaaaatggaaactgtctcatcaaaaatgacatggcgcaaaataatgatgcggcgggtggatatgttgaggcatcgataacctttgtgcgaggaggggtaaccaagaaagacgcaaacggcggagcgaggtgcaagtttgtgggcagcagtggcactaaggttaggatagcataaacacccaaacacatgtaacatggaataatcgggaatcttgcgatgaagaagctggaatgggatggagttgtttactgaggacgatggtcgacggttcaggaggtatgtggcggtggctagaccttcggcccaataggagggtggcatgaaggcttgtaggagagggtgcagacagagttgttgagggtgcgaatcatgctttcggccttgccgttctgtggggaagtatatgggcagtagtcccgtaccagtgcncggccntgtcccatcagagntgcaatcaagggcg

SEQ ID NO: 14151 - DNA, 2533 bp, Oryza sativa
  unsure (1)..(2533): unsure at all n locations
cgggtgttgagcgcccaaagagaccagagacctcctgcgtgaaagagtccaaagagaagaccttccacaattctccccaaaaagaacctttctccaccaaatagcacgtgcgcaatataattatgcgcgggtgtgattattttagagcatcgatacctnttgggcaaggaaggggtaacaaaaaaaaacgccaacggcggaaccgaggttcaagttttgtggccacaagtggccataaggttaagnataagcataaccacccaanacccagtgtaacatggaatataacnggaataccttccaatgaannaagctggnattggtatgnnaggtggtttacttgagncacaatgttcnacggtttcagnaaggtatgtgnccggtgncttagacttgcgagccaaatgagaaggntgcaatnaaggccttgtagnananggtgcaanacaaaggttgttaaagggtcggaaatcatgctttcggcctntggcgtttttgtgggaaagtatatggccagaagacctgtaccaggaaccttctacaagtgagaaagaagtgggtgttgtatttaccaaactcggtaccgttgtcggctgaaaacacttgagncgntggcgaacttgtgtgtgggcatactcaacgaactcacggatatggcgatgaacatgggatttgtggcgaagagaaaacgtccacttanaatgagtaaaatcttcaaccatcactaaataaaatttgaagccagaaatgctcataacaggagaagtccatacatcgcagtgcacaagttcaaaaggagaagaggtactggaagtggacttattaaaaggaagacgagtgtgtttccctaactgacaggcatggcaaagggaattatttgtcttggagcgaggtatggcggataaatgttggagagtggtgatggcaattggacccggatgaccgaggaggcgatgccataacgtggaggaggtggcgaggttgcactgggcggcgatggaaggtgcagcggccaggagggtgtagagctcgccatggctattgcaatgaagaatcacgcgcctggtccgagggtccttaatagaaaaaccaaactcgtcaaactcaatggaacatttattgtcgcgggtaaattgacgaacggagagtaaattgcgaaccagagggagcaacaagaacatgacgaaggtcaaatctagtggtgccaatagggagaaaggaagtgccatttttatcaaccggaatagagggaccattaccaacggtgatataagtgtgtgagttggggaggcgagtaacgagtataccatcggtggaggacatgtgcgaagtggcacccgtgttgagaacccatgaattggggctgtgaatcgtcatttgattgagaacggcgacgaggccggtttggtcccaagccggctggacagaccctgcaggcggcggcgaggagtatggcccggtgaaggcagtgtgggcctgaggatacggcccatgtatcctggcgctgggggcacgccagggttgctgctgtcctgcccagggcaagaagcacatccatggtgcggcttagcgtggagcagggatggagaaagtgctggtgccgaagctgttgccgccgttgttctgtccaccatggtggccgccgaatccactgccgccgttgcccccggagttgcggttgttgcggccgccgttcttgcccttgttcttgccgccgttgccgccgccggcgcggctctgctgctgcccaccgctgccagaggagtggcaagtgcccctggcgcagttggagtaggtggtgttggctgtgacgagggcattctcggactggacctgcacggaattggcgttgcaaagctccttgagaactagcgtgttcctcaccgaggtgaaggacgacaagacaggggcgctcgcgatggtgtcggccgtgctggtgaagcgcgagttgacgccacggaggaggttgaggacgagcagggactcggtgacggggtggccgacgtcgcggagggcatcaaccgcttgtaagttcaagtgccttaatttggttttggtgattaatgacaaatctaactatatgagactaacgtttttatgagcctttctttgaataagctcatttggatatgaaagtaaaaatgatgagaggtattgttttaaccttacacaattctacttggtttttttgtgggatccaaaattaagggagcttcctcatgactttattgactttatgggcaattcggtcttcatatcaaatgatggctttttggggggagctattttatatttgttttatagaactttcctggtttgaaataattttattaccctttttatggttattggggttttttttccaaaaaaaaaaaattaaaaacttgttaacaaaggaaaaggggttgggaaaagaaaaacaattttgggttaacctttttaaaatgtgaaaggttttcccaaataagagggggaggccctatatacagctaatgttggaaaacaaggtcacctctttcacttataggcaatt

SEQ ID NO: 14152 - DNA, 1698 bp, Oryza sativa
  unsure (1)..(1698): unsure at all n locations
ttttcgtagtctttacccggtccttggtgtttggtgtagaccggacttgctagatagacgccgtactatcaagaggggtctatcaagcgagcacgtgaatgatcttgtgccatattagttcatatgcatgtaggtacatttagtgggcttgtctagccaagtgtggtgagttttctcaagtcccaaacaaagagagaagtgggcacatcctataggtttgggtagcctcatatggttttgtccggtggagtatcttttggagtgtgagccctttctccctgagaaaagttgtgtttcttggatggattgttcatgggttggagtagaccggatttgctagataggcgccgtactatcaagaggggtctatgaagcgagcacgtggatgatcttgtgccatattagttcatatgcatgtaggtgcatttagtgggcttgtctagccaagtgtggtgagttttctcaagtcccaaacaaagagagaagtgggcacatcctataggtttgggtagcctcatatggttttgtccggtggagtatcttttggagtgtgagccctttctccctgagaaaagttgtgtttcttggatggattgttcatgggttggatagccctttgaataagctttccatagagtacaagaacgtcaaattacgatatccgagtcaagagatatcgccgttttactaacggctggttggctgaaaagtgaaatgcggtctgaccgtgggccttaggtcggtctgaccggggctgttagccggtctgaccagcgtggtaaggccggtctgaccggccccactggtctgttgcactggtctggttttcggtggcgatacaaagccgccagagccgcaaccggtcagaccgagccgacgacggtctgaccgagcggtggacggtctgaccggccactacactgcgatcagaccggccaggttgagtgggctcaatgattgccctgtaacagctagttttctagccattacaaagtagtccagtctgaccggccactctatggcggtctgaccgtgttaacaaccaaatttgataatctgagtatcgaagaagaagattagatcgatgcggaattgtagacaaagatcgtttcggaaacagagcaagattcggctgaaatccaaatcggctacgatcaaagacagccgagttcgagttggacaaggtagccgattaagccgaatctgacaatatgactcggtgtatgtcatcgggttgagttaatgcgcttcacacggattgccacactcggattaagtcctgaagaaggcaattgtatctattaattaggaatagtctgttagtttcctttttatctttaggaaagtatgtttagtgtccgattatgactttatgttttccttttatctttagaaaagtttctttcttgtcctacaaggactagtatccacccatgggtataaatatgtacacccggggtcattgtaaactatccccacagatcaatacaattcggcgtttcgccaccttttaccttttctactttatttatcatccggcggaaattggcacatgacgcggggctgcatcggttcagttcgatctccggcgaaggggtaagtccaatgttccgttggatcaggcaattgtatcatcttcgtcagcgtcgttcaaggctgcatcagtacattggtctacagangagatctaatggggct

SEQ ID NO: 14153 - DNA, 3185 bp, Oryza sativa
  unsure (1)..(3185): unsure at all n locations
cccaccaccacaaaagaagggggtgttggaaagtttgtttttaaggagagacaaacgtaggttnccataagtgggaaaaacacaataaaaccctctggtggttagaaagggttccgggggttcacacaaagatattggccgggccgcggttataagatgataaattattggtttgccggacgccacaaagtttcattgattaacaattagaggttataggcgcggccttcagccgatgttgctttaccctgaaaacagtgttttcatgtaatttgcagccggttggtttaactggattatattatggtaaaataaactatcaacagccgatggctttatatcataatctcatgggacatatagcggagtgttaaaccctatccactatcggctggtatcggcatcggctgggattgctccatcgnctgtcaagccgatcggctatttgatctgctgttatatatcttgtcagttgcaggatcaaactgactggcacgcccgcatctcatcaacctttggacctgcactggagctaagcagatctcccaggccggtgtgttcgatttttttcgtcaacagaccggcagagcacatagttagggatttcgactccaacggctagttttgatggttgggggtatatatacccactccccagcaacaagggtaaggtttttgcactccattgcattatcttgaacccttgcaagagctctcacacccttgtgtacttagtttatctagtgaggtgttatagagtgagttaagcccatccaagtgcattgcttcattgttatagctagtgtggcacttgatcatccttggcaagcatcctagacttgttactcttggaggttgccgcctcctagacggcttgtggaggtgttgcccggtgacctctccgaggagattgtggaggaggcccaacgccgtttgtgagtggtttggagttcaccaccttcggagtgaaggaagaactaccctagtgatcgaggctagggtagtcctcttcgtgggccggctcccaccttgcccaccccttgacgaagggggcgtgcggtggcttcgtggttgagcggtggagttgagctcgccttaacagggattaggaaaccggcgagtttccgagccttggtgaaaaattccttgtctcttgtctcatttatttgttgcatttacatttgtacaatttacatttatagagacatatttgagcccatatcacctaggtttgcaaaacttaacttagttgcttagttaaccttgcacttcaccttgcctagcaacttatgttagttttgtttaagtgccattaagttttaaaaccgcctattcaccccccctctagtcggcctccttgatcctacaccgccgtcttcatgcactgacaataatcggcgacggagagatcgccttgggtcatggagtggaactcgtgatgcagatagatcgcgcgaagctcctttgtggcttgaaagagggtgtcgatggagatccacaagtcccaagccgattgatcgggcttcatggcgaggtcgaggacgtcgtctgcgacagaaccgaaaagccagctgcggaggcagcaatcgggctgttcccaagcagcgtcngggtttgcgggaggagcagcgtcaagatgatcgaggagaccaaatttccacacatcgagcggaagaagcccttcacttgttgtagttggggtacgaagctcgagagaaattggacatgggacttgacggcgacagtcgcatacgggttgatgaacaccggggcgacggtagaggtggaagacgacgccgtagaggagtcggtgncagcgaaggtagccgagnaagtgnacatggtgaggaaggaggggcgcancagccaggnaggcggcagcgctcggtggacgcagcgaccagaggaagcggcgctagagcagtactagaagaggagaaaacttggaatctgataccatgtagaatggaatggggagaacacctcacacccaatgggaggggtggccatgcattgatataggaagcacatgtacatgatcctcaattagaggagaatacaaggaaagagacaattcaatacaatatgtacatatatgtcaaagtattcctaatagtaagggatcatatatgctacacaggggaatctagatttcaatcacctgaaattttacaaaatttcagtcacttttttgctgccactagatgtgcaacctacggttgatagcccttcacttcagtcctgtcttctcagcccagatattcttaacttgtgaaatttctatacatgtgttgtgtaattcctatacatgtattgtaatctttgtgtactagtggttcgctagagcagaccgacagttgggatcacttcctaacttacaaaattgttcagagaagttggtcaacaaattgcacagaacaaacatttgcatgataagtccatacagttcaaaaaagctatttcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggggccccccggcttttttgtgggcctttggggcgccgggtttttttttttttccataggtcgcccccgacagcttaaaaaatcccttaagtcaaggtgcgaaaccgcccgacttatagaaaccaggcgtttccctgaaactccttcgccctctctgtccgcccttccttaccggaannnnnnccaataacattgggaacgggagttttaaaagtaac

SEQ ID NO: 14154 - DNA, 5319 bp, Oryza sativa
  unsure (1)..(5319): unsure at all n locations
nttgaacaagccctttaaagtgtgcccctctaaaggaaaacccttctaggggagggcccctgttaccctccccaataaatttttgggggaagggcccaaacctataacggccccaagggcgccccctttaactttgccggaaaaccggcactgtgcaaaaagaaggaaaaaaccaaagaacgggccataggccttgcaaatgtaagtgttcacttggtgtaacccacacaccccgcgctgtaaatgcccgttccaggggggttccttttcccatcaggccgtaattttaatgtcccacaaaccccagttaaagggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattcctaatagtaagggatcatatatgctacacaggggaatctagatttcaatcacctgaaattttacaaaatttcagtcacttttttgctgccactagatgtgcaacctacggttgatagcccttcacttcagtcctgtcttctcagcccagatattcttaacttgtgaaatttctatacatgtgttgtgtaattcctatacatgtattgtaatctttgtgtactagtggttcgctagagcagaccgacagttgggatcacttcctaacttacaaaattgttcagagaagttggtcaacaaattgcacagaacaaacatttgcatgataagtccatacagttcaaaaaagctatttcaagtttgataagttggaattgttgccccactaattcatgccattaatttgcctgcatggataaaagtttccaaacctcgtatagtgctccacatcaactggagttccaaaaacatcttctacacaagagaaatatcacttacaggtagctaaatttagacatgttcccaagctccaggggaatgtctcacagtaagtttgtttccctttaaatacctgaacaaaaaaggagccaggaagtcttatagaagaaagtacatttcaggaccctaatgcttatggacagaaacaagcatacaaatatttctctaagtccacaaaacataagatccaatatgtacatttagtaaatgaacaatttgcagaaatttcagataaaataaacaaaactgatatatttgaatttggtttcctcaataatagcagatgtcatgtattagaattgcacaaggatatgaactgcaacaaaatgaaaacaggagcaacagattgagaaggagaacttggaaaccaaaataatttgttcatgtcattgtcaaatatcaacatctgatataaacactgcatcacatgcattgaagctcaaaacatgacttcttatcatcaggtacacttaccgagatccctatttatctttcaagacacgatcaccaggttttagcacctcttccttcactgactgactggtcactagctttttaacgacccaacttctcaagctctttaagctgaaaccataatcacagacagctatcaaaaatagcattgctaggcattgacaaacgatagagattcataaaaataatgaacagtatgagcatctgaacctacgcttataactccaaagaatataaacccataataaacttttggtactaatatacaggtatatgtacataatacttgtgttggtataaagtagttgcatagttgtatgcccaacaggattacttgtcaatactgaagactagtattattacaaaatggaacagcgtggccatgacaacttcaaattgcagtactacaattatatgtgtctctacacttttcagaacaacaaagaaactggaattaaattgcactactaggtttgcacttggggtactagataaagcagagagaaaaaaaaaagggagagcccacattagatacaagggccattgatgaacaacgcagcatttggactatggaagcagaacagcattaagtctgaatcaacaaatctaggatcagatcagccacacgataaaattaggataatagggggaaaaaggtgtttccaggtgctcaaacatcactgcacagtttcttttttttaaaaaaataaaataggcctactaaaattaagccaagaagtttcggaaaccctgcataatccaagcatcactacatgcatgcccagatcaaggggtcgaagtgatccatatccaaagtgattagaagaaactgacaatacgattgagcatagttggtactagaaacgaggtggggggagtaaaccttactgctcaccgtcatcgatcgatttgcttccggatgtccggctccctgggctgaggtccccatggctcggagagtcggagcggaggcagctcccgcctcctccgttccaagctcttctttccttcccactgcctgaagtcggaggcggaggcggcctcgccgacggccgccgcctcgccgggaggagaaggggactggggaggcccgggtggagacgaggaggatgcagatggtttcgagcttcgactgaggtgtgactctctgagggttaggcgcacggatcttgatgacagatgtgtgtaagattgggttatttcgttttgggagtatcacaggcctgttcactttaatacaattttcaacattaccaaattttgataaaattgttaaaaaaaatagctacatttaggttcgtgccaaattttggtaactatataagaaatcctgcaaaaattttagcaagttgccgaaattgccaaaattttggcaataccaaaatttggtaattttttttttcgtcaaagtgaacaggccctaaaaaccaccgcaaacttttttaagttaaaaactataacactagtataattgtattgtaattatattgtaactatattgtaactacataccatatagtttatataaaacttgcatttaactacggtttgattagataacaatgaaatcttatgtataatatgtgtgaaaaaaattttcttacaatttattttatggacaaatctctcgagacgatacgatggtcataaatctgaaagttttgggaccagaaaatttgtgaaagttttctagcaaatccgtttttttttaacatgggtggcgcagttgagataagctggacatatttttcggaaacttcaatcttaactaaaagtattgatgaggtagagaatatcaaggatgtaaaatatcatgtttttcttgtatatatattattattttccgtcggagctgtagaagaatgctgatcgagaaaacaggaataaagtgatccaaccacatcacataatgccacggaaggtaaatcagaataacaaatcactcaataacgtacctgaccctgataaagccaactggcattacacacaacaacaaacggctacaacatttacaactaagacaaaagccgtcgatcgagctacgaaaacaagtctgttattttccaagaaataagaaatccttccaaatagcgttaagaacttgtaccgggggatatgaaaaatttttgaaatacgtgcgcgttgtgctccttctaaatcttaccaacaaacaagaacgaccgcaacatcaacgtctttttgcttcccatagttcttcctcatcaccggccaccattcaaacacacatcattgtggctattcggtcatggccagcgagaagcagcgaatcatagcgtagccccctcacgaactcgggcttgcacggcaccagctccaggtccccagcgaaagattcatggtaagtcttcagaactccaggtctccaaatctaagaaacagcacaagattcagaagcaggatgaatccacaaacactggcatacctgaatatgctgaaaatggatgcatataaacaaaattacgataactctagggaaatatattgggggaaattataaaaaaatgtatcagggagcacacctttgtttggttcacttggtggaaagaagtatgcaccacctattggttatcagatgctacacagaaccccatatcctttgggtcagaggtagaaatatactcccctccatattttaatgtatgaccnncnnggcttnnttncnnntntttttcttcttttcttctttnttcntttttttctcctttttccctcttcctctctttctcccttctttncctcccctcttcttcctcttttctcttttccctntccgcttttctctcctttcttntccctttccttctttggcttttcccctctctccctcctcccttttctctctttctctttccgtttcctccctctctctttctccctgtggtttcttcgcttgccttgcctgtgtcgcttttccgtctttttctccgctttgtgtctcgctctctttttttttctcccttcttcgcgtctctccggcctggctgtttcttgttgtctttttcttgctctctcctctctcctcttttttttctcctcctcttctntgcctggtctcgtttcctctgctgctggggcctcgctgcctcttcctcctcgtgcgttctttctcccgggcgctgctctgtcgccgtgcttgttctcgctctgcttcctttgctcgcttcttctttcctcctgcgggcttattctcctcctctccttcgtgtccgctcgccggtttctcttttcctcctcctccttcttctcgctcgttcctctttctactggggccttcttatcgtgttccgtgtcgtgtttatatcttcgctcctcattataactccagcctctctactttaaaaatctatgtctgatcgtttacacctcgcggttcttctatactcatcagctctgctctattatgtcactcctctcctccgcgtcttctngtccatatctcgtcctctctttactatattcgctcgtggcatatacttacttaaggtcacgcttgctcattatcg

SEQ ID NO: 14155 - DNA, 3774 bp, Oryza sativa
  unsure (1)..(3774): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactagctcaacaaccagcaatcacgccggtggcgggatcctctaggcaagttcctcatagccactgtcctcctccctttagatcctctctctccacccactgatccggccactgtacctcaacaaacatttaacctatttgaagtgatgtgtggtttaagcctaaatggcccaaaaatgttgtagtagtggcggtttagtacactacaagagatcttatgataggtgacgtttcatttacgtcacaaacacataaaatttcgtcatatttcgtaatctgtgacgctcgcgtgacgaaaattcattcgtcacctatcatgcgtctctaaaggcgttctatgacgaaaccttcttttttcgtcattaatctagtgacgatccttctatcgtcataactttgtgacgctcatattcgtcattatctagcctaaaaaacgtcatgagattccatatggcatgatacggcccatgtagtgagcaagctgtttttgggctaggcctttttaaagcccatatagtgaaaaacctattaatgagttaggcatattgtaagtccaattagattttaataaattcagcctaattcatgtatattgaattaaatattgagtgggccatgcatattcaaaaagcccagtaggcccaagcattgcaacaaaatagcatatgggccatgcttactcaagaagtgtcacgcnccgaactagtcccgaccggaactagcccgtgacgctccaaattaacctgttaatcgataccagtcccaggaaacagtgctggtattacagggagacagaatatcacagcaacagaggtctctttattatagagtagatgtacagtcatgttgggctgcggacagatcccgagctcacaactgcattacaaaaggaaaagcggaagccaggacttggaccaatcaacacaggcgcgacttgggaactaagccgaaaccctaaaactcattgtagccggcttgctcctggaagaactcctcatcagcaggatccggttcatcttcttcagcaactggggggggaaatatttatatagagcaagggtgagtacgggagtactcagcaagccatgggaaataagtgtttaatgcaggcttcaaggaaaggctgatgtttttgtaattaatttttatttgaactcttttctgaaacaactaagtgagtgcttctcaaacgacacggatgagacagtgcgtctcatccggtcggagtatgtgcaatgtatcagtctttagaatttaaacaaggttggcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccgcacgacattactaacccggatcacccagcccgtggggatcagccacgtcgggagacctccaagctttcatgacaaggcatttccaaagccgacacaggtttaccatacgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccagtacgtttcccggtccgcggttttggaaatttatttagttcgcaaagaccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctagagcttgatcctcgaaatcctcgcactgcgggtcttcgggctccgaaactacacgcgaaacgggacaactcaacaaacggcgaaaatgaaaccctaataatgacctctaagcgtgccattagatagatctcgagatttgaggaattttggaagttgaacggagtcaaacggatctaaggttaggaagatattgaatttctaagattattggattttttggtctaaaggaaaaggatttaattaaatccttttttggaaaagaaaagaaaagaaaagagggagggattatagacttttcctcgggcggctaaggcgcggcccaagggaattggagcggaccggccgagtttaatgggccggccggcccaaggcggcccaagtgcgcgcgcgcgggaggaaagaaagagagagcgccggtggaccgggctcaccatgcgcggtcccgggtgggacccgcttgtcagcggctcggctcaccgtgcggaggtagtacgcggctcatgcgcgcgggcgggggaggaacncggtgcacgcgcgcggttcccggtgaacgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggagcgaaccacggcgatacggacaaaagcgagcacaccggacggttgctcgtgatgaggggagacgagccaacggctcggatttgccggaggaagcttgacggcggcgaatcgtggcggcgacaaccggcggggagggaagagggaaacggtggcgaggccacgaggggtcgattcccggcggtgagagcatctacgcggtttcgggaactcgatgctagcgtcggattggacggagctacatccgtctcacagcgggtcaaacgtg

SEQ ID NO: 14156 - DNA, 15006 bp, Oryza sativa
  unsure (1)..(15006): unsure at all n locations
ttggggattaaggcaaatttggatttaaaacctggtgtcggataacacatgttatataatcccaagaccggggtcacaaaagcctctttaaatcctggttcccaacttaaagtgccgccctgaaggcttaaatagcccttaataagtgcacaaaaaggcgtttccaagaagagcgtccctcggtggcaaaatccaaagtggggaagggcttcttccttcccctaaaatcccttcctgttcaagataggatgggaagagctcccgcaaaatatttaaaagattaaatagcttgttttccaaataatcaatttgggttcctaaattgccccaagccagtgaataaagattccagacctattcttccgttgccgaccagaaagtattggaaggcagaaagaaagagatgaattcacccatatgtttttaagtggcaagagtgacaaattgctaaaacttcctattgttgggataggaggattgggcaagacaactcttgcacagctggtcttcaatgacgtgaaagtgaaagcacattttcaaaagcatatgtgggtttgtgtctcagagaacttcagtgttcctgatattgtcaaggggataattgacactgcaattgggaatgattgtggactgaagagtgataacctggaattgctacaacaacgtctccgggaagaactgagccaaaagaggtacctccttgtactagatgatgtttggaatgaagatgaacaaaaatgggaggctctaagaacattgctttgttcctgtaaaatgggaagtgcggtggttgtcactacccgaaattcgaatgttgcgtcagtcatggggacagttcctccattggctctagaacaacttagccaagaagattcctggactctattctgtgaaagagcgttccgtacaggtgtggccaagtcttgtgagtttgtcgagattggtacaaaaattgttcaaaaatgttctggagtcccattagcaataaatagtatgggaggcctgctgagtagaaaacatagtgtaagggattggctggcgatccttcaaaacaatacttgggaggaaaataacatactgacagtcctatcattgagctacaaacatctaccttcttttatgaaacagtgctttgctttttgtgctgtattcccaaaggactacgagattgataaggatgatctaatacatctgtggatatcaaatggattcattccatctaaagagacctcggacatagaagaaactgggaacaaggtttttctggagcttctttggagatcatttttccaaaatgcgaagcaaactcggtcccgcaaggaagagtacatatatgggtacaaagatgtaactacatgcaaaattcatgatcttatgcatgatcttgcagtttctataagcggggatgagtgctatactttgcaaaatcttgttgaaataaataaaatgccgaagaatgtccatcatctagtttttccacatccacacaagattggtttcgtgatgcagcgttgtccaattatccgaagtctatttagtttacataagaatcatatgaattctatgaaggacgtcagattcatggtgtccccttgtagagcgcttgggcttcatatctgtgacaatgaaagattctcagttgaaccagcatatatgaagcacttgcggtatcttgatttatcctctagcgacataaaaacactccctgaagcggtcagtgcactgtacaatttacaaatactaatgctcaatagatgcaggggcctgactcacctgcctgacggcatgaaatttatgatcagccttcgccatgtgtaccttgatggttgttctagtctacaaaggatgccgccgggtctagggcagctcagcagtttacgaacattgacaatgtatatggttggcaatgaatctgattgtagacttcatgaactcaaggacttagaacttgggggcaagctacaaatacataatttgctgaaggtaacaaatccgttacaagcaaaagaagccaaccttgagaataagaaaaatctgcagcaactagcactttgttgggactcacgaaatttcacctgttcacattgtcattctgcagatgaatatttgcaattatgccgtcctgaagaagtgctggatgctcttaagcctcccaacggattaaaagttctaaagctaaggcaatatatgggctccaactttccaatgtggatggaagatggtgtgacactgcaaaatattgttaaactcagtttgagaggctctgtaatgtgtgtcaaactcccaccagtgtggcagcttccctttcttgaagttctccgtctcaaacgaatggagaggttgaaatacttgtgttacaggtaccccactgatgaagaatatggcaaccaattagtggtatttcaaaaattaaaattattgtcactagaatggatggaatccttagagaactggcatgaatatgacactcaacaagtgacatcagttacttttccaaagctggacgccatggaaattatagactgcccaaaactgacagcactgcctaatgttccgattcttaagtctttaagtttgacaggaaacaaagtactgctggggttagtgtcaggtattagtaatctatcatatctgtatctcggtgcaagtcaagggagttcacggagggtaagaacactatactatatctataatggagaacgtgaaggaagcactgatacaaaggatgagcatattttgcccgatcacttgttgtcatggggttcactcactaaactacacctacaaggattcaatacaccagcaccagaaaatgtgaagagtataagtggtcacatgatgtctgtgcaagacttagtcctgtcttcttgtgattgcttcatccaacatgaaggattacagtcaccactatggttctggatatcatttggatgcctacaacaattagaaatctggtactgtgatagcctcaccttttggccaaaggaggagttccgaagcttgacttctttagaaaaactcttcattgtagattgcaaaaacttcacgggtgtaccacctgaccgactgtcagcaaggccctctacagatggaggcccatgtaatttggaatacttacagattgatcgctgccccaacttagtggtattccctacaaacttcatctgcctacggatccttgtgataactgacagtaatgtacttgagggcctgcctggaggatttggttgccagggcactctaacaactctcgtaattttgggttgcccaagttttagctccctgcctgccagcattcggtgtctttcaaatctgaaaagcctagaactgacaagtaataacagcttaacctccttgcctgaagggatgcagaatctaactgctctcaaaacactacattttattaaatgtcctggtataaccgctttaccagaaggtctccagcaaagactgcatggcctccaaacgttcaccgttgaagattgccctgctctggcgaggagatgcagacgtgggggagattattgggagaaagtcaaggacattcctgatttacgagtgacaagtgagccgcgccctgtctggcaagatgcagccagaaccatcattcccaaatgcatgaacgcttggcaaagaagagcatcaagttctgggcagccagacaattaatttatactacaaaggtgcacactgttgtccctcgttctctctttcttacccttgccttgctctgttcgattaagcaagtttgagtcttacttacctgggagctacgaaaccatttgttgctgcttttatcaagtcagacattgtttaatcgaatgaattgcatcactctgtttggaggaactttggcatcattcctctcatgttcagaaattttgcaggtatctacgctgaaacattgttgaaacagaatgtgtcttaagtgaatgaagtgcattgcatttctctgctccgaacgtatatcttgacctgctgggatcaaggcctttttgtaacaatgtacaaattgtggatatactgatattgattggagttccactgctcaacactgattgtgtgatttcgaggaattccctctttcttgtcggagttgccaaatatatttctacctctgacccaaaggatatggggttctgtgtagcatctgataaacaataggtggtgcatacttctttccaccaagtgaaccaaacaaaggtgtgctccctgatacatttttttataatttcccccaatatatttccctagagttatcgtaattttgtttatatgcatccattttcagcatattcaggtatgccagtgtttgtggattcatcctgcttctgaatcttgtgctgtttcttagatctggagacctggagttctgaagacttaccatgaatctttcgctggggacctggagctggtgccgtgcaagcccgagttcgtgagggggctacgctatgattcgctgcttctcgcaggccatgaccgacgccgtggtgcgcaacgcccacgtgaatgctacggccggggtctttactatagtggaattttacagttcttgagaaagtaccttgaggtacctaaattttacactaaaatttttggtgccttgaggtacttagtacctagagatatcaaattttacactagaaatatggtacatctaggtatcttatgaaggatagtaaaattacccataataccatgtaagccatccgagggcgaggacgatgcagacagcgtgggagatgaggctaagctgctagagaaatcatggcgcatgcagaaggggcttcatgtgggcatgctgcagggtcactagcctcagtgagggatttagtccttttcttggtgtgcggtgatagtattaagtattcaatctttaacttgttttgttcaatcagggcatgattctccatggtttagattgaaggggatggagtatggcgtcggattttagagattgatcgcctgatgcactactgcacgagcagtggtgagaatttatttgttgctgtactccctttcttattgtgttgtgtgtggactaacgatccacaatctccgcctggtttcccccaattagggcatggttttacacgagctactttgttttatttgaacgggaaccaatattgtttgaatatgctttattttaaagagagaagaatgtgcgttacagatcattgaatcacaatatatttcttacgaataatcaataatattggtataaatttcccagcgtttgataataatttgattgcagttggcctgggcatagctagacgtgaagcagcattacggctgcgattccggagaacatgccctcacggaaaaaacatggaaaggcacaggaatgttggctggggctgtttgccatgctcacgtaagttattcactgagttcttttctttcatgcatttttcaaacaaaattaatgagtttagccaaaaaattaagtacctttttttctatccaatctgtttgattgatgttgcccttcctattcggatagccactgatgcaaatattatttttctctcttggtgtagtgttcaatgtacaataacccacgaaacatagatgataaacaacattaaatgaattagggtgttgttggagaaataatactgatatatgtagctattctgtggctgtgtacatccacttggatgtagaggccaggttatttaatccattatctaagaaaaatgtagctatacattttatcagcagcaaatgattcaatttaatttatatatttccctctcttattttgactcagtatctccaagtagacctcattttcatggtaggaaaccttgccattggtgagctgatttggaaggcaacagctccagctagagtaaagttcgtgtggttggctgttaaaggccggtgcttaacggcagacattctgctgaagagagggatggcctcatgaaccagtctactcactgtgtcagtctgattttgatgattgcaatcatctcttcactgcgtgcgcctacacaaacagagtatggaccttactgcaggactggattaatgtggatttccacccgcccaagtcaccatggtcttccactggccgaatggtggcaacaagcgcgacgtttgtttttcgggtgagctacgggtatgcgtttgattcgaggatgaagatggaagagcatatagtcctttatgacaacgaccctaagtagagttcttctcatggccaaatcctttataaagaaaaatttacgatatactaattctatgactatgtaggcaagatatcacaagtaagtctatgagatgaaacaagatttttcttggccttaggaacataaagaacactttttcactgtaaatctcaactagggatctgaacaacagaattaccatgtgactaatctccatacatgcaccactcgctatatgaatttgatcattgccatgatatttgccacgaactattagcttctcaagctctccggtgacatgatttgtagcgccggtgtcaagataccaattgaaatcaatgccgtagaatgcagcagaacctgcaaacctttcatctatggaacatagtcttcatcgaaacggtactagcaatcttttaccgtgtgtccccttttgtagcaaagttgacacttgggcctgttgtcgacacctcctatgtttcttcgaccaccgctagggctgcctcttcctcgacttcagtttccaccattgtttggagcaccttgtcattgatgggtaagtctgatgcgcgagtgttcgcggtgaccggggcgagcgaactagaaaaaccatcgtgcactttgatgaaaagcctgattgccttcctgttttctttgttgatgtaggccagcccacgatcttttttttagaatggtcaccggggggcgaaatgcccacatgaatatataactgccaacgatcttatacagggcaggtttcacctgcataaatgtgggcgctgccgccggcactgccatcggggccagcatcgccggcggcggcaagtctgcgcgcgcgtaggaggagcggggcctcggcgacggtcgcctcccgggtcgccctgcagagagcgacacgggagtctctctctccaccaggccagcccacgatcatttcccctattcatgttacttgcaagtccaagtcacatgaagttttttaattcttngaagaaaccagtgtaacgatttttagcataaagagttatccgtttctattttccctttaaatttctgagaagtggngggtttttttgagaaaatattatacatagaaactttatacgaatacaactttatacatagaaagcctacgcatagaaaactttatacgtagaaacattcaatgtatatacacatggactttacacacataaaaattatatatagatattttatacacataaactttatacatatatactttatacagataaaatctatgcatagaaactaaaattcattaggtaatagaaagtttttacaaatgagttttaaaacaaatttgcattccacataagcacaaaatattcggatgggccatgagcccgtgaggcccatgtagttggatcagcgtgccgcaacaaatttccgagtcacgtgtccgaagctcccagccacgtgttttcccattcgcgggatgagcaacacgcgaacgttcacgtattaacgttctcggtcattgattgttgtccgcgccacctctgacgccttgttgctgaccctggacacagcttgcgctattagccgaggccaggattctccattctccactctggcaaagtgctagcctctgcttgaagctttactccctccgtttcacaatgtaaaactttctaacgttgttcatattcatatagatgctaatgaatttaggcatatatacgtgtatagattcatttatatatatatatatatatatgaatgtgggcaatgctagaaaatctgacgatatgaaacggagggagtatcaactaagcaaaggcctcactgacggtcacctgatctggtcgcccaacaatggacgagattaccggcacatattcttcatcaagaccagcaatgatatagctgatcagatcatcatcatcaatgggtttgccgatgattgcaagttcattagccaaaggccgcaccttcccaacaaacgtcgtgatgttcatgtcgcccttctgcagcgtggtgagggagagtcgcgtgttgattgttcgtgcccgagtcatggacccgaacatctcttggatcatactccatgccgaggctgttgtgctacatgttgccacttgaacaagtagatctttagtcatggaggaaagcaaatatgaaagcacctgttgatttgtcgaaatccattcatcacaatctggtttgttgatgataatttccttttcgccctccttttctcgaagaatgacaactggagcttgatctgctcctatgagaaccttccaaccgagcaccccgaacaatcacaagaatacgcgccttccatatggcatgatccgagtttgcaatttcggttgcaccggaatttcgatggttgccaaaaaattgaaaatttcgtgatttccgggtttttctgaccaaaattatttgaatttttaacatattgtgactgaatttgaacaaattttgaccaaatttacaaatatttgacaagaaaccaaaaattccggggagatttgtgcttgccggtggaagccgaaatttcgaaccaaaatttcaaaccatgggcgtgattcgattttcctagcttttccgaaaagaaagcagtgattgctggcatgattcttcgagaaacttcgggaaaatgcttgtaatcgggcgttcgactgacacggaaaaattggataccacatcgatgccttccacactgttacatgctaactctagaaagaatcgaatccgtcaactgatatggcaagtttcacgggtgcttctatctgtaatcaactaactgctaactcaattatcgtagctattcattccaaccatgcatatgcatgtgtcaatctttaaaatattttttctcctaaactacttatcaatctaaaatccgattacaccattgtatttattggaattaaatcgttataacaagatatcacatgtttatattccgattaaagaaaaatataagtttcaaactattaatacttcatgtttcatacgctatgtcgatatgtttcagcgcctgtttttactgtgtttcacaaaattctcgaaaataattgccactaccctccatcaatgcttgcatgcatgcattttagcggtctttaaaatgatttttcttctaaactacttatccaatctatgattcgatcataccgttgtattcgttgtaattacatctttacaacaagatatcacacgattatattttgatgaaagaaaaatatatgtttaaatctattaactctcgttgtttcataagtgatagcaacatgtttcaacgtgtatcttcactgtgtttcataaaatttttaatgtttcaattgctgtttttttttgtttcaccatatataaattaatgtttcacatgttgatcagctgcaacattttgaccgttcgatattttttgagatatcggatgtccgattggtagtattctcccaaactttccatggctttgcttggtgatggaggtagatcggtttgctctgataccatatcagggaataatagggggaagcgctgaaccctgataggggccgcacctttgttgatataggcaggaaaagcctttgccgtggcgcattacagagggaacggatcactctcaacaacctgagatcaatccgtattatagatataagatcaaatggttaaatgtgataatataaaccttatctccaataactaacttatctaacacggactgcgcgtgctcaatattgtctccgctttggttgcctccacccaatccccctcacactctgccggcggccaaaacccggtgttggccggtgtggcggaagctgctctcccataagacagccggatgcgggcgcaagaaacttcacggagcagaggaatttgtctcgatccggcacagctatacagtcgaagagatatcgggcttgtttcgtttgatgccaatttttatcctactaaaattttggtaacttaaacagcgacacatgcatgtttggtttgataccaaattttggctactatagttcaaattcaatgctagaaaatttggtagtgccaaaactttccaccaagattttggtagagtaaaattgactttaaatcaaataagcccgtcttcagcagcagccatcggaaggcacggctagctccacctccgaaggtaagctcgtagattcccagcccgtgaacagaaatagccactaataattttgataggcactaaaataagcaaataatagaagcttagttggtgttctgaattatagccacctgcggcgatacaaagataaattcaaagtcttggacgatttatataatgcacgacatgacagcctagtagggcattataatgcacaaattggcactcttgcatatattttttttccattttttctatggacgtccttaggagaggaaacttgctggaattgtttgtttaggtgaaaccatacatgctgctgttggtttggtttaattcggttgctgcagtgggcggatgtttatcttctccttctgatctggtgctaggctgatgcctgctgtgatacctcagctgacatatggggcttacactgagcatctttagcaacttgccagcttacactgagcagttgaccacttgttgtttgattgtatgatgtgattatttgaaatttgaagcgcgtcaactaacatgatgtatctaatgcacccattgtcttaaacaacccacccacttttttctaatggaacaaacagctcacttgcttcttctcattccattatcagtctccttcaactccaactcatctttgtgccttggatggttttttccaaagacttaactcaaccagctacaccatacgctcattcctcaacccaccattaattgtcctccaatcctttctgttctgccaatactccattgatctctgagctttgagccatggcggagttactatcggctcttttgcctgccctcctgaagaaagcaggtgagtctctcggcacagagtttagtttcatcgggggtattgaacgacggcgttcggagctgtataccttgctgcttgccgtcaaccaagtgatcaatgatgccgaggatcaggcatccaagaagcctgctgtgaagtcttggatcgcaaagctgaagctggctgcctgtgatgctgatgacgcccttgatgagctgcactacgaggagctccgctgcgaagcgctccgtcgtgggcataaaatcaatactggcgtaagggctttcttctcttctcattataatcctttactgttcaagtataggataggaaagagactccagcagatagtcgagcggattgatcagcttgtttcgcaaatgaatcgatttgggttcctaaattgctccatgccagtggatgagaggatgcaaacctattcctacgtcgacgagcaggaagttattggaagggacaaagaaagagatgaaattgtccatatgcttctaagtgccgagaccgacgaattgctaatacttcctattgttgggataggaggactgggaaagacaactcttgcacagctggtcttcaatgacgtaaaagtgaaagcacattttcaaaagcatatgtgggtttgtgtgtcagagaacttcagtgttcctgttattgtcaaggggataattgacaccgcaattgggaatgattgtggactgaagtttgataacctggaattgctacagcaacgtcttcgggaagaactgggccaaaagaggtaccttcttgtactagatgatgtttggaatgaagataaacagaaatggggagctcttagaacattgcttggttcttgtggaatgggaagtgcggtggttgtgactacccgaaacgtgaaagttgcatcaatcatggagtcaattagtccattgtgcctagagaaccttaacccagaagattcttggattgtattcagcagaagagcttttggcacaggtgtggttgagactccagagctcgttgaggttggtaaaagaattgttgagaaatgttgcgggcttccgttagccataaagagtatgggagccttgatgagtacaaaacaggagacacgagattggctatccatcctttgaaagcaacacttgggatgaagaaagccagatactgccagcgctgtctttgggctacaaaaatttgccttctcatatgaaacaatgttttgctttttgtgcagtattcccgaaggactacgagattgataaggacgatctaatacatctttgggtatcgaatggatttattccatccaagaagatgtcagatattgaagagaatgggaatcatgttttctgggagcttgtttgaaggtcatttttccaaaatgttaagcaaattggatcaattttccaacgtaaagtgtacaggtatgggcaaagtgatgtaactacattcaaaattcatgatcttatgcatgatcttgcagttcatataagcggtgatgagtgtttagctttggaaaatctggctaaaattaagaaaatacccaaaaatgtccatcatatggcttttgagggtcaacaaaagattggtttcttgatgcagcattgtcgagttatccgcagtgtatttgccttagataagaatgacatgcatattgcccaggacattaaattcaatgagtctcctttgagagtagttgggcttcatattttcggcatcgaaaaatttcctgttgaaccagcatttatgaagcacttaagatatcttgatttgtctggtagctacataaatacactacctgaagcagctagcgcactttataatttacaagtgttgatactcaatagatgcaggaggctgacccacctaccagatggcatgaaatttatgattagccttcgccatgtgtaccttgatgactgtgctcgactaacaagcatgccagctggtctaggacagctcattaatttacggacattgacaaagttcgtacctggtaatgaatctggctataggattaacgaactgaatgacttaaaacttgggggcaagcttcagatatttaatttgattaaagtaacaaatcccatagaagcaaaagaagccaaccttgagtgtaagacaaatttgcagcagttagcactttgctggggcacatcaaaatctgcggagttacaagctgaagatttgcatttatatcgtcatgaagaagtacttgacgctcttaagcctcccaacggattgaccgttctaaagctgaggcagtatatgggcactacgtttcccatatggatggaaaatggaatcacattgcgcaacattgttaagctcaaagtaacggactccataaattgtatgaaacttccatcagtgtggaagcttccctttctcgaggttctccgactaaaagacatgaagaagttgaaatacttgtgtaacgggttctgctctgataaagaatgtgatcatcaattagtggcattcccaaaattaaaactcttgtcactagaacgaatggaatccttagagaactggcaggaatatgatgttgaacaggtaacaccggctaattttcccgtgctagatgcaatggaaatcattgattgtccaaaattgacagctatgcctaatgctccggttctcaagtcgttaagtgtgataggaaacaaaatattgattggcttatcgtcaagtgttagtaatctgtcgtatctatatcttggtgcaagtcaagggagtttagagaggaaaaaaacactaatctatcactataaagaaaacctggaaggaaccacagattcaaaggatcatgttttggcccatcacttttcatcatggggctcactcactaaattacacctacagggattcagtgctctagcaccagaagatatacaaaatataagtggtcacgtgatgtctgtgcagaacttagatctaatttcctgtgactgcttcatccaatatgatacattgcagtcaccactgtggttctggaaatcatttgcgtgcctgcagcacttaacaatcgagtactgtaacagcctcaccttttggccaggggaggagttccaaagcttgacttcattaaaacgactcgacattagatattgcaacaacttcacgggtatgccacctgcccaagtctcagtgaagtcctttgaagatgagggcatgcataatttggaacggatagaaatcgaattctgctacaacttagtggctttccctacaagcttatcgtatctgaggatatgcagctgcaatgtacttgaggacctacctgaaggactgggttgcctgggcgctctaagaagtctgtcaattgattataacccaagactgaagtccctgcctcccagcattcaacgtctatcaaatctgaccaggctctacctgggaactaatgacagcctaacaacattacccgaagggatgcataatctgacagctctcaatgatctggctatttggaactgccctagtttaaaggctttaccggaaggtctccagcagaggctgcacagcctggaaaagctctttattagacaatgccctacgctggtgagaagatgcaaacgtggaggagactactggagcaaagttaaggatattccagatttacgtgtgacaggggactaggggagcagcattctgcttggggagatgcagccagagccgtatatggctgaatattgtcaaaattcagccagagaatttaacgatattgatgatgaatctcacaaaattcatattgagaatttaacgatctattgatatggctgaatatatatattgattggttaaagaaaatatatacattggttagtcttttcaaggaaaatctatgtagcatgnntttngcagggtcctatcagngggtcatcatcaca

SEQ ID NO: 14157 - DNA, 3195 bp, Oryza sativa
  unsure (1)..(3195): unsure at all n locations
nattgcgaaaaaaataattttaaaatagagtttggccgagagtcctattaagttttcccacagttttaccttacatagcttaaaacataggttgtatatatttatgaaaataagtattattccagagtttatgggattcaaagcaaatgacttcaagagttaatgttccagataagtaatctgtagttcaaaataaagcaaaacaataaatttttacctaaagtaaacctcaaatatataacttttttatcaacatgatcgttnaaaatttggcattatcaagtcttttgttgcatttttttaaatatcaacagctgtgttagacccccgcaaaaaaaaaaaaacagttgtgttagacatttagcatatttttttacttaatatcattagactaacagggacggcccttaattaatggattatagagatatatctatttctacctagaaaagagaggaaatgaaatgagcagagcttatgccaatgcttgaattttttttattggagattgaatgctaaaatgcatattaaataaaaaaatatggaagataaacactgaaccttggtttacttggtaaattgatacattaacatcacattctccttattttcttttgagttcttgtacccttgacccttccacatagcatggattgtttgattcacttgaagcaccgtatagcggcgatcgcccttgttagttgttgtttccacaatgctgttgcggacacaatcctcttatgctgtctttggaccgaacagagctcacaatcctccgcaacagccacaacggggaatggctcgtaattaaataacgacgacgacataaaagttgaatcaaatatgtgaataagttgcttttaattttttaaattattaaatcctgcacaaaacaaaactaaataacccaaatactttataaaaattgtactttatcaaatattttgtactaaccatctttctggactttacggcccctttgatttaaaggaaattcataagaattttaggggatttcattcctataggaatttttcctatatagccatttgaatcaaagaaatggatcttatggaatcctatgaaattcctatgtattgtctaatgccatgcaagtttttgaggaattctaacatgaggtaaaatctcttggaaactttcctttgagtctttatctctcctctaattcctgcgtttttcctgcggtccaatcaaacgacctttgagtcaaatctcttggaaacagaggattttgcaatcctctgttttacacttacattcctatcaaaatcctgcgtttttcctattcctatgttttctcattcctgcgatttaaaggggccctacattgaaaaagtgttttaattagtgttacgtgcttaccctgcacgaatgtcctggtaaatagattcggtaactaattaataatcttgtgctacactaaataaaacaggtgaatacttaatctggtatatgcgagatgtgtgaacaattttaaggtggcacgtgataaaggataggagatcaagggctggtttgaggcctaaattgcccttgcgaatatttggcaattttaatagtgtttagtatctatttggtttgaagttaaattttggcatgtctaagaaagttggtcattttaatagttaacttagggcttgtttggtttgataccaacttattgccctatcaaaaatttgtaacttcaatagtagcaaatgtatatttggtttgctaccaaattttgctacaatagttcaaattcatcactaccaaaatttnaaccagatcctctggcgctcgctacgtcagagggacgtccaacgtctctcgtgcgtccattcggcatcgtttcggagtcgagcgagcacagcagatgggctcggcccatatggcagaaaaaacagcccacgcggtatcgacgccacctccgagccacagccgtcggcgccgctaggaaacaaatgggggaggggaggcctctgcgccatcggcgtcgccgccaccgccgcagcctgcaccttccgagtgagggctccttcgttgccaccttcctcttcccacccagcaaaatcgggatggctcctgttttcccgtggtcttcagccgctcactgcagctcgtcgtctcctccggcgcatgcacgggtggagtggagtagtagaggaccacggaagaagcccctcctctcatcgctgccctcctccccatccctcgccctgcgttctcctgtttcatccagcgtggaggtcgcggctgcctcgacgacaacggcttccacggtggtgccctcgcggagtcttttgccaccacccacctcggggctctcatacacctaggggtgggcgttcggtcagaccgaaaaattcggtctcggtcttcggttttcggtcagttcggtctttgcaaactcaggatcgaatttcatcccaaaaaatttaggaccggcaaattcggtctcggtgttttcggtttcggtctcggtctaaccgaaatttttcaggagaaaatttggaatgaaaaaaaaatgacggaggcgtcgccggcgcggtggaggacggaggcgtcaccggcgcggtggagggcggaggcgtcagccacggcgctgtggaggccggagagcggaggcgtcggccgcggcgctgtggagggcggaggcgtcgaccgtcgcggttgtcacaccctaaaaatcccaaatatataaattgttgtctaaattggaattattagaatttattttaaaagcctagaagagaagatctggttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagtctcttttggctttgggccgaaagtcggcccaaaaccttctctctctctctctccccggcccaagccggcccgcagtcgcccgcccgtgcgcgcgttcgccgctgacaggtggggcccgcctgtcagggtcgtcgtcttcctcccgacgaaaccctagacgaaccgcgccgccgccgccattccaaatccggccgcccctttccgtttccggtgaattctttcagcgcgcggggcgnctataccaggggtctaatctcgtc

SEQ ID NO: 14158 - DNA, 1472 bp, Oryza sativa
  unsure (1)..(1472): unsure at all n locations
agaaaaggacccggtaacccttatattttccctttgggacactgttaacacgttgggaaaccgggattgggtttaatggggtggttttcttcccccaccctaactcttatttggttccggttcccgtggcctttcccccgccctccttgcccaaataagggaccccgggttctccggtaacggttgcaacctggcttggtctctttggccgtagagcccaagccctgtggacctagggccgccgtgttcnctgtcgctcaaccgggggtggtggtccctctagtcgtcgccgtggctcggaaagaccgccgtcgtgggtcgcgttcgngtcacggtcttcgtcgccccctccattgttgctgtagaccgccggagccccgccatcgtcgtcaagccgaaggttgccgccgcttcttcctcgacgccgtcgccgtccgttgatcttccgccgccgttttggtcaccggtgagttcgccgcgtcgctttctacgtgctggtgccctccgttcgtgccgtcgcgccgtcgttcgccggcgagcttgcacgcccgagccgccgccggtggtgacgtcaccgctgacgtcatcgtcgtcgtcccccgtggtccggtcgtggaccgatggatcttggccgtcagttttggatggatggatctcggccgttcgtttctgtgagccgccccgtgcactcggtccaccgcaaaccctagccgctgacgcaataaacccctttttccttttcaaaaataattcattattgcgtcataattcaattaaaacccatataagtgatttaatccgatttaatctttgaaaattcataactaattcatcttagctcggatttagttggttcaagtctctaattttttctaaaattaagatctacatgttaaaaatatccacatgtactgttcatgcttgtttatgtgctgtttggtgattttgctcctttctgtttagattccgacgtttccggagagtccatttttgcaggagaagaatttgaagagttccaaggccagcaaggcaagtcacacagatcccaaacatccctttgagcatgttgatcccgtttaaagctattgtttctattcaactattgcatttattttcgaatgtcgttgggtggaattaacctattgattgttatagtccttttgttcttgattactttattccttgataccttaggttattataacttgactagttgggctttatatattggttcagctagatattagatacgattgcttagccatgcttagaaacattagcacactattgggataacttatgactcactattatttaatgatggcttaatgatagctcatgatggtcaatcgtgattgattaattaattaatttgccaactaaaatctgataatgatgggttgtgaacacatggttttgatggtcgtgctcatgncngtgngnnttcgcgaggggaattcattggncacagt

SEQ ID NO: 14159 - DNA, 2269 bp, Oryza sativa
  unsure (1)..(2269): unsure at all n locations
ngcgcccccctctagtgcttctctatgtggggcaacagaaaagagcccacttcggtgtggcgctcccacctttttagttttctttcttccgctatatagcacgagccataatatgttgggcctccaccaaaataatttggcctgtgtaagagttatccgcccctcctctccaccccaacaatgaaggtgggctaaaaacgcaggtgcgcccttttccttcaccccccaaaaaaaggttgggtataaaaggtgcgcactttaacacgaagaaggctttgtttcaaccttaccttcccccgcaaaaattgggccactttcagagttttcttggtttccccatggaagaagaattgaggactccctccatttttcttctttggaagtttttgttgagggcttttcatttggagacagccaccattgcccttccacaattgtcagcctccacaaatccaggttgtgaagcttttggaatggggaaactattgctttccggttccactttgagcggatcccaccttgttctgtgcaaacttttggctcttccaccaaccgttgccatctcctggttctccattggtgcgtgcaatgacatatatgtgttaattgttaacttttgtttccggttaaagaataactttggaatgaatattttttggctttacccttgctctttggagtgtttggtcctggattggcttgtagtgtttgtggtagtcaggctgccaaatttcctcttcttgctgtgagcagaactgcatagtgtgtttgataacactcatctgctggcttggtgaaggattttgctgttgagaacccactgtgccagaaccactagactgatgctttgaacaactgcttttgttgtgcccaacttgcttgcacctagtgcatctaattacagtaccatacttgggcatcttggttggcttgggtggctcatgcttctccctcctcctttcagtttttggccttcctggcatcttaatgtatccaggtgcatttagtggttccctatcatcctgtggccaagcactcattccttccaatggctgaaggcaatgcacatatgtgcttctaaatgcatccacatagtaacaaggtgcaatatagtcatctagcttatttgttctatagaatatgcatgatatagcatgagggcatggtaatcctaagagctgccaatacctacaagagcactccttcttgtccaagtgtactgtaaacctatggtcatggtgcttaacctcaaaactatcacctccattgcaaatagcatggcaaaaagctgattcagtgatgtaaacattaagttttttgagaattcctgggcatacaacagtagtccacttagcaccagctgctttttgatcattgatcctaaccatgacctttctccaaattgtctcaagcattgtgataattggatgaaatctagattctaatatccatctattgaaagattcacataagttattgtcaactgagtcacagttagaacctaacctgaaccaagctctactccaatgctcaggatgtgtgttcagtatagcttgagctccagcttgagtgacctgtgcaagtttaaccctagcaagattaaatagtattatgcatggagcttttgcacacctccagaacttcttttggaactgcttctcatggaaatgccttttccaattggtataaatgtgcctagcatagttcctatgctcagcctcatgtgcccatttcttcacagcattaaggataccctgcataccaaacagaattgcaaaatttagtcagacagatgtagtgaaaggtgacacaacagaaaattaatcagttcaaagcaaatcaagggattaaatacccaccttttgttgatctgaaatgaagaccccaaccagttctgtgcaactttgattaccacaaagcaattagggacccggtccattctcattggtttactggcaacactgcccagcttgaagaaacatcggatggtggcatttcggctttagacacaacaagttttcattggtttccccttggaaaaacaatcatcaggcccacacttttctaaaccagattgaaaactttttggttgcttccaaaaaaggtccaaccttaaaaacggggggaccagcaaattcctttacaaacaaaaggttccaggtgtttttaaaatcaattggaataaacaacttgttttgccttattaaaaaatttttttttaagaacatgttttttatttaaaaagggcttaaaatttcttttcacgggt

SEQ ID NO: 14160 - DNA, 2265 bp, Oryza sativa
  unsure (1)..(2265): unsure at all n locations
cgcccttgaattcacntctaattggcnnntaccatnncctatatatatattgatgttaagaaatctagatataaatatggaagatgttagaatgacttacattgtgaaatggaggtagtagctagcaagaacaaacaacaaaaattaaaaaggccgataaaaaataatctacatccggagaggctgcaccgttgtagcggcattacgtcgaacgccaccgccgccggccggtgcaagctagctagcctcaactcagtgagcgccggacggcttcgctatccacatccatcgccgccgcattgtccttcagatcacatccccggaggcccggagtcagggggaaaagaatgaggaactccggcgtagggaatcccggcgtaaccgcaagcggcggcggtgcctgtgccggtgcctgtgcctgcttctggtggtggaatcccggcgtcagagggaacagcgggaggcacaccggcgacggcgtaggttcctctttctccccgccgccgccaccgatgatcgggtcgtcctcctccttgctccacccggccaccttcgagttcttcgacgacgacgacgcctcctcctgctgccccggtgttggcggtggcggcgaacgattgccgccggcaccgcccgttgctcctccctctaacgccgccatcgcgttcgtttcgattgcttcctctccggcgatgaataaagtggaagatgaactaaccgaaagtacttacacattacattatctctacgacgtggaaggagttttatatagttatctttgcgacgtaggagtttgagtcgagttaaagaaagtatagtgtttgagattaattcgagtcaggtttaagatagactttgactttgattttcacttggttaagtttattagcttctgcaaattaaattgaatttgatattgcaaattacaaactgttcgtagattttattttcaatttttgaatcttttagttttcaattttaaaaatcaactctctcaaattttatttgaaaattctaaactttttgatcactagcttggcgaacaacatttgttttgtcacgccaccattactggcatggcaaggatttttccatgtcggctaggttggtgtggtaaaataacactagcacagtcaccattggtggcaggggtgaagctaggataaatggtcaccggggtcagtattaaccagggtttatgtttttgatcaaaactaaccagaaatcatgtaattttgatgttttgccgtgggacgaaaagtatattctgagtgaaatttcgaatgttttttgagacttcacagtaaaactagatcaaaacttattaaaatttggtaagaaaaatgtcatatcgctacattggaatccaacactaaatcggaaatatgtcatctagtttgtaattaatgatataagaatatacataatacaggacaaaattaatgacaatacattatgataaaatgaaatgtctacaaatctattaaaaactatacattattaatttgtaaaagacatcaaatgcaccaaagatcatcaaaaccactaatttcttgccttccgttctgctagaaataagatgatactccctccgttttaggatataagatgttttgactttggtcaaaattaaactactataagtttgattaattttatagataaaagtagtaatatttttaacccaagataaatatattataaaaaattattcaattatagatttaatgaaactatggtgatgttgtaaatattactaattttttctacataattagtcaaacttacagtagtataagatatcaagatgcgcaatgccggtgcgggacaaagtgctcgaaggaatacgatgacgcaacaagagaaactcgtggagttgtgggcttccaatgttatttttggatccaaatcccaatcgtatatgtatattcggctaatgtataaattataagtgctagctaatttattgtttgttagtaccgttcctagtcgctatttgggttttgacggaagaatcaacaatattaccggggtctagtttttctcttcactcaacaatattaccggggtctagtttttctcttcactggggtcatggatggcaaaataaagaagggtaccagaggttcgcaaaagatcgtcagggtcaactgacccctatgaacgagtgtagcttcgcccctgattggtggtgtgacacagtaacaacgttgtttcgaaatgtcaccaagccagtcatagccattcganaagaattcaagccat

SEQ ID NO: 14161 - DNA, 1304 bp, Oryza sativa
  unsure (1)..(1304): unsure at all n locations
catggnaataagacccgtgcttacgacgcncccgncattggcgacgnnttctttcttccgcttggtcgggcatgggaggggaggatgccggaggcggatgcgagctccggggtctctcatggccaccttgctcctgaccagcaccgagttggtcaccccctgcacgttgttgttcacgtagatgttgatgctgcagcagcagctgccgctcgccgccactgacatggtcgcccccgtgctccggttgctccgctcggaggagcaatcgtctgcaacacccatcgccggcgaggtaggccggtcggaacggacggaaggttgatttctgaagctggagaaaacaagatctgcaacctgcagggatgcagtgcagcagcagtttcagttatatttggcatagttagtacgttgctgcatcaccaagaaaagcatagcatatgctactacgagcacagctggggaatcacactttgcctctgcggttgggctactccccaggctccagcaatggatgtcaagaaagagcgggttaattacatgtcgctttgcgcttatctttgtatagcgtcctaacatgacataggcacatagcaaatcaacggtcatttttgtgttctattgttgaataagctgcgcgatagaaggcccatttcagttgtcaatgatattactgggctggactgtggatttggagaaggtcagaaggctataagaaaacgccagcccattctgctcttctagtcctttctttccccttcacgacgttaagaacattgtcgttttttattcaaactttgaagcatcgccagtaaaatctcgaagcatcacacgaataaaaataaaaaagaacactttgaagcaccaccagtaaaagtttggagcatcaccagtagattaagctcatgcgaagtgcaaactagggtcggcacaacattaatatactttggatccacatctgtaaataaaacacgaggctatcgactcaaatacttagtactcacatgctgcagtcatacgggccgaacggctagctgatactaccagtaaaccgtgttcaacggaaggtagtactaatgcgttaggatgagggcaagcaagttgaacttaattaatcacagtactctacattttctcaattcatccgtgcacacattttatacttgaattcaaacagaaccaaacacacagcagcaaacatttgaactaaaaccaaaccaaacggtacatacatatgattacgaacgtcgatacagagaacagaagtttacatacggagagtgttgtaacaaacagtgtctactctg

SEQ ID NO: 14162 - DNA, 968 bp, Oryza sativa
  unsure (1)..(968): unsure at all n locations
atgcgcttttgaaattctactttcaattgccagtatattagtttaatgctgatgctctcctttttttaatcttttaaatataatttgacatggtagttttatacctgattgacacaggctagggaatatgacaacaaacagtactggtgatctccgctcggcaggagtggtccaagttttggatgttggatgtggtgttgcgagcttttctgcttaccttcttcccctagacattcatactatgtcatttgctccaaaagatggccatgagaatcaaatccagtttgctctagaacgtgggattggtgcaatgatctctgtgttggccaccaagcaattaccttatcctgaaaatgcatttgaaatggttcattgttcccgttgtcgtgttgactggcatgaaaatggtaaggtttacaactttaaacactgtttgtgtcaagctatgcagccacatttgacttattatgactcttgagattttgattgggcaacatagttttgtgggaacattcagctatactatgctggtgctattcagctataacaagttcatctaaaagtttagttgctctcaagttaaaaatctctgttctacattggtgctcttcctaaaatgcaatgatcctttgtttcaaaattttaatctgaatacataattcatattttgctgtatgacttattttcagatggaatattgctgaaagaggtagatcgtcttctgcggcccaatggatattttgtatactctgctccaccagcttatagaaaagataaggactttcctgttatctgggagaagttaatgaatttaacaacatcaatgtgctggaagcttattgctaaacatgttcagaccgccatatggatcaagcctgaagatcaatcctgccgacagaaaaatgctgatacgaaactactgaatatctgtgactcgtatgataattctccaccttcatggnagaatc

SEQ ID NO: 14163 - DNA, 3921 bp, Oryza sativa
  unsure (1)..(3921): unsure at all n locations
cctagatatcaaccctcccgaagataatttttatcagaacccgtgaattttgggctcgaaataatattccccccttcagagagaaattccctttaataacttgttgagattgacacagagcacagtcatattcgcaaaatttgcttcccaacctgacccgctttctttttattccagatgttggaagatataggtcagcttctttagtctcacttaatatgtccaaatgccgcagagtttataaataaagcaacttttggtttttttcaaatggacaaccattcatcggtattctaaaaagtggcaaaccagggcttttattcaaaattcatttaaggttagtgttattgacatttggggctagacccatttgttggtgacatagagtgctccttccagactaaggctcatgatttaggggttgttttggacttttggttccttggaaatttttatgtccttaaagctatttcagcctaagtcgggtgacataaaatctactatattttttatctcttacctaattatttgggtgattctgaaggatcaatggatagtttctgtatacattacaattttgaactaggaagcgctgttaatgaagcataccaatctgtcttgcattcatcaattttgaagttctctaaacaactatatataagcttataattgtcattagttcaactttttcgagtactatttttgcaaatctgatgggagttactctcaaatatcaaatctgacttttgccttgagtggcatatacatgaatgtaacctgtttgctgaaacatgcttgataggagttactccagagaagttcgcaaagaataacaagttctggagggaccaggttagcatgtattggtcatttcttggtgttgagaagactagcatccgaaatgtcatggacatgaatgctaatattggtggatttgctgtggcactaagcaatgatcctgtctggattatgaatgtagtaccccatacaatgagcaacacattgcctgttatctatgatcgtgggttaatcggttcttaccatgactggttggttgtttttctggaaaaataaacttttcttttcattatttgtgatggaactaaatccatctatgctgcaggtgcgagccattctcaacatatcctaagacatatgatttgctgcatgctttccacatcttttctcattaccaaagtcggaaggaagactgttcattggaagatatcatgctagaaatggaccgtatcattcgccccgaggtaaccatgccttgtattctactacagagtcaaacttcaaacatagatattattatggtcacagaaacgattttttaatgctatttgtgctagaacagaagttatgctcattggcatgctatgttcctcagcaaatcctagctctagtcatcaagtgttttggcctatcattattgatatatcataaaatagagtagaaatgccttatcagaatatctatatttatcaacaacttgacttcagtgcaaacgtaatgattgatgttttatcgctttgcatagttaataaatattttcccaattcatttttagtaatccacaaaagagattggactgtgtcccatgattctcacaagctaattactgacaacaatatcagattggtgatcactgcagaataaatagtttatctggagaaataagataacatgttatgaaattcaatgatagcatatccttaacctaatgatttgccattcatattattatgaactgtaagctaacagattcacgattcagacattatcttgtgtaggatcaacttttgtgtttttcaattttatattgtttattacataaatatagtttatagagaagatccgtgatctgacaaaattattaatatacagggttttatcattattagagatgagaatgccatcttgtcaggaatcaatgatcttgcaccaaagttcctttgggatgtcaccacacatatgttggaaaatgaggaaagcaagccggagaaagtcttggtttgcaggaagaaattctggtccatcgtttgaggtgtgcttaggcctaaagctgttgtttttatgacctattttgcattcccatttatatcgctgactaaacgtgggtattctgcaccagtgagcggatactattcaggccagttctttccagatgagtgtcctattattgaaaaagcagatgtcattcggcaaaaggaacacagaaaaatacatggaaaagaaaagaggacaacaccgggtttccttcagcaactatttagattcgtatttcagtgcttgagtatatgtcgatttttctgactttaaaaagggcagaccaaaggtgtaaagatgcaagatgactttttcacttgtttgatgacgatgctagtatgtgttatgtactttctaatttctaactagtctaagttaacctaggtgttttagcaaaattttgctggtgtttctgttcttgtatgggagcacatgtggtactactacgactgaacggcatgaaggctaaatttacagtggactttgagggataattatttcattatctgtttaatttgatttattatcctagtttgtatggtgtggattatcaaccatgcgcttgtttgcaatatctgcctactctgtctctacgttgagctacccagtgttaacacatgcaatcgccatgaccatgcatgttccatgcctgcctgtttctttatttgttttttttaaaacaaaaatattagcatgctattctgctatgttccacggcacattgttctcatttttgttccctttttttttaaaaaaaaaactttggagttttaaaccttatgtttttatttttccgatatgctttatatttagctcggattctagttttattttaatttccacatgttttttttcctttgcatattttctgaccgattcttgcatgttgattgttcgcctttttaaaacctgcaacttctaagttcttttcctgatctgctttatgccttttcccatttctgcatgatctgcatgttttattggtttccttcttatgtgtgatattctaatttttgtttactttgttgtttcttattattaaaaggtctgtaggagatgttccattatatcttcacacgcaaaacggaataactcattagcgcataattaattaactatcatctattttgaaaaaagattaatataatttttaaagcaaattttccgtaaaaagcgagaaaatgtaaaaatacaggcacaaaggggagagaagctagagcactaaaaaaatatgtacttcctccatttcacaatgtaagtcattatagaattttccacattcatattgatgttaatgaatctagacatattgtgaaagtcattctagcatttaccacattcatattgatgttaatgaatctatattgtgaaacgtagggagtatattacaaactctgtaactaatcaagcaaatctaatgaaggggccggttccctcatcctacaaatatggatgtgcaggtctccacatccgttaaaatattatataaaataatttcattacgctgcttacagatatgtcaatatgtcaaaaacatgatctccgtaaaatttttttttatgatttttagcacgacacacgttgcccgaaggtgtgcacgtagtaaaactcatgcgctttagaatttaattagaactcctggcagctaatttaattgtgaattcacaattaattaatgaccacatttatcttgttttttaataatggaaaaaagaattccggcctttgcttcaaaaaaagctacaactacttattacaaaattctcttaaagaaaacaaatactcaggcaacagtaagaacataataataaagccaacagacaaggcannnncanttngaaggggccnatccacngagaattcatggga

SEQ ID NO: 14164 - DNA, 1211 bp, Oryza sativa
  unsure (1)..(1211): unsure at all n locations
ctgagatttgaanccttgatgatcgantgcccnntgcaannncccaggaaaccaccaaagcttacccttctcgtgcacccagttctgtcctccttttacctcagcaaggcgtgaatggttgacgttactacgccaaacatagtcccgacttgttggccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgccgccgttggggggtacttgcatcggaaccgtcccttgcaacgaccttgcgccccgaccttgggtggttccgtcatttgagcccggtcccgggtttacccgccaagctcttaaagggggtgcctttaaggtatcgagtaaagttttacgggtcattaacccccaaaaactagatttggggatggttcaccgcatgggccctcggccttgaccaaaggcttaaaaacttatgccctgggatgcacactatttaatagtggggcttcttttcccaatatgaacccgcattaacccctatatggcctattttttattaataagaatctgtccaataagggctattgtaaaaatatcttcgtttacagattgtaacaaatataagaagaatctcacaagaaaataaggggatggctccggatgtgatgcgtgcaccaaaatcgtggaaatcgccacccttcttgtatatctct

SEQ ID NO: 14165 - DNA, 11597 bp, Oryza sativa
  unsure (1)..(11597): unsure at all n locations
cggaatcggaatacaggttcatgtaaccccgccggctttattatataataatcgtgtgcgtatgtgaatagaaatgttaaaccaacancacccccccccaagggggnatggattgcattgcgactcaccaaggcgaattcgagctcggnacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaaatgagataaaactaaaaagatgatgtggctagtgaactaacgttattaggtgcatgagtaacatggaaatcaagagattatatcataagtaatgttatttgaccaacaacatctataaaactaagatgtttaaataaaaatagttgcatattattgtagtttgtttaatgataaatatagtaacatcaattttatatgattgaccttttaatattttttttctattaatagtcatagttaaaaaaatgacttgacaatattttaaaaatgcttacattctgtgacggagtgagtactatggatatataaactacttactatattacggtagtttttattcaccgtgtattatctatggtagttttatttaccatgtattatcttagaaacaacactgaattttagtttggatctaattttcttatgaaagttaaggctcctttcgaataaaagaattttggaggattacatttctatcgaaataaattcctatatgatgctttagaatgaaggtattgaattccttctaaattccttataattgtctcaaatcataggtttttttttgcaaaattggttatatatcatcaaaagttcactttttttttctttttatagcatcgaaagatactaaatagcacctaaagctcaccacgttcccatttttaacactttcgttaattttcaatcgtttttcgtccgccttgattactattgactcagccacacacacaatatgatgtttctacccctgattgtcatgcattctacttgtgagaggtagttaggaattcatattcctctcttcttaagaaaaaaaaagtgcgctcacaactcgtatacattcatccatataatatatacacgaacatcttacctttatatgaacaccttgcaaagatcggacatattctttttatctttacacgccttattaacgtacactaaaaatgtgaataagtgaaccctgcatagccatacatgtttataaaagaaaacaaaatagaaaggcacgaggagaacagtgggacagccaaacgtgacggtgatttcacttgaaaaagaaaaataaaatactgtgtgccgatttagacaatgcaaatgcattattccaggctatatatatagctagttagctctgtcgtcgatgcttcttctttttttgtcatttacaattttgctgcacatttggatgtgattttcgtattgtattgtacacgtatatatgggctcacgaagagatagctaaagggaatcgtgtgacattggcacaatggcacatgtgacgagcgcagatggagctctcgcctcgtggaaagaaacaaaaaaagtcgcggcaccgatgggcgatcgatcggtggctgggcgagtcgtctcgtgcgatcgtgtgcggttggtttggttttgctggctgcctcgccacaccggcacaccgcccgtccatcataccacgctctggctgacgcgctgcttgtttgccgtgccgtgtgccggctgcatatcctctcgatcgccctagtacatgccgcacactccattttcagctacctttttttttatgataatggatcttattaggactaactgcaaaacacgtgaccatggaataataacgtgggttcaataaatggaaagctagcaagcttgaaaaacaaaggaaatatatatattttgtagtactaagaaatttgatctacagtaatattgttttatttcatactccctccatcctataatataagagattttaggtggatgtgatccacctaaaatctcttatattttgggacgagtatctcctatcattcaattcatcttgtgacaacttttttctctttacctttctctatattgttgccgccacattaaattgcttctcttgatctcaagcgtattttccgatcataaaagaccgagagatgatcttgatgttattactttgaagttgcacaaaccccaagccccgaattctcgattgggattcacagatccgatttgttttttagaatcgcttggttttcttgaaaccaatggcggaggcatcgtctgggcaggcgaaaactccattaaaattttatattagtgagtaaattggtgatgaaatttctataacaaatactagttatatttatccggttttaaaaaattttctagctccgccattgcttgaaaccaccctgacccaatttgtgaattccaattgattttagttagttttcatacatagttaacaaaaaaaaaggtcaccggttctatggtttgtatcggctttcgcgctgttttggtaaaacctaccatgatcggttttcagttttcacctcgatctcctccgggcaaaccgcgacatttgaaagaactttctcctttacgaaatgcccaaaataaatacaacaagtaaataaaaatggaattcgaaccgttagcgtacgctacacccggccccacgcgtcagtgaaacccaacagtctcctgaaatcaacccgccacaaaggcccaaagcccacgccgagaaccccgccgctcgcattcgcattcgcatctcccccgctttctctcctccgccgccccaaaaccctagcggcgagcgagcgagcgagccatccatcacccatggcccgcaagcgccgcgcgccgacgcccccgcccccgccgccgccgcctcccgaggccgagtcctccgcggattcaagcggcgaggaggaggaggaggaggaggaggaggaggaggagagggagtctcccgtcgccccaccgccccagaagcccagcggccgcggcgccgcctcgtcggatgaggaggaggaggaggaggaggactccgacactgacacctacgcccaaggtttccagcttcggaaggttggcggcggcgacgaggaaggggaggaggtggaaggcgactcgtcggagtcggagccggagccggagcccgtcaagaaggagtcggcgaagaaggccaaagccgaggccaagaagaagagggccgcgcctgagcccgcgccgtcgggcaaggccaagaaggccaagccggagaagtcgtcgtcggcggcggcgcctgagcccgctccctcctcgggcaagtccaagaaggcagccaaggctgaggctgcgaaagcggctgccgctgagccggctccttctaccggcaaggtgagcaagtacaatttggcgccggagccctcgccgtcaagcaagtctgggaaggccctatcgcgatggacgacggatgacgaggtcaagattcttgaggtcctcgtggcccatttcaagagccacggcactcagcttaaagttgaggggatcatcgctgctgtcggcgatagcctcgagaggaagagcatcaagtattcggacatgtatgagaaggtgcggaggctcaagcagcggtacgaggccactgccaagaaagttgaacacggcggcgacctaccagctaaagaggatgacctgcggatgtatcagctatcgtcggaaatctggggaaagaacgcaaaggatgctggcaattcgtcaaagaacaagaaggggcaagctaagaaagataaggtgagtggagattcaaaggaagccgccaaggaagataaggtggatgaagccgccattgctgtgaatgaaaagggtggtactctggcagagaataagaaggggaaaaccaacaagcagaaaacaggtatggaaacaaaggttggatcatctaaggaggctgctcttgctgctagtccaaccaagggtaagaagaagggaagccacaaagacaaattggatgaagaagcaaagagtggcacggcaaaggtgacctccacaattgccactgatgatgatgatggaactttgggtgggagtaagagggagaaggctggcaaagaggaattggatggggacacacatatcgtcatgccaaaggaggccaccacaactgccgctagcgatgatggtactttggttgggagtaagaaggggaaggctgacaatgggaaattggatggcgacacacacagtgttatgccaaaggaggccaccgctggcacccaaaatggtggcatcctaacaggaggggaaaatcacaaagaaaaagtagataaagatgctaatgtaccaagcatacggagggagtatgctgaattgcagagtttgtatcccaaccttgcttcctttgtgaacggaattgaggcccagcatccatgtggatcaaccttcaagagagcttttgagttcattagtgatgataaggcttgcaccctggaatccaagatcaagaagcagaagatagcggaagtgagaatgcagctccgtctagcagacacgaagaaggaagtagccaatgctttgttaggattgctggactaaaacattgcggtgctgacatcctttttgtgcggtatacattcttcttacttgcgttattatgttcccatttgtatattaaagttctgttatagctaaatgcatttaaagtgtttttgttgcttctaaaatttgagtgtgacttctgaactaattattgaaacaaccctgttcttatgtggtcagtttagtgtgaaacatgtgcaattaaggaaagtgtagccaatgaaagatttagccatatttgacacgtacaaaccatctaaatatttgattggtttgtatatcaagctaacttacactttgtaggtgttgagagggtgagtttgtcatacgtagcaacataagggagtgatttgaatatatcatctgttggattctactattcttgattggttgtaaattaaactgtacctacactttgtaaggattgagaggtaggagtagtgaacaagggaacactatgaataaagcatctcttgcattctactcctgaaatagttagctttaccttattcaaacgcacagttgttgctttgctaggttgtcattgtaatgttttgtacctactatactctactcaccgtgaatagtcattttttggggatggttttcctttgcagaactgagttataatgctttttttttaccacaactgatatatgcaatgtttactggtagtttgtccatatgaatcttgtgctgcaaaaggcagcatagtttattttcaagttctttgtagttttgtttgttaattgtagcttaggttgatataaatagcttaatgtttgaagttatgctttatatttttcaaagtaaattattgtgtgatgtccattgctctagtgaatttagggtttctcttgaagaattttgttggctgctccaactgctcccaataatgccactaaaagaacagttgcatttttacaagccacctgctagtactgacatggtattggatgtgacatttcctagtacaacaaatctgtcaggagcttatccagatttgttgtattagggaatgtctcgtccaatactaggttggttttttgtgggacggagggaactaccttgtcttgtatagatgacctgattttgttgactgacctcatcaactccactaaagaacaacagttgcattctgttcaagctacctgctagtactgacatgggaatttgagtagctaccttgtttgtctagatgaccatcctaattatgtactacctcattttcaaaatgtgtgacgccgttgacttttcatacaacgtttgaccattcgtcttattcaaaaatttaacataaatatgtaaaagtataagttaagattacattttatttgatgataaaacaagttacaataaaataaatgatatttatataacttttttgaataagatgaatggtcaaacgttatgcaaaaagtcaacggtgtcatacattttgaaatggagggagtatatgccaccacacttgtcagtttggtcaagcacagaggattctatgctaagcctgcatttatttcaactgaatttggagccttgatacctgaatattgatttgtttatgtgagcctgtgaggctcgctcaaggatacatgattttttctgagtctctttaaccaagtcacaattgcaactcaagaagttgttcatctagaattaacatacaaatgaaatcaatggtcaatcccaaatccatatatgaatatcatatttaatctttaatttggattttggtgaaccttgtggggctgttggcatgaagattataagttggcaccattttagttagttcaatgcttaaaggctgaaccaatacaaagtagcttagtgtaccagccgtacataacttttctcaatatctcaaatctgctttatttgttttcaaactacaatgatgagcatatgagtgcattgctaagactttgatttgtctgtgcctggacaaaacatttcttttcgttgcttcaattttcttcttgcatccttagtagtactaatttatattgcttcattatccatacacttattctgttcactgttcacaagcagatggttgtattgaagattcaagttgcagaagatttttggcttgtggagctaagggatatgacgtgacgagttgagctactgggttttctgtctctggttctcgagagctattctgtgaacggttgtttatgtgattagatggtagtatccctttaatctatgagttagcaatggagctgatgacagtttaattaactcctgtatctatgatggcatttggctttaattaggaggtgtgcctaattaagggggttctataactttgggatatgcgtgatgctgatattgacccgaaatcccgtaatcctgcttattttgttgcccggtttattcgacctgcaaccgtttcgttttgttgtaatgctccaacatgatctcagtctcgtacaattctgtgcaactaagtcatgcttattcatgaagtgaaaaatatttcatttcattacagagagtgaagaatttcagtttccggatgcatgatttgcacgctacgactacgatcatcttgatcaacctgtacggttctccaaatttgattcggcaatcgacttgcaatgcagatagctctgaaccatcatccctcatttatctctttagggttaagtcttatttacccccttcaactatcatgaaagtaaaaaataccctcatcaactctaatactagataaatagctttggccgatgtccaaagtgtgagcttggtgttgtcttgcttgtttaggcggtgcctccaacgatgtcgcgatcgccatggagtcggagttgctaggtcgctgggcggcaagctcggcaacgatgacacgtgccttgtaatatcaaacttgtatgccacttcttcagcatctcaacatcgacgttcgctcttggattccgccgttgtttctttggtagtttggctagtgttgtttggtgcttcgtgtgttgtgtggttgtaccagttgcggtggaggaacttggcgagtctctacttgtcgagaggttgttttatttttctgtaacccgtctgggtttttactccagcgagaggttgttttatttttccgtaacccgtctgggtttttactcatgtttaattgaaatataattgatagttgtcctgccggtttagtttcaaggacgtgactagacagacagtggtagctgatttgtctaaatcaactaccactctatctaagaaggacacaatccacttatactttaaatacaattttctcttaaactactcatccgatctatgatccgattgcactgttgtattcgtaacaattaaatctttataacaagatcttacatgattatattttcatgaaaaattataaattacttttatcatatatctaaattacttttagatttcactaaattacttcttagacatataaaagtaaattcaataaagtctagaagtaatttacatatattatagaagtaacttataaaaaaaagtaactttaatgaatgccttttttcatcgtacgagaagtcatatttttatccctacaacgaatttagttactttcattttgttttaagttacttttataatataatatatgtaaattacttttagactttattgagtttacttttatatgtttaagaagtaatttagttaaatctaaaagtaacttctatatatgataaatgtaacttacgtatataataaaagtaatttacaaatataaatattttttcatcataatataatcatgtaagatcttgttgtgaagatttaattgtaacaaacataatggtgtaatcggattgtagatcggataagtaatttgagagaaaattttgtttgaagaggaaaaatgacatgcatgtctattaaaaaaatgcatgcatgtagtacgatgtagtaaactccacgtcttctccatattcaggtatcaccggttaacgcaaaaatgagaggcctctccgaatagattttacgtttcaaaaactattcgatccggatagagaaaccccccttcctcccatttaccggcggttttgggctaattatagagattaatctcctaatgaggactgaggagacgggcccagcctgtcacgtgaggagcacacgatggagttagctactgcatgtagaggccatgtcactctgtaattggcccaaaatggttcaagagattagtttaatagtatagccaactatcagctctaaatcatttatagtcaacctaatagtcattcatataagagcacccgcaatggtaaagtaatgtgctctctataaaacatgtacatctcagcaatatactcgattaatagtaaaccaccttaatagtatgtctacattggtatttatagctctctcatgcattgcctcgtttttctctatagactatctctaagttagtagatagctttgctctctctcttcatttaatacctttcaagtaggaaaatatgctgacatggatttcttgtagagagtatatagataaccattgtgggtgccctaatagttaattacaaatatatactatatcattaataactggtcccatatatcatatacacatagtgttctagagttcgtgctgcagctggctacaaatctatagcccctgtcggctattttttttttcatcctctgcgaaccgtctcaccggaaggaagctcagcgccatgctcaccggaaagaagcagtcgtgccgtccggtgcctcctgcaccctagtgttagggatttgggctctagaggatggggaatttgagggaaagagagacgagaggagggaattatttaattttttgctatgtcatccgtcggagtgtcatgtgagataactctggaacaaaactggctataaatgggaatgagggggttgtgtgtccggactgaatagttatggtgaaaatgctcgatcggtcgactgggggaggggggaaattggttgtttcccctcccccacgcgcgcgccccgctggacccacccacttgtccctacacttgtttcacaaaagatgtttcacctagtgtacttataatgtctcactatgtatagatctaatgttgcagtgaattaaaatattcttttgcaacaaatcacccacatattttagaaaccctttattaagggaattcgtttcatttttttgttccacccaaaatatttcatctagtgtactcataatgtttcactatgtatagatccaatgttgcagtgaactgaaatattcttttacaacaaatcacccatatattttggaaactctctattacgggaattcgtttcattttttgttccacaaaaaatgtttcgccttatataatgtttcactatgtatggatcaaatgttgcagttaactgaaacattctttcgctatttgctgaaacctgtttttatataaggcgaaacaacgcccgatttaaacgattgaaacattttcgatctacttagtgaaataattccgatatacctggtggaacatcgtgcaacatttaaaaaatatcaataataagctaaacttttttcgtcggaatatatccatgggtggttttgttttgaagatttaattgcaacaaacttaatggtgcaatcggatcatgatttggataaataattttaaagaaaaattagtttaaagtggttttgcacatatgggtggcgctgatgtcagcgcccgctttttggagatttgtatcgggcgaccgatccctagtcatcccctagttacggggtgtgacttgtttggaattagagttgaggaggctaaatcatattttcgttatagttggaggggggggggggtcaatcggacttgagccttatttctttatgcttagctctctgttaatattcaaatttcgatggatttaagtttgagtgtattcttcaaccgtttttgttatagacgtcgaattatttttttagcctgattagtcgaatttatggctggttgatctacatcaagatttttcttttgcagggaaaatagactttattaaatcacacgggacctattacaatcgtttttgataaattatgagttctcaatatttcaaaagcccatctcagcacaaatcttgacaaacaaagctagaagggactattactcagatttgagtgggtttgagtacaattctgctttgcggttatcgaaagggacaattacttatttgactctattttagagtctaaatatcaatttggccctacttcttttaatttgcttatttgactccgcatttgtaaaacgaagttaccgtttggtcctatttccatttcgctgttaggatttcatttagaaaaaaaagaaacaaaaattcaaatcatattcaaactgaccaaaaatacgcttgaggactctaccctatccattcaatccctaaattttattactacttcagaaacaggcacatgatttatgcaatttgctacactgattgtttttgaaagatctaacctaacagaaattattaggacaagctatatgcgagatatattgatggaatgatgggtcataaaccggagaacttaattactgaactttggaagccatagtcaacgtgggcccatatttgaagtgactttaaaaaggagacaacagtgcattaccccagttaatttattttggaaaaaatacaaattaccccccgaactatcgcgcctgtccgaattacccccatgaaccacaaaaccggacattcttcacccccaactatgcaaaccggacgaattacccctccctcggaaccaattcagagcggttttgtccaacgtggcgcacatgtggccaatccggtcagcctttttttaattaaaaattgtaagaaccacctgtcatactcttctttcccctctctttttattttcttactttttctcggtcttttttctttggcgtttacaccaagcgcacgtgaagaccgccggcaggaccttcccgggaccgt

SEQ ID NO: 14166 - DNA, 25510 bp, Oryza sativa
caaaacacaaaaatacgattccaattcacgcatctaacccccggatgtataatatttcttttagaataaaaaaattattaaagcacaaaatgataaaccaactactgacacttcaatttatctccttatagacaaatgtgttccatattatcatccaaataaacatacttcacaatatgaataaatgttataattaaaccaatacatatagttttcaccattcagcatctgtaaggcataatatttttttatggcatctcaggattatgacccgggttattttgcgcacaatatttttccctttttggtaaattagaaaacaaccccccccttcccataaatgtttgacacggttgaatttttaaacatgtttgaccgttcgttttattcaaaaacttatgtaatatgtgtaaaactacatgtatacataaaagtatattaatcaataaatcgtatgataaaaaaagaattaaccaccatttaacttattttattaacacgaacggtcaaccatttttcacaaagagaaggacgacaaacatttggtgatggaggtggtacactcctcggatgagaattacaccaccccatgtgtgtcaccatgagtccggtgggcatccgcctcagtagcctctgtatccgtgtctacgtgcgtacagtcctcgccgaccgctcgtccatgcgctgtcctcgccatgcgtgttgtgcgagccgcgagagagaaaagagcgagagagatagagaatagagagagaggaagtagagtatggcaggcgggtcctgcattttttaattaaaaaaacgctaactggattgccacgtgtgcgccacgttggacaaaacctctctgaattggttcgaggggggtaattcgtccggtttgcatagttggggggtgaagaatgtccgtttttatggttcatggggtaattcggacgaccgcgatagttcgggggatagggggtggggggttattcatactttttccatttatttttaacggcagtcttttgtctatttggcaccttgttaggatcgttcaaaaacttgtcacgtcacaattcgagatttcgatagcaaaggacacatgtacgtttttttagaagccttataaaaaattgttataaataacacaataagatggtgaatatattagtagtagcatttttgtctatggtgaagttctggagtagtgctttctgaaagataaacacatttgcaaacacatcatcgcctatgcgtcagcattgcaattttcttagtcagtacacacgtaaatgcaaaccaatgagcaaatgtaataatatatgaatgttccattgcacattccgaatacacaactgatcatgttgcaacaagttaccaagaaagaatatttaaatttaagccaaaaatttagtttcggtgatatatttggcccctctttcatctacatagtttaatactctgatcccttggtgtattctgatacaagtttcgaaaataacgatgaattgtcttccagaagttttgctggcgagtcatcctctgcgattttacctgtttacaacaacatggaattaaaacgggagaaccaagctattaaccgttggctactaattaaacacaaagcacatgactaaccattgtccagaagaatgaccttctcactatcaagaacagatgcgatcctatgtgctattgtaatcactgtgcattcgaaaaattgttgcttcagggttttctgaatcaaattgtcagttattggatccactgaagaagttgcttcatccaaaaccaagatctttcgcttctttagaactacccttcccaaacaaacaagctggcgctgacctgcactccagttgttgccattttctgtaactatatttcatattaaaatatcagttatgacttatgagtttgacactgtggagcaatgcattatagctttctgatatagatataaaacctgcagagtcaagcttgagctcattctttctaacttcatcgccaagatgacaagagttcaatgcctggataacacaacaaatataagttatgcattagtttgacaggtgcacattgaagaattaaaatgtcagtaaattaaaattaaaagacctcccaaatttgttcatcgctgtactcctccaaagggtcaatgttatttcgtagggtcccctcaaacatcacaggatcttgtggaatgatactcaatcttgtccgtaggtcgtgtagtccaatggtgcagatatcaaggccgtctatcaacacttgcccaatagatggctcgacaatacggaatagcgcttgaatcaaggttgacttgccactgccagttcttccaacgatgccggtcttcaaccctccgggtaaagtgcaagtaaggcctttcaaaacaaaaggcaattgtgttgcataccttacctgcatcacatacaaagcacttagaggaaaaaataacacttcaccagaaatttctgcattaggtgttgtatgttttccatgttaagaaagaagatatagtgttgtgagggtatttccacagtggtatgctggaagtcgtacaaaatagtatattatgaaagaggattgcaactctacagtactagaaaaaaaatctgcatgccaatttttgtggaataacttcgatataaaattaatttaataacacactgtttttctcagaaaatattatgaatagaaatgttgagagttctaatcaataattgacatagctccgacattgttagaagtgaacttatataacaacatagagttcaagagacaaacatggaggttgcgaagctcaatttcaccatttgtcggccactggcagtttggtctactttttgatattgtaaggagttgttcagaaggaataaacatgtattgaaaaattctttcaacggatatcattctattttccaaactacagagcactgcaatagcccacccttgcaacatgttcagacttaatccataagtgactgcaagaccagctgtctctgtgagaatacaataaaaataaaaataatagttagcaaggatggtaatacacataaagaactaatttgatcggaccaatcaaattaaagcccactgtacttacttgggtcaattagagcagctggcaaggtgaccagaagtaccaaggcaaatgcgaagataaaggatgaaagaatgtccaagcgaaagcacaaccattccattgaagcagaattatataaacttggtctagataaattatccatgaaatgactgacataattgataaactgtctttccttgccaaagcatctaataatatttgatccagctactgattcagcaaaatgttgcatcagcggagctctgcaaactccagtcaacctctgcaactccctagcaccatctatgtaatattgctgaagggaaggaattatggtgattaaaaataaaaacaaaacatgagtcgtattgaaaccaataatgccataggacatagttataattttgaaatatgattacaattattattggttaatagcatattttaagactaaaagtttgattgttcagaagaacatcggaaatgcacaagttctcctatatacagtagcatcaacctagaaattttattgggaacatttttgccaagaaaagaatcacatcatatatgtacctcatgtttttattatgtattatatttaattgctttgccatgcctttaaatttcaaattaaatctgtgaaaagaaaaaaacactgattttcaattttcaattgaatctgtgaaaaattgtcaataatgtcatgaattaatgtatttttccttccacatacttaaaaattataaactggaaccaaaaaatggcatccaacataaaatatataataaaaagaatacctgataccacagagatgctgcaataattgggacaaaaattacgaagactggccatgctacccgtgacattaaaataattgttccaagaagttcgataacaggaaatagaacatatcccatcaggtcaaaaatgctggtatccactgtgctttgatcactagaagcctacaattttgtttcaactttcatgattaattgaatatgaataaaaattctaatggtattccaaggagataacttcaattttctcattaaaataaagatggtgaaggtaaattacttactctgttcaagattcgaccgctaggagtggagtcaaagaaagacattgaagcctggaatatgcatcgatgcatcttatcaaatagcatcattgcagtcttacatccagccatgacaagaagatgggatcttatgaaaatgaataacgagctcacaaaagctaacgcaacatatacaagtaccattttcaagctattgactggaggattcacatctttggatattggagcagcccaagccatccaaaaattgcttccaatttgaagaacttgaaaaattatctgagcgagcaaaataagcggcacaagtgctccaccatatgccattgtaatatatttccaatagacagaaatcccaacccgccctttctccctttcttcttcttgtaccaactgaccattttgaacaatcccttctgctccttcattttcatccttttgcttatcttgtctgaaaagcatacttccactgtcaccaggaataagactactttcgggattgccacttgagtgttctaaactttctagagtagaaatgtcatccttatgggaaaatactaattttgtgaactcttctccagaattaagtatttcagcgtaattcccaacttgtattatttgtccatctttcatgacctggaacaacgaaatgaattgacaaggtaaaacgattgttgcgagtagaataaataagtagatttgatagttgttggaagctcaccatgatagcatcggctgatggcaaaaattcgacatggtgggtaacatacactacagtttttgaagctaagagtccaagtaagcactcctgaaaaatacaaggtcgtgttgaataactttcatacagtagatatactcttgaaccctgaatattgttcaagaacaggctacctaaaaactgtttagctgaaacatacaaaagatctgattaagacattaggtttctgtccacacaataaactatgcaaagagataaactgctattacttattttggaagttgggaaatgaaaaatcaaacaaaacaaacatgttctattcgtctaaggatttgataacggcactagcactgacaactgaagaaggttaaaaaaaaaccccctaaattgactgggagaaaatggcgttgaaatcatatgatgtaaatatatattttgtagtattagaagtcttaagtaccaacaataagttattagtttaagcattcagtgatgatttacacacatatagaaataggatttaaagatttgttttgaaaaataccttgaacaagtgcaacccagtatgagcatcaacagcactgaagggatcatcaaacagaaagatatctgcatcttgatacaaagcacgtgcaatttgtatcctttgcttttgtccgccacttaggttaatgcctctctctcctataattgtctgatcacctaatggtaatatttccaagtcctttttaagacagcatgcttcaaggaccttttcatacctttccctatgcagttttgtgccaaaaagtatgttatgttcaattgtcccactctgtatccatggcgattggctaacataggcaatcctaccacatgtttgaacatctcctgataacctcggtatctcaccgagtatgcatgacaacaaacttgattttccagatccaacagttccacagatagcaaccctcattccttgtcgaatacggaagttcaaatttcggagagtaggaacctcagaagatgtgttccaagagaactgaccgttcctcacctcaatcgatacatcagttgtacctcttggaagtttagttacaacatcgctcgatagttcctcgaggtgcataaaagagcatatcctgtcaagtgatacttttgtctggatgatcacagagactgtgtctgggatactattgattggtccttgtagctgcctaaacgttgctagagcagacaatactttccctgtttctaatggaatgcctagaagcaaacaagttccaaaggtgaccatagcaataaaagcaggagctccaaagaagacagatataagcatagctgaggtgtatacatctttctttagccaatgcatctcctccttcctcaactccatgatcttcgacaagaagaccatttcccatccttgaagcttgagaatgcgcatgttccgcagcatctcagacatagccctcattctagcatccttggcatccatcattttctcttggtaattttgctggatcctccctataggtagatttgctaacattgtcaaaacagtggcagcaagggctgcaaatgctgccaaaccaagagtggagtataggatcagcattgctagaataacctgcacaggaaacaaccaaagctcatgcatggacgaattgaaacccgcgacacgcaccgcattaacgctcacggcattgatgatctctccacttgaaatgctttccctggactgatttgagagggagaggcccttttggtaaatgatggcgacaagagctgagcgtacccgcacaccaagttgttgcgatctgaagagcaaatgccttgatgagaggcctttgatgaactgcgcaacaacaaaactcaacaccaaaatgtagccttctttagcggtccgtggacttcgattcaggtaatcaacaaagtactcaatcaggtatggaccaacatatgaagagacagtacggagtaaggcacaaactgcagtgaagaggattaatttccaggttgtaagaacaagagctttgaccagcttaattgttgtaacaccggtgtacttccctgaaccagaaactgagatgagcttcgcctcaaagttagggaggatgccttgaacactgtcattatcatccaaagttggcacatcatcaagatctagtgctttcctccttccaagatcaagtaacggccccatccaagaaaaagtgataacactaaagaatccagcatctgtgaaagctgctctactgcctgtggccttagacgaggaagaagctgcacggtccaatagtggctgatccatgataaactaataactcctgaacatagaacaacaaactttagcaagttacaactgattatttatgagaaagaaaagtataaaagtgttaacgtaaaaatgataatttaagtctgttcatggacattaataggattacagaaagtatagctaatttaaaggaaacaaacataactgtgagtgttaaagccatatgttgcatgaaaaacatccggatgaatccgcacgataccacagaattccattgtcacacatggtcaagatgatatcacaaatctccaagtaaacaaaatcgagacctagattacataaatagcatatgtaatatgtatgtaatctaatatgtgctaaacttcctagaagtaaaaaaaaaagaggatgtaccgaacttttaaatttagcaattgagtttttttttaaaagtatccgatctcaccatgcccatctcagcattgaagcacagacttaataaaaatagcaaaattagtgcaacagactgaaaatgagaatatatattacgcattactccttgcatacctcaaaaagaaagaaaaaaaaagcacgcatgtggaataggatggtgtcagccacaaatcgaaatctgtgcgaaatttttgtaaattaaccagatactggctattcggtgggagagatggaggagaagagaagttggcgatctcgagccctccggcaaagaggcggtggtggcggcggcgatcacggagagcctataaatgaatgcggcggtgagggtcttgagcccaccagcggggctagcgcaacggtgccgatccgaccgaagaggagcacggacgtgccgctggtggctggggcaagccgccgccgccgctgccgccacggccatccgggtgtctgcgtggtttttctcagtgatcagaagttggaaagaagccgcgtctcactgaaaaatttgataatttaacgcttttttccgttgcccaaattaatttaattgacgtttgtaaagatcgccgccacggccatccgggtgtctgcgtggtttttctcggtgatcagaagttggaaagaagccacgtctcactgaaaaatttgataatttaacgcttttttccgttgcccaaattttaaggagtgttaaattatcaaatatctccgtctcgctcgactcacgtgaccaaaggagacggaaattacctatgcttgcggtacgtgggttttttctaatttctcaaaatcttataaaacacatttgtttgttatagatttgggtggcgagtttattaacgacttaaaagtaattcctatcacaattatgaaaaaaaagctgttatagaacttatttgcaaatctgaaccccggttttcttcacagttcacacgctgtacgaccgtagcattatcaatgtcatgcctaaaggttattttaaaattgagtaaatttggagtttatttcaaacaaaacaataaaaatgttagttaagttcaaattagtgcggattacggatttcacatatgtaacgcttgaaaccaatatcataatccccgcttgttagtaacggttcccttcttccccttaccatctattttcctccatgtcataggcaactaactaaatatcttcaacgaatgttcacttgctctcgttctaggggtgggggtgggtgggcatgagttgcgcaggcagccgccctcctattcaaccggcggtgatttggagaactggtccggtatttcacgaggctcaaaatagtttgtaaggggtaaaaaacaatattaaaattcggggattcgtgaattaagagcaggtttattagtgtagtaagctaccagcgatagtatttgtccgtgtctgatatagccatcaagagagaagctcatgcgatgaactagctgtttcgctagctaaatggaaataaacaaacatttaattcatgcatgcacaaccaaattggcatgatcaaaactaaccaccatccttgtagctatgtgtgttgcctgtgctctagcgtgttagatagggagaaaaacagaaatacatgcaaactagatcgtggagatatgtcggaggcccaccaaatacgtaggtatcacccatatcagctgcaagcgagcagtagaggctcgtttcttacactatcgcccggtgacagatctagcgtccgctttttctctttcttcttttctccctcacccacataggatttcgctaatgtggaataacgtatagcctactgactcaaccttattatatatacctgctctaagaagtgtaagtcgccatcttcctcctcgtacatcgtaattcgttgtaaagaaaccacctcaacaaaaacaaacacgtgtgtttccatccaaaactcatcccaccagtaaaaccagatggatgaaactcaagccttgcaaattttccttctaatccctttgcaaagtaagggtatagcgctagtaaaatttagaagttgagttaagtaatatggactattttttttgaaaaatgaaataaaattaagatcgttctcgaatcgggtatacatggatgaatacaaaggaaaagaaaaaaaaggaccaatgtgaagaatcaaaatagagatgacaaagtctgcaggcatatacttacctgctagcttcttcgttatgcctaaaagcctaacaaatcgatcagaagatcggccgctccccttctcaacgccggctgctgcctgctatgcgccgtgccaaggccagccgtcttccacggggtttcgtagcagaaggggttcatatgtactgcactcctgtatttgtgtggggatttttttattacagtacaaagtacagatttgtttaggctaatccaatagaggtaataatcatatagaaggaaaccattgtattcgtacccttcttatgtggagaattaatgccccttttatttgacacctacagctacacaaaagtatgattagtcaattaatgaaatataatcgtacctgccatatattgaaatccaaatttacagccgtgggcctatttggcaagtttagagaatattgcgagtttatagaagggaaatagtagtgtggctgcattcggcatgtttggcgatggagaggactgatagttttgagaggaaattaattaatagtaagattagaatttgatttttaagtctagcatgttttgcgatgaagaggatggaaagttttgatgggaaattgattaatactaagactagaatttgactttcaaatcctagtatagcatgtttggtacaagtggtgcgaagtgatggaaattactactccgtcccataatataacaaactagtaccgaataggacactttatagtataacgaatccggacatgcttcctgtccagattcgttgtactatgaagtgtcacatctggtcggagggagtatcttcctagtttctctataaaagtttggttagtcccttcggatacaagaatgaatatatatgtctagattcatcaacatctatatgaacgtagatccaatcccacaaccgaaaaaaagtacaatttcctataaagcgaaaaacaaaaaaaatccataaaaaataaaaaaaatctagaaaacatctagaaaggatttatatttgtcgttttagtagtccatatatatctcttctctatctctaatctaactaaaaaatgcgcggaaagataaaaacggtttaaaaaaacacgtgaggaaaaaatatcagaaaaaagcacaaaagaaaacacgctagaaaaaaaggttttcgtagtaaaaaaaacacgcgagaaaaaaatatttccatcgtctgtaaaaaagcaaaataaaaagcatacgaggaaaaaattgtcagaaaaaaaggctaaattgatggacgcttggttggttaggatcatcgatttttttttcatctcctaggcttttgtttcatcatctattctcctgtattggagaccctgcacacctctgtagtcaattatcatactattttttgtgaagtatagctactattcttgataacatattatatggaaataatattagaaaataaacatattgtaattgttatttagaaaagagtgcacagtggctctattttgtgtagacttgaccatgcgagtcagtgtaggatttgattggttgtaagaatgagattaaaataatatttaagattatatgcatgttgtcacatgaataatccaattattttaggtaaaccaaacatcggtaaggttgccatcatcgaggttgggccattacatttaagatgttctaattttctaattttctgattgtcatcaatatggttatgtatgaaaaagtatattatcattaggttttttcatccgttgcaaccacaggtatgtttgctagtatatataaagaaactcagtcggacgtccatggtagagtgaaatgtggaaatcaactaaaacaggggagaaagaaatagagttggtttcaactttcaagaaaagaaaagaaatagaaaaatacacacaacaagggaaagacgagttaaaagaactgggacttttcctcacaaaaataaaagaagaaatcgattgggacttaggggtttagagttagcagtgatctctacgatcgatctgttgcattgccacctcgctcgtgctcttactttaatctgttgcattaacacgattgattctcaaactttggtttcaagaaagaaaaggactcaaattcacattgggttctatatataggccttgtttagttaattagttccctaatttttttttctaaaaaacatcacatcgaatatttagacacatgcatggagcactaaatatagattaaaataaaactaattgcacagttaggggggaaatcgcgagatgaatcttttgagcctaattagtccatattagccataagtgctacagtaacccatatgtgctaatgacagattaattaggctcaaatgattcgtctcgcggtttccaggcgagttatgaaattagtattgtcattcgtgtccgaaaaccccttccgacatccggtcaagcatccgatgtgacacccaaaaattttcttttcgcgaactaaacagacccataatttgtcacgcccagaaattcactagtaatttccgaactaatttgcgcataaaattcttgtccaggaatcaaccgaggtacacaaactgacaatttaatatacatattcatcaaaagaactaaagcgataaatacttactgaagaggcacttagtcctcacaacgaagaaatctgcagcggaaaaataaaaataaaatctggcaaagcttcggctccactcccacagcagctcaactggggtataagctaagcatcttctccttctggatcatttttcttcaactgagatttgattgattattgcaaggtgagtacatggaatactccgcaagccacacagcaaatatgcaagtgcacacggataccaaaggatggcataatataggctcatttgcaaaagcagcatttagcaaacatttaggagtagtaaataagtagagtaattaatcatcaatattaatcaacactgaatagcacacccatgctgcaggcccaaccaaacctgaacaaccaaccccggtcgtacagatcaaacctctaaaccaggaatttaccattccaaaccaggagtcaaattaattatcacattattatcattaatgagtagtgtgggactaatcacgaaaaacattgctcaacccacccataaccgcgggcatggctattcaaatagttttactctggccagaggtgtacaaatttacccacaagacataactccacaatatgtcaccatatcaccatgtgcccatgctgaacatgccaccatttgtgtagttgtgacaagacccctcgcatagctcaactcaaagcagcgcacctttcctggatcataatcaccccctctacaaccagaggcgtggactccccagcgacccccacggacttctcgccgcttcacagtctagcgccccacaatgagccttgctatacaaagtgtccagccgttgcccattctggcttgtgattagtacggttaatgtctcacaacagtagcttgcgaaccggtccttaattgtcatgagcatgaccttcaaaaccatgtgctcacaacccaccattatcaagttttaattatcaattatttatcacaacacgattaaccatcgtgagctaccataaagtatccatcattaagtaatagtgaaacattaatcatcccaatagtatgctagtgtttctaagcatgactaagcaattattctaatatatagtcgaaccaatatataaagtccaactagtcaaattataacccaaggtatcaaagaatagggtaatcaatgcaaattggccataacaaatgaataggttcacaccacccggtgacatttaaaaataaatgcatagttgaaataaatagagaatttaaatataggagcaacatgctcaaatgattgtgtttaggatctgtgtgacttgccttgcaataatcggtcttcaattagtcttcttgaacacttctgacgcactcacgaaccttcacaacgacggaaatgacaagctaacatttataacggagaaaaaactaataaaaaccaaataaacagtactaaaaagtaaacaaacatgtagatcatgattttagatgaatttagagacttgaacggcctcattccgacttcatatgaattagttatgaattttacaaaattaattccaattaaacctattaaagaaaacactattccaaattgattaaacaatttacaaacgatttatactgagattaaagattaaaacatcctccgaaaattattggaactaatttagtggatgatatatagtaaaaagaactaatatgccattgaaaagggataacatgatttatattgactttggatggctgagattaatcttgaccgagtcgaccaagatcggatggtttggattgatctggcaagctggcctcacgagataccgactcaacgagtcaattctacgtgacacgggatcaccgaaatgattaaccgaaaccggcggctctgaacggctctaaactaaaggacgactcaacatggacgaacgaacgaagcacggggaacacctcgttcgaacgaacgagcaaacgactcaacaatggttgcggctaaaccgatgagctagacacgattcacggtaaaaccctggtacgacaaacgataggccggtagaaacctagggatgcacctacggctttgcaactcggctaacggactacgggaagcaaacaaaccacgatgacgatgacgtgggatagaggcggcgttgcacaatttggagcaacgactaagcagcgacagtgacacggtttagcagcggcacgactgcgtcaacgacttggcaaggcgcggcagcagcaacgactcaacaatgacttagcaagatggctaccgagctacggcaacgcggcagcgacacaacgcagcagcaagtggctcggtcgctgcggtagcgggacgacatcgacttttggcacgcacgagcagcagctacacagctgtggcagggagcggtacagcggcggctaggcggctagcgcagcggcaatgctaagccaacagctaagcgcggcacggaggaagctactcaccgacacaaacaagagattaaaacctaaactgagggaacacagatagaaacctcaccaaaccaaagcgatcggagagggagagacggcgatgactacccggcggcaacacacggagacgacgatgacgctagacatacagcggattagattagattggattaataccctaggaaaaaaacctaaatcggtgaacggcatgggagcggtggttgcaggcgaaccacggcacaataatgcaaacgagggcaccgggagaaagagaaggcgacggcgattcttaccaacacttatgcgacgacgaacagtgaaggagatggccggcgacggactccaaagggcggcgaggttcgggtccacggcagcgacgattttccggcgacgagcagcggcaacggatggatggacgggcttctccccggctgcgacgctgtgggtggcgacggcaaagcttggcgacgacggaaggagcagtagggcctcgccggagatcaaaacgcgacggcgaacttcgggttgacggcgacgatggagctccggtgggtttcggctacggggaaggggtggacggggtggagcttgaccttgcggagccgagagaggcgacggcgtaggtcgtcgacggctgaggcggctgctaggggcggctggagcggctgccggcggtggacggagaagacgaacgcggcgacggcgctacaagcgacggcggagagagggagaggtggcggccgaaagaggagagggagggaactctatttatagccatgggagagagatatcgatcctacaacgagagaatcgaagccgggattttctagagtttggtttggagagataaactcgaaaacgaatccaaattcgcatcgaattcaaagggataaaaccggatttttgggggaagagatagaggaggataagggggatattttgcctcaactaattttggaaatacacgagagaggaggccggagttggagggggaaggcggcggcaatggcggcatcgggctctgtctccggccggctggaggttaggggcgactactgtagcagagggaaggaaaacagactttcagctgggcttcttttactcagcccgattgaaggagggacatgaaatggacttcggagaagggatagaaccagccgaaaggaagagagaatggaccgagaactaaaagtgaacttttctagtttcggcccggaaaggaaaagggtgtttttttattactttcccaattaaattaatcactgaaatgatctctaaattgttaaaaatacttccggtgctctaataattccaagaaaaattattaaaatacttgaacactataagtatttaaaaaaattataagaagaccatttaatgattaatttaatatgcgaatcattgctgaactgctctttgtattattaaaattagtaattgagctctgaaaaattcgagaaaattgcagagcgtatatttaattatggagaatttaataaaaattaaatgcagccatgatttatatttaggaaattttatttctcacatttaacttcacttgtaaattaatgaacatttaacataaattctaataataatttattaaataatttataaatcataaaacaaaaatcaggatgtgacataattgtacaatctcggattaattaattaatttagggatttgctagacaactgccggctagacaatcaaaaaaaaactcaaaagcttttaaaacgcacaatataagtaagaagataaccatataaaattgtaagaccaaactaaacttagtttcggagtcattaaattaacaaattaaatggctaaaaactttgttcttgagtttttatttttttttcttaactattttgttaatattatatctaataattgaagtcgattttaattaatcttgtaattttgtaggtttactaataacactttagcagtgttcaaaatacataatctatatattagctatacagaaatgtccggttttgagcttagaacatatccccctgatgagaaatgtgtaagaaacatcaggaatacatgttgtatctgacatgaaagagcaacaaagaaaataaaaagaaaaatatgtgattatctgctatatatcctcctggttatgcatggttttagttctgttccaaagagtgatgttgaacccccaccaaagaacaatcttcccaattcccacaaatgacagcagcattcgtacttagacatccaaccaaaccactcaaactcattctcaagcaatgcaactaaataaatgaaaatttaaaataccatattattttgccatggtttattaaatataaattagaaaaattctaaaccgttacgagtcattcatgttaaaatgcattttcaatcgtgtgctataaattactccctccatctacaaaagttagacatatttcacatttgagtttttccaaataaattgtttctatttgtagtctttattcacttaaggctttatttagttccaaactttttcatcaaacttttaacttttccattatatcaaaactttcctactcacatcaacttctaacttttttattcaaactttcaattttaatcaaacttctaattttggtgcggaactaaagcccaagaatctcagttactacctgttagctcggtacgacaccatttaagaatctcatcagacatctgcagcattttaatttgttgggggtgctaatgagctttcaagatggaagaaaaattgaaggggaaaaaaaagaacgcatctggcatactggatgctcaaaatcggtggaaggctgcacaacgtttgtactgcccaaattagcagcgagcagagccaatgaaaatctgtaaatcccccacagtaataaaggacatggaaatccccaaatcagctgcagcgagaggctctggcgccgtcctcgtcatctccacactactcctcgagtagtccatctgcacatgaacagcttggtggataggcagatcggacggtcgtccacgggtgatgaacgaacagtgtaacagttttactaatttgttgacaattagtaaaaatctattcgattttcaacttttttgggttcaaatttcctgaaaacttagaatttcagtctgccgattcttttaggactctgacatcttcatccttcctcagaagttagcaacaggcatgggattgcaacagtaattagaatagcttccttcactgttcttcgaaaaaaaaaagaaaaagaaaaaaaggagtcgaggacgagaagagagcacaccatcagttttattttattaagatagcagcgagagatgcatcaagcatcaatcatgaaaggtagagtagctacgatcaggtgtttgtaggaaatactctcaattggcagccacagaacatagccctgcggcatgtagtgccaaatgccgtcgccacggcctgccttgaggagctcgaagtacccactgtcccaggtggtggtgttgacgtgcacacggcgacagcagtggcgccgcccaggcccacgtcggcgacggcgtggaggtcgaccctcagcgccaccgcgtcgtctggccggtggcagtagtacacctcgtatagatatggcatagggtggcacgccaccacggcgtcgccgccgatccgggagacgccgtcggccgctaccacgtacttgcggggctccctcccgtgcacgagcgtggtgaccgcgcgcggcgcgctggtgcccagcgccgaggcggcgaagtcgagcaccgcctcgcgggaggtggcgcagcaggcgcgtggctcctcgccgccgccgccggcggccgtcagctcgctgcaggcgcggagggtgtcggcgacctgcgccgccttgtcggatccagggaggatgccgaacatggcgaggatggcgtccatggcgcggaggtcgaacggcacggcgtcgcccttgtccttgtagatgaaccttggcgccgccgcggccacgccgtggtcgccgtgcggcagcgccagcttcgtgccttccggcaagacggcgccaggatgcaacttcttcattaagaagagcatcccgcgctggatatgtatgcctgcagctgcatgaattcaaatatatattccatgaaaggttcgctgaaatgagtacaaaatctacctatatgttcttacctggatgagccagagaagacaaggcagccggtggagtaggaggcgcaacactacgtggattccagtcgactgggtaagcagcatcagtgaattgggccttgttaccatcttgttaacacaacagagtgatgggatcaatttgattgcattgctagtcaatgaaaatagcacatgcatatagcataaaacgactataatatatactacttactagaatgttgagcaaagatgcccggtgctttaggaggtgcaacactacgtggactccattttaccgagtaagcagaatcagtgaattcggccttctcaccatcttgtgaattatgtaataacagaattaattacagggtcaattttgtttatggtttaattaactactagtactagagaataccaatccaattgatgtagcataaaacagtacttacttggagaagcagggaaggtggctggttgtttaggaggcccatcagcacgtggactccacttgactgggtaagcagcatcaatgaagggagcattgccatcttgtcgatcatgtaacagaattaggggtgaatataattggactaaattactagtactagtaaatgggattaaaaacccactatgtataatattcgaggtagaacaaccctgcaatacttagagcatctccaatagcttctccaaatcgaactctccaaacacccatatagccaactctccatctgatttagctagtcaaactagatgctctctccaacagactctctattaatcctctccaaaataacaatggacccacacgtcagcctctactcctcttcttcttttctctcccccttccttctttcccctttcttttcttcccattcccttccctgatgccgacggcggccgcgcgtggtggctcgatgatgcggggaggcgggaggcgagacaatgtcgacctcccctcgagctgccagatctacaagggggcggcggcggagctcggcggcgacgtctcgcgacaatgaccttgacgacgacctggggagacgacgaccttgacgatgctcggggcggagctcggcggcagtggcggcgacggctcgcgacgacgaccttgacgacaacccggggcgacgatgacctcgacgatgctccgggcggagctcggcggcggcggcggtgacggctcgcgacgacgacgacccggggcgacgacaacccggggcgacgacgacctcgacgatgctcggggcggagctcggccgcggcggcggtgacggctcgcgacgacgacgacccgggcgacgacgacctcgacgacgacccagggcgacgacaacctcgacgacgacccggggcgacgacgacctcgacgatgctcggggcggagctcagcgacagtggcggcaaaggctcgcgacggatctatagaagggcgacggcgagggcggcggctcgcgatgacctcgacggtggctccctaccgccgccgctgctcgccatcgatttttggcaagcggcggtggtagggatttcaccggcaaagggggagagagagcgagcggatgcaaagaaagagaatagggaataggtggggcccacagatggctagtgagtttggctggccaaatttggctactgaggggaaggatttggccagccaaatggcttggcaagttgaatagagaggctattggagtactttttttttcaagaattgacaaaatttaacttggagagtcttttgaagaggctattggagttgctcttactcggtagatgatgagcaacgaccagcgatggcgtggacggatcctgatctggtttccacttcgccgggtatgcagcatcagcgaattgcccttctccatcttgttatgtcacagaaacacgggttacttaaatgaattgctactgaaaacgacaaatacagcgtagaaatgacaatcaaacattctcactcggcttttctcaagaaaaagaaaattcttactcgtcggcagagtaggagaagccatcttgttattttgtaacagattaatggagtcaatttaattgatgtactacactgaaatgcagatatatagcacttaaacgacgcctgtctgatgatacttactcagttgatcaacacagttattacttaattactagaaaatcggcgtgcttattggcatgcttgcttaagttagcccgtaattttgtgtgtgtggagtatttgtatactgcttaattagaggttatttagaacgtgagaatttttaaagcaaataatccggtacttaaaaagttctatcagcatcatacctttaaagtacccttttagtgtgtttttagatttttttttgtggaatactgaggaaaaaacactgcatcatactaatatacgctaacaaattgatgaaggttgtatattagatgaatagaaaagtgtgttttatgaatatttcatctcacttttataaattcaaaagttttgcctataagctgttaaaaccatataattagaaggaaaatatgttcatgatgtttacacttgctactaattgttttatcttttctagaaatataagataaaaacaaagccaagttatatgtttccaaatctaacctaacgcaaattgtacttatttggattatttctcaatgacttttccaaagcaataaattggtataataagaaaaaatattgcatttttatattttgatttctttatactgcacattcctttttatatatttttattatttatttttttttcttttaaaataatattatataggatgctgataacatggcctatgtacttgccttgattttcactttaatctacagtaaccgtatctgttgttgaggaaatatgaatcataaaaatgacatcaatattgaacgtcgattattattaatttttccaatgtatcacaagttcccaacatataaatatgactaaatatgctaatagctttgtggctgagttttttttttaaactcatggatagctggtactgcagctggttcaggcgttcagttgcacatgcgtgtgagtgcgaatatgcagccggctcaaccggtcagcccgcattctcttgtgtatttgtgcacgcactgccatgggccaaggaccaaaggcggtaagcccattgggctcatttcatggactctgactaggatgccacgctagctatatataggtgcaaaaagttgttgaaaacaaaacttgcactattgacataataagtactgtgattaaatcatatatatttttttataataactctaagatataataattagattaaacggttaagaagtttgtttgtaataagcttttggtacgcgtacgtgccgagtgtttacacgagcggagtaataataataataataataataagcagcacctgctggagtatcatgtccgtggccgacgaacgacacctgcaggttggtgatcttgttgttcgtcctcgccgcctgcgagctgtcgtcgacgtaccggccggcctccttctccaactccgatgtcatcttcgtcgtcgggaagcgggccaagagactgcgcggggcccgggccgtcgccgcgtgcgcgcggcagcagccggcggagagcgccgccgccagcaagagacaggggaggaaggacgacgacgacgacgacgccgccgccgcccggaggctgaagcggcggcgagctgcggcgcactcgttgcccttgcccaccatggtctcgccaccaccagcttcctctagctaaacacacgtactgtgatcaactctttggaaacgaaattgaaggaaagaaagctagctagctaaacgcttgctgctgctgttgctgcgtttggagcgcgcggctatttataggaccgtgagcggcgagccaggcaagcagagatcgatcgatcgagccagctacacattatattacacacacgcgtgttgcgtatacgtgcatgcttgcgcagttgcactgcttccgccttgtgaggcagctgatcaggtgagggactcggtcggtctctggttctggctgggtacgtctcgccgtgcaacagagctgcaccgtacgcacttacatatcctcatgcgtgcacgcgtacacgttttcatgctctctacctagctatgttgccatacaaaagtgacgcgacctgcatgtcagtaattaatgatatatatcaagtgagcgacgacaaatgggtttttgaaactgaaaatccagaaaccacatgttatgtcaggctatatatatacataaacgacaaattcccaaccgctatgctatatatacgtgtactcaaatactttatttaattttattactagccttttaaccaagtcagtcattattactgccatgtgtatatatatgcaacacattttgtgctcctattgtactttctcatctcacatctttatatgaatgaagggaaatggtagtttttaggtgactgagatttggtgttcacctgctccctacccattggattgaaatccaacgtttagagaattgtcttcaaccacttctcggcgatggcaacagtgatgaagagatcctcgccgatccctttatctttctcatcgccagagacatccgattgcggtacatgacctacggattagagttagggttttggggctagggttgggggaagccgtggggttttgggaagaaaggagcggtttctcccaggattagggagatggccttctggggtggcctgatcgacgatgagcggcgaggcggcggaggcgctgctggagacgcggagttagaggcacgcaggtgggtagggttggtggcaggggtgagggatgtcatggggtttggaggatgtggtcatcggcagtgaacccgatagcaccacgccgccgccagaagattagagaggaagagagaggtggccggtctagagggggctcgccggcaccgttgatggcttctggctagctagtgagccatggggcgaagtgcggtggcagtggaggcctcagtgctcagtaagaaagcaaggcgtggcgatttgtcctgagtctcatgtgcgtgcatgcgaactagaaaagagaagaatcgttaagggagagataatgagtatgcacaaatcttgatgcgatcctagtcgtccaaaaaagtgactgaaatttttcggatttttcatcagttacattaaagctagacaagaccttatataaatatgttataaagtatacttgtagcatatcttatgtgttactatgatattggattttcccctgtaactcacctgtttatgttttactgggatatatatatgtaatatgctacagtagacatgccctgtagttatgacctcactttatgttgccatacaaaaatgactcgacatgcatgtgaactaatcaagtgagctacaaatggtatttgaaaactgtccatcaagaaaccacatgttatgtcatgctatatctatacatctatgacaaattcccaaccgctacacatttctaaagcaacaaaatgctatatatacgtactcaaatactttacttatttttgttagtaatcttttttaaccaagatagtaactttcttcaattcaaaaattgaaaatcagattggggaaagctgtatataatactctcctaccgctttactctagtactctcctaccgcttgtacactataatagtgaagcgcagcagcagagaagtagccagtattaatgatactactcaaatgtaaatataaaaattatagggactcaattagaaaagtacaaacccaaaaattaaaatcatataaaaatggaatgctctcgaccggtaggttccgtttttgcacacagatctttaatccggcacatcaattttttttcaccaagatatatgagatatcacgatatagattgaaaccgagaggagtgtccctgggatctcggactcaaaccgatgccgaaaggagtggtgtgttttattttccgtttttaaggaggaatccactagaacggataccctcatctcaattgggcggtaagccccatctcaatcgggcatggcggccgtcacaggctagaagtcactgatgtgaagagttatctcaatcgggaaaatggccgtcacggatgattctatctcaatcgggccctaagtaaagcccgtcaccgatagctttgacccagacgaccagtcaaactatagcctgtcacagatgaactatctcaatcgggccacaactagcgcctgtcacagatgaccctgatctgtgacgggcattacctatagcccgtcacagatgagtcatctgtgacgggcattaacccgtcacagatgagtcatatgtgacgggcgttaactatagcctaagttaatgcccgtcacagatgagtataattaaaaaataaataaattttattttttggctagccctcactcgtgtgcacccacgcgagaagttcaaacttaatgttaaagttctttaaagattggcttccgaaaaagtagttgtaacatggtggtatgagtattctattaatcctattatgccctaagccaggatgtccccctggggttattaaatgatttgcaggatgtaaaatggggttattaaatgatttcaaatggaaaagtcaccaaact

SEQ ID NO: 14167 - DNA, 4152 bp, Oryza sativa
  unsure (1)..(4152): unsure at all n locations
cctcgccccttgaatttgatggnnnnnnnnnnnnnnnnnnnnnnnnnnnnnnnnnnnnnnnnnnnnnnnnnnnnnnnnnnnnnnnnnnnnnnnnnttcaaaaaaaaatgttatattgaaaaatgaccaaactaaaagttgtaaatcttgataagttatacaactttgttgttgacatttttttcatttgaaatcatttactacccgtaaagttattctgacttataaaatgaattattatactgcactaaattattttgctatagtcaacttacaaatataaacatttcatatgaaaaatggaaaaatagtcatcggtgaggggatttagttaatgcccgatagagattaagtatattggccgtcactgatgagtcatctgtgacgggcctaattgttatctcaaacgggcctcaagttggtgcacgtcacggatgatggtcatctgtgacgggccacaacttgaggcccgtttgagatatggaatgttatctcaaacgggtctaaagttggtgcccgttacagatgatggtcatctgtgacgggccgcaactttaggcccgtttgagatatggaatgttatctcaatcgggcctaaactacggcccgtcactgataggtgtcatccgtgacgggctttagttttatactcatctaacatgtctgtgcaaccatatctcaattgggtacttttcggcccggttgagatgacttccttgtgacggcccgctatttctaagcatattagagcccgtcacagatagaaggatctgtactagtgatcggatatagagtcggactttttttttcgtttctgagagagagtcgaacttttttttttattttttcgctatttattttgttttgaggaatgaaggaaacacctcttttttacatagtagagattaagtagtagagaatcgggctgatttttttttgattttttttcgcccttttttaccagagttggattcatttttcttttcgtttattttcgccctttttctggatcggacatatttagtttttcttttctttttccggttttttcgcccggtttttagatcggacagattttttttttcttttttcgcccggtttttttacgtttggtttttcttttcttttccggtttttcacccggtttttttatcggaccgatttgtttttttttcttttttttttagtttttttcggacgatggaagcaccttttattttttaagtagtagagacagacatagagatctctacttaaaaacaggaaattcccgtcctccgtaaaaaaaagaaaaaaatgtccgactcaaaaaaggtaaaaaaagagaaagaaaaaaaagtccgacttaacgagcgaaaaaaagcttccatcgtcagtaaaaaaaaagaaaaaaaacatctcttgtccgactcccgtagaaaaaggaaaaaaatctcctagtaaaaaaacaaaaaagttcgtttggttttctttggcaccggtatttttttctgttttttctttgcacgcaaaagagtttttttatgcagcgcacacgctaagccttttggttgtttgtcccctttttttaacccgatctgttcaccgcgcgtctcccagacgcttttagtttttttcgtcaatcttttttgtcaccggttttttctcccgtgagctttttgtttttctcatctgattttataatcccatctgttcgctgcacgcctcccgaggtgaaccctagcgctgtgcagttgccatatcgatcgtgtgttttctcctccaatttgattgcaaaaatcgattccccaatcctctctcatcattgtctccatgattttcccttcgattcagctttaattgccggatttaatctctattttacacttgcctctctcatcattttctccataattttcccttcgattcggctttaattgttggatttaatctctgttttacagttgccgatgatgacggcgatcttccccagtcatttttatcctgagttttacgctctgattttggggaaaacggaaagagtagatcgagtggataaaaaccctcgaccaattttggctgatctagaaagattcggctagatttgatggggcgatttgattcggcaaatgtacgggcacggacacaggattatcttcgggaggttgaagatggtagtcatattcgggaagttgaagatggtagggtcgaagagaagcagatcaaatggagggaggtagcgcactagcatagggctgaaaaggaaggaaggctttcgaccgaaaacccaggaaatattttcattaatttttttaattataattatagcgatcccaatgttatgatttttattaactttttcaatcatagtgtatagtgatcccaatattttaatttattactcagctcttaatataacactgaaaaaagtcgttacccgttgcaacgcacgggcatcttttctatatattgagaactcataaactttatcattatttgagaaacaggtaggagtagatgatttatgcaattcgctgcactgattgttttcaaagatctagcatagcagaaattgttagattactgaatgaactttggaagccatagtaaaaaaaagtgacttaacaaaggagacaatagttcattagcccagttaatttattttcaacagcagacttttgtatgttggtagcttgttaggatcgttcaaaaacatgtgacctcacaattttagatttccatagcaaagcacgggtacttgactagtcttataaaaaaaattgatgcgtctatgaatcttatataacctatattagtagcattcttgtctatggtgaacttctggatatagatgcaagcggggcgggcaagcggccttttttgtcccgcttatcccacttttagtttttttgtttttctgaattgtgtacaattatgcgaaaaatagactagcaagtgggtttttatatgggtagcggaactacccacttgcatccgtacttctggagtaatgctttctcaaacataaacatctctgcaaacacatcatcggctatgcatccagggatttccgaacaacattgcaatttcttagttccattgcacattccgaatacacaactgatcatgttgcaacaggttaccaagaaagtatatttaaattcaagccgaaaatttagtctcggtgatagacttggcccctctttcatctactaatcatggtttaatactctgatcccttggtgtattctgatacaagtttcgaaaataacgataaattgtcttccagaagttttgctggcgagtcagcctctgcgattttacctgtttacaataacatggaattagaacgggagaaccaagctattaactgttggctactaagtaaaccttaggcacataactaaccattgtccataagaatgaccttctcactatcaagaactgatgtgatccgatgtgctatggtaatcaccgtgcattcggagaattgttgcttcagggttttctgaatcaaattgtcagttattggatccactgaagaagttgcttcatccaaaaccaagatctttcgcttctttagaaccacccttcccaaacaaacaagctgacgctgacctgcactccagttgctgccattttctgtaactgcatttcatattaaagtataagttatgagtttgacatcgtggagcaatgcattatagctttctgatatagatatgaaacctgtagagtcaagcttgagatcactctttctaacttcatcaccaagatgacaagagtccaatgcctggataacatatatacacaagtgaactcttttgcccatcgaatagcagatatgagttatgcatatttttttttaaaaaaaacataggtgcacatacgaagcattacaaattatactacctccattactaaataagtatatttctaacactcaagttttgtccccaaaataagtatgattttaaagctaactaccctctctcttcaatccatccctcatttaatttggggtatgaatgtcatgtattttctatagaaatttgtctcccatatgttatttagggatgaaggtactagtaaatttaaaataagaatnnnnnnnnnnnnnnnnnnnnnnnnnnnnnnnnnnngatactcaacntcaatggnnntcaaagggccg

SEQ ID NO: 14168 - DNA, 9577 bp, Oryza sativa
  unsure (1)..(9577): unsure at all n locations
tacctccaaatttgctcatcgctgtactcttcanaanggtcaatgttatttcgtagggtcccctcaacatcacaggatcttgaggaatgatgctcattcttgtccgtagatcatgtagtccaatggtgcaaatgtcaaggccatctatcaacacttgcccaatacatgggtcgacgatgcggaatagtgcttgaatcaaggttgacttgccattgccagttcttccgacgataccggtcctcaatcctctgggtaaagtgcaagttaggcctttcaaaacaaaaggcaactgtgtcgcataccttacctacatcacatacaaagcactttagaggaaaaaaacagttcaccagaaaattatgcattaggtgttgtatgttttccatgttaagaaagaaaatatagttttgggagggtatttctacagcggtatgttgaagtcatacaaaatagtatattatgaaagaggattgcaactctacactactagaaaaaagacctgcatgccaatttttatggaataacttcatgaagaaataaattactccctccgggctgataatacttgtcgttttagacaagggtgaggtatagaatctttgattatgaatcatttttaaaatatttgtctttcaaatatggtgattacatgtatagattagtcttacaaagtactttaataaaatcatatatttattaacacttttatacatattataatgaaaaataatggtcaaagttgtttttttggaaaccgtgctcttgtctaaaatgacaagtattatcaaccctaagggagtaatttaataacatattgtttttctcagagaatatttcgaatagaaaatttgggagttctaatcaataattgatataactccgacattgttagaagtgaacttatataacaacatagagttcaagagacaaacatggaggttgcgaagctcaatttcaccatttgtcggccaccggcagtttggtctactttttgatattgtaaggggtggttcagaaggaatagccatgtattgaaaaattctttcaacggatatcattctattttccaaactacagagcactgcaatagcccacccttgtaacatattcagactcaatccataagtgactgcaagaccagctgtctctgtgaagtagtaaatatgagagttagcacggatgttaatacaataatgaactaatttgatctgactaatcaaattaaagcccaccgtacttacttgggtcaattagagcagctggcaaggtgaccagaagtatcaaggcaaatgcgaagataaaggatgaaagaatgtccaagcgaaagcacaaccattccattgaagcagcattatataaacttggtctagataaattatccatgaaatgactgacggcattgataaactgtatttccttgccaaagcatctaatgatatttgatccagctactgattcagcaaaatgctgcatcacaggagctctgcaaactccagtcaacctctgcaactctctagcaccatctatgtaatattgctgaagggaaggaattgtggtaattaaaaacaaacacaaaatatgagtcgtcttgaaaccaataatgtcatagaaaatgcataattatagttttgaaatatggtaacaattattattgttcaatagcatattttaagacaaaatttgattgttcagaagaacatcggaaatgtacaaggacactcctatatacactaggatcaacctgaaaatttgattgggaatatttttgccaagtaatgtatcacatcatatatttacttaatgattttattttgtattatctgtaattgctttgccatccctttaaattttaaattaaatctgtgaaaagaaaaacactgatgttcaattttcagttgaatctgtgaaaaattgtcaatatagtcatgaatcaatgtatttttccttctacatacttaaaaattataaactggaaccacaattggtatcgaacataagatatataataaaaagaatatctgataccacagagatgctgcaataattgggacaaaaattacgaagactggccatgctacccgtgacattaaaataattgttccaagaagttcgatagcaggaaatagaacatatcccatcaggtcaaaaattctggtgtccactgtgctttgatcactagaagcctgcaattttgtttcaactttcatgattaattgaatatgaataaaaattctaatggcattccaaggagataacttcaattttctcattaaaataaagatggtgaaggtaaattacttactctgttcaagattcgaccgctaggagtggagtcaaagaaatacattgaagctcggaatatgcatcgatgcatcttatcaaatagcatcattgcagtcttgcatccagccatgacaagaagatgggatcttatgaagatgaataacgagctcacaaaagctaacacaacatatacaagtaccattttcaagctattgaccggaggattcacatctttggatattggagcagcacaagccatccaaaaattgcttccaatttgaagaacttgaaaaattatctgagcgagcaaaataagcggcacaagtgctccaccatataccattgtaatatatttccaatagacggaaatcccaacccgccctttctccctctcttcttcttgtaccaactgaccattttgaacaatcccttcttctgctccttgattatcatccttttgcttatctgaaaagcgtacttccactgtcaccaggaataagactacttttgggattgccacttgagtgttctaaactttctagagtagaaatggcatccttatgggaaaatactaattttgtgaactcttctccagaattaagtattttagcgtaattcccaacttgtataatttgtccatctttcatgacctagaacagggaaatgaattgacatggtaaaacgattgttgcgagtagaataaataagtagatttgatagttgttggaagctcaccatgatagcattggctgatggcaaaaattcgacatggtgggtaacatacactacagtttttgaagctaagagtccaagcaagcactcctgaaaaatacaaggtcgtgatgaataactttcatacagtagatatactcttgaaccctaaatattgttcaagaacaagctacctaaaaactgtttagctgaaacatacaaaagatctgattaagacattaggtttatgtccacacaataaactatgcagtgagataaactgctattactgattttggaagttgggaaatgaaaaatccaacaaaaccaacatgttctattcaaacagcactagcactgacaactgaaggttaaaaaaaaccctaaattgactgggagaaaatgtcgttgaaatcatatgatgtaaaaatatattttgtagtattagaagtctcaagtaccaacaataagttattagtttaagcattcaatgatgattacacacatatagaaaaaggatttaaagatttgttctgaaaaataccttgaacaagtgcaacccagtatgagcatcaaccgcactgaagggatcatcaaacagaaagatatctgcatcttgatacaaagcacgtgcaatttgcatcctttgcttttgtccgccacttaggttaatgcctctctctcctataattgtctgatcacctaatggtaatatttccatgtcctttttaagacagcatgcttcaaggaccttttcatacctttccctatgcagttttgtgtcaaaaagtatgttatgttcaattgtcccactctgtatccatggcgattggctaacataggcaatcctaccacatgtttgaacatctcctgataaccttggtatctcaccgagtatgcatgacaacaaacttgattttccagatccaacagttccacagatagcaaccctcattccttgtcgaatacggaagttcaagtttcggagagtaggaacctcagaaggtgtgttccaagagaactgaccgttcctcacctcaatcgatacatcagttgtacctcttagaagtttagttacaacatcgctcgatagttcctcgaggtgcataaaagagcatatcctgtcaagtgatacttttgtctggatgatcacagagactgtgtctgggatactattgattggtccttgtagctgcctaaacgttgccagagcagacaatactttccctgtttctaatggaatgcctagaagcaaacaacttccaaaggtgaccatagcaacaaaagcaggagctccaaagaagacagatataagcataactgaggtgtatacatctttctttagccaatgcatctcctccttcctcaactccatgatcttcgacaagaccatttcccatccttgaagcttgagaatgcgcatgttccgcagcatctcagacatagccctcattctagcatccttggcatccatcattttctcttggtaattttgctggatcctccctataggtagatttgctaacattgtcaaaacagtggcagcaagggctgcaaatgctgccaaaccaagagtggagtataggatcagcattgctagaataatctgcacaggaaacagccaaagctcatgtatggaccaattgaaatccgcgacacgctcggcgtcaaggctcacggcattgatgatctctccacttgaactgctttctctggactgatttgagagggagaggcccttttggtaaatgacggcgacaagagctgagcgtacccgcacaccaagttgttgcgatctgaagagcaaatgccttgatgagaggccttcgatgaactgcgcaacaacaaaactcaacaccaaaatgtagccttctttagcggactgtggacttcgattcaggtagtcaacaaagtactcaatcaggtatggaccaacatatgaagagacagtacggagtaaggcacaaactgcagtgaagaggattaatttccaggttgtaagaacaagagctttgaccaagttaattgttgtaacatcggtgtacttccctgaaccagaaactgagacgagcttcgcctcaaagttagggaggatgccttgaacactgtcattatcatccaaagttggcacatcatcaagatctagtgctttcctccttccaagatcaagtaacggccccatccaagaaaaagtgataatactaaagaatccagcatctgtgaaagctgatctactgcttgtggccttagacgaggaagaagctgcacggtccaaaagtggctgatccatgaactcctgatcatagaacaacaaactttagaaagttacaactgattatttatgacgaagaaaaatataaaagtgttaaagtcaaaaagataatttcagtctgtccatggacgttaataggattacagaaagaataactaatttaaaggaaacaaacataactgtgagtgctaaagccatatgtaacatgcatgaaaaacatccggatgaatccgcacgataccacggagttccattgtcacccatggtaaagatgacatcacagatctccaagaaaacaaaatcgagacctagattacataaattgcatatgtaatacgtatgtaatttaatatgtgctaaacttcctcgaagtaaaaaaaaaagatgtaccgaactttttaatttagcaatggagatttttttaaaaaagtatccgatctcaccattctcagcattgaagcatggactaaatataaaaatagcaaaattagtgcaaacagactgaaaatgagaatatatgttaggcattactccttgcctatcctcaaaaagaaaaaaatatatatatgaaacaaaatactgcacgcatggggaataggatggtgtcagccacaaatcaaaaacgatgcgaaatttctgtaaattaatcagagactggctatagttggacagattctgttcattcttggctattccgtggcagagagggagaagagaagttggcgatctcgagcccaccggcgagcgtcggcgtcggcgtcggcggcgatcacggagaacctatcacataaatgccgcggtaagggtatcgagcctaccagtaggggctagcgcgacggtgccaaaccgaccgaagaggagccatgagccgccgccgccacagcctttctggtgtcggcgtagtttttctcagtgatgtccctctttttttttcttttttttttgagaagacgtatcgatagttggaaagaagacgcgactcactcacgtgataaagggagacggaaattacctatgctacacgtgcggtatgtggttttctcaaaatcttatgaaacacatcttgtttgtactccgtatgttgggtggcgagtttatcaacattttttttaaaaaaatatcctataataattatgaacaataaaaagctcttatagaaacttatttgcagtctgaagatcggttttcttcacatgctctacaaccgtagcattatcaatgtcatgcctaaaggttattttaaaattgagtaaatttggagtttattttaagagtctttttaccgtccagcgctcggtaccggtaccgggtggtaccaaattcctggccagatccaacggctcggtaccaattctatccttgtacaataccgacctgaaaactcagatggaagggcaaaaatgtaacttcgcaatgggaagcctagatcaaatggatcgggccgtgccgccccgccccgtcgacgtctccctcttccgtgcctcacaccccccgccaccgttgtgcttccaccccgctgccgccgtgcttcctcacccccgccgctgccgtgcttctgccctgccaccgccgtcttcatcctctgacaccgcgacttcgatctgggtcgccaccgcctggatcgatgccatcaacgccgccgccacctggacatcaactccgccatcgccaggatcaaccaccgccgtctcctggactatcccgtcgggaacgacgactttgacgccgccgccgccgccgggaacgacgactcgaacgccggttaaatttctctcccgacgctcatcttctctcccgatcctacccatcccgattcaacggttagatttgttttaccgcccggtacaacctgctggactgtagcaatcctcttattttaaagaaaacaataaaaatattagttaagttcaaattagtgtggatttcacgtatgtaacgcttatagcattatcataatccccgcatgttagtaacggtttctttcttccccttatcatctattttcctccatctcagtggcaacagctaaatctcttcaactaatgttcacttgctctcgtgctaggggtggggggcagcggctgcgtgagtcgcgcaggcagtcgccatgtctgatatagccgtcaagagagaaagctcacgcgatgagctagctgcttcgctagctaaatggagataaacaaaacatttaattcatgcatgcacaaccaaattaattggcatgatcaaaactaaccaccatccctgtagctatttgtgttgcctgtgctctagcgtgttagatagggagaaaaacataaatacatgcacattggatagtggagatatgtcaggcccaccaaatatgtcaggtatcacccgtatcagctacaagcgagcggtaagagcctcgtttctcacactatcgcccggcaacagatctagcgtccgttttttctctttcttcttttctccctcaaccacataggatttcgctgatgtgtaacaacgtatagcctgctgactcaaccttattatacctgctctaaaaagtgtaagtcgccctcctcctactacatcgtaattcgttgtaaagaaacgcacctcgacaaaaaaaaaacacatgttttccacccaaaactcatcccaccagtaaaaccagatggttaaaactcaaccctcgtaatttttccttctaatcccttggcaaagtaagggtatagcgctagtaaaatttaattaaaagttgagtaaagtaatatggactatttgttttgaaaaatgaaaacagattctcgaatcgggtgtacatggatgaatacaaggaaaagaacaagaggaccaatgtgaagaatcaaaatagagatgacaagtctgcaggcatatacttacctgctagcttcttcgttatgcctaaaagcctaacaaatcgatcagtacgatcggtcgctccccttctcaacgccggctgctatgcgctgtgccaaggccagccgtcttccacagggtttcatagcagaaggggttcatatgtactgcactcctgtatttatgtggggattttttttattacagtactagtacagatttgtttaggctaatccaatagaggtaataatcatatatatagaaggaaaccatctaattcgtgcccttcttatgtggagaattaatgccccttttatttgccacctacagcaacacaagagtatgattccttaattaatgaaatataatcgcacctgccatatattgaaatccaaatttacagccgtgggcctgtttggcaagtttagagaatactgcgagtttatataagggaaatagtagtgcggctgctgatagttttgatgggaaattaattaatggtaagattagaatttgatttttaagtctagcatgttttgtgatgaagaggatagaaagttttgatgggaaattaattaatagtaagactagaatttgacttttaagtcctagtgtagcatgtttggtaaatgggtgcaaagtgatggaaattactattccctccgtcatatgatataacaacctagtatcgaatgggacactttatagtataacgaatccgaacatgcttcctgtccagattcgctgtactatgaaatcccatccggtcggagggagtatcttcctagtttctcaataaaagtttagttagtccctttggatgcaagaatgaatatatatgtctagattcattaacatctatatgaatatgggcaatactagaaagttttataacgtgaaacggaggaagtagtttgcaacatcaatttctgcttaggtacagctgcatctaatttcttaaccctgttgttactatgggccatttgcattgctagttcagtatatactaccaaaatgcccatgcgttgcaccgggtaatgtcgtgttggataaagtttaactgagccatcttttaagcggtctagtatgacaataagagtgatcaagtaatcgttcataatttttcagcaattttaaaatggctccaaataataccaaagaaaatttctataaaagactaaataaattaaatcgacagaattaaataaaatcttattttggtctattactttcataaccagcccaaaaaattggaccggcccgttcagcgcaagcacacgagccaattgcacagcaagcgggccatcctactggcgatggcctgacgcagggcgaactgagcgcggcgaagggcgcacgacccagttctctnnnnnnnnnnnnnnnnnnnnnnnnnnnnnnnnnnnnnnnnnnnnnnnnnnnnnnnnnnnnncaagcgggcgtatcatgcaatcaagggnccac

SEQ ID NO: 14169 - DNA, 1367 bp, Oryza sativa
  unsure (1)..(1367): unsure at all n locations
cccttttttccttccttgggggggcgtctctccctcctccacccgagttgtcgcagaccatatcgaccacggcttcaaaggcgtcattcatactcgcgtggatccgccaccggcgcctggatcccgttgtctctcggcgatggccccatggcagctgcaatggccaaggcgcgtgggcagcgaccaaatttgtgggtggcggatctgccagccggggaggcttgaggtcgcggaggcgactgagttttggcggccgcctcacaaagttgccaccgccgcctgcttcctcgacatcgccgccagtgagagccgccgttgctgggaatcacctcccggtgtctttatcgattacctagctccctcaacaccccgacacccaagagcctcaccagtgagggccgccaccaggttagatccatgaaatctttttgtaattatggggttaatttcatctgttttttagtccagatcgaatatgcatctgtctttcgtattgaacttttatccgccctcccaatttttgttcagttttgcttgaatgggggaggactaggtagggactcttggacttacggacgaaaaagagaggtgacgaatggaaattacgaatttttagattttttttaaccgttatatagatatatgggatataagatctggtttttacggtttttatagaaaaacggcaccgaaccgacgtcaggtggcgtggccatgtggagctgagtggagcacgagatgaggaaaaaaatatatcgcacttctccagttctccttatcctcttgcacctccgtctccacctctccccctccctctactgcaagaattttcagaatatgctatcgaatacacactgctttcaggatatgccactcaattcggtctactttcagaatataccattagagcacgaattttttcatttcgtgcccctccgtctcttggagtcagtaacgtcgtcgtcgggccgtccgcccgggcaccgccgttgtcagtccgccactgcggcgccggcgcggcgttanccgcgccgtcgtcggtctgtcgctgccatcgtcatcaacaaccgcccgcacgcgcccatgtcagccgctttgtcgtacatccacccgccggcatcgtcgtcctcctccgccacagcttggcgagtgtgctcggggaggagcaccgtggttgggcccggagcgcaggtggtggacgcacgcgagcgcaggcggcggaccgacgatggcacaggcgagcgtgggcagacgaactggctaatggtgaacgacgacgacaacannnnnnnnnnnnnnnnnnnnnnnnnnnnnnnnnnnnnnnnnnnnnnnnnnnnnnnnnatgngagctgcagttcatgnggcag

SEQ ID NO: 14170 - DNA, 816 bp, Oryza sativa
  unsure (1)..(816): unsure at all n locations
cggctgtgcatccagttcaacactgaagtttattctacttattttttgcaccttattttcactcataagcaaactgtcttggtctctgcagctgcatgggaggtgaacggcaggaattcggcaagaatgacatgctgcaatttcgtggtctcttcaagcacgtgtactaattatccttacattctgttgctaaactactgatatcttcatactagaaatatgaaattattttgtttgtcacatcaaggcttcgtagcagccaactgcatgtactatttcttttgaactaaaatagagtgatagaagcccaatgaggtactactgaactgctagcagcatctatcttattctccttatagctcaaaatgtattgcatagttatcagtcaaatgaaacatgactccactatctaacttattgttctatttctaccagattatgtagttctgcaacattcagcgactgtaatggcatatattttttttatggcatctcagatttatgtcccgggtttttctgcgcacaatatttttccctttttggtaatttacataactactccctccttccctaaatgtttgacaccgttgacttttttaaacatgtttgaccgttcgttttattcaaaaacttttgtaatatgtgtaaaactatatgtatacataaaagtatatttaacaataaatcaaatgatagaaaaagaattaacaattacttaaannnnnnnnnnnnnnnnnnnnnnnnnnnnnnnnnnnnnnnnnnnnnnnnnnnnnnnnnnnnnnnnngtgncgtgtcatcaggngtcaaaanngccag

SEQ ID NO: 14171 - DNA, 5840 bp, Oryza sativa
  unsure (1)..(5840): unsure at all n locations
catggattgatttgcaatcaagttnnnnnnnnnnnnnnnnnnnnnnnnnnnnnnnnnnnnnnnnnnnnnnnnnnnnnnnnnnnnnnaaatacttcatcagcacagttcacagaaaacactaaaaacacaatatatgtgcaattacagccattattaacttacacattaaaccgcaaaaacgtttgaatgtacgtggcatgcggacgtaaggcttgatttcaaacaatactcccttttcagtcctaacataaacagcttgtaacctcccagctttagttagtgggctatcaaatattgcaagaagagcctgcaaaatattaagaatacaaattatgttggctttgagaaagcaggtataaaacaaatgagagaaatgaatgactggcttgaacaatttctttttcattaatcacttagatgttctttgtaaaatcaccacgaggctctttcaagaatgacttcattctggtgttatgtgcacagcaccaactacagaaatcagctactacttctgtcccaaaaagaatgcatttctaactatgcacctgataagagtatgtctagatgcatagccagaataacattctttttgggacggaggtagtatcctttaccagaggggccattctgtggttagcccccaaaagtgaggaggtaaatgccatggaatgtatatatcctcaataggggaagccaaaatagaacacagataatgatgtggtacggaatgatttcaaacagaaaattggatgtctgctttcgttcagtttcaaacaggggttgtacagatgtgagagaggacaggctttaatcatgtgccattaatccctgggagctccggaaatacaagaaattcgaaatacctggtgaatgatatcaggcctgtaatcagctggattcctgttttgcttcctcaaataattagcatggtcatccgagttcaggatttgcatagtctacacaaagagtcaaaagaatcgtcaaaaatatcattcgtgcagcttaagctcttcaatcatcagagctacagactgatatgttcagatacaatatagctaacaaagaattgtcaaaagtatcattcgtgtagcattaagctcctcaatcatcaggtatacagaatgatatgttcagatacaatacagctaactcgttaacaaagtatacagctgaattatcttctagcgcaaacaaatttatcaagataagcataagaacagaactaatccaactatccaaactgtacatccaaagccagaaacggattggtcgaaaaaaaagcgcaagaaaaaggtgtaataaatttgttggcgaagcttcgccccataccttgccgactttgccgacctcgaggcaggccctctcgagcacgaagatcgcgccgggccgccgcttcccgtccaccggccgtggcacgacgggtagcccatcagcaaccttcccggccgccgccgccgccgccacgtcttcctccttcccctcctcctcctccaccccctccggcggcggcagctcctccgccgcctcttcgtcgaccgggggctcgcgggaggccccgccgtcgtcgagcttccgcttcttcttccgccccttcaccgcgtacggccgccccatcggtctcctccttcctctcgccgccgctcgcacgcgttgcagtggtgtggtggggtttcgagggggaggaaagctagggtttttggagagggtggcggcgatttcttcttcgtccggaggtaaatactgcgagtgatgtgagccactcatccaattaatggacagctgagactttttggcaaaataaatttgtataatatttagaaggagaaaactagaactaaatttgtataagtatttaggcttagggtgtgtttggttcacagtcaaggttggatgggatatgacgagccagttttttgtttggtagagtgaatatggcaatccagtcttttgtttggttccagggatgaagatggatttggtgatccatttttttgtttggttagaaggagtaggatggatgagtggttacaatcacctcatcattagaggtggtgagtataccccttcaaattcaccaaactaaaaattatcaatgtactgcaaaataaaaaatctaaagagaaataaaaggggaaaaaggagaaaaaaagaaaaaaagttggtccttcttgctcttcacgccggccgccgcctcaccttcttgcacgccggccgccgcctcgcccgctcctctcaacggccgccgccctgctcctctcgacggccgccgccccgccttctcgaccgctggcctccgccccacctccttccccaccggtctccgccacgctcgtctcacctctcctccagatccggttgtcgccgtcgtttccttctacaccggccgccaccccgtctccttccccaccggccgctgccccgtatcctccaaatctagtcgtcgccgtcgtctccgtccccaccggtcgtcacagtcgtccccgtctcctccggtcgtcgtcgtcgtctccgtccccccaccggtcgtcatcgtcgtcgtcgtctcctttcctcctcccgttgcagccgcctttgggcttgccgctgccgtcccctcatccttattccgttgccgccgccgtgcaccgggtcgctgccaccgccgcctccttcatcccgctgccatcgccgcttacccacatcgctgtttcgcatggtgagaagggtgacacgacccacgtcgtcgctcgccccgctcacccgagcgctcgggcggctccatccggccaaatcggccagataccaccatccggcatctagagggaatattcccctccgggccgccctatcccacttccgcccaccaaccaaacacccacaaataatgggccgccatgtcctatccacccaaatccctccatccaaacacaccctaagctaaggctggcaacctttcgtactagcacataaatcgaaacgatccattaacgcataattaattaagtattagcttaataaacttaaaaaatcaattaatatggttttttaagcacttttctataaatattacttttaaaaaatgcattgtttaaccgtttggatagcgtgtgtatggaaaacattagagtcaagttaggcaattgttccgaacgtagccttagaaggaggtgactatattcaaactcccttcatccaaatttaatcattatatattaaaaaagctggatcttcacaatgttcaattgtcacatttgaattggtttcttattgcgtctttgatccaacatggtgaccctttcggttccatatgggattactccgctaccctctaaaggttggaccaatagaatttgacaaacaacttctaaattcctattatgttgtagcaacgcttttcttctccatgatttgtgtattaactgcaaccacctgcatgagatggacggtcgttttcatgtagaagacatgatggaagtgaagggaagtgggcaggtagacattctagggaaagggagtgccatggcgctgaggtgaacatgtatgattcctgtgatgttcgtgctgtgaagaattccttggcctgatgacacaaaagttcatgattcctatgttgttgtggatgttcaaggtagtgtttgtgaccgagagcgagatatatggtgcacatgagaaaaagcttcttctattgtcccaacatcgggtttgggagtttttatttccacctgatccctaagttgagcttaactccacatttgagcatgtctaatatagggttaaaggacccagcacattttgccatacttcttttgcgcaaatgtggtctaatgacttgccattatactctccatcccttttgatcttagagcatgtacctcgtcccttttacgagctactagctacttgttcaaaaataccacgcggtgcatggtactatattaacataaagtaagtatatagtatgctaaaacaaccacattagtaatatagtaattgatgaacaaccacgttaataatatagtaactgatgatcaggctacaggccgataatcatgaaaacaaatcctcaagtctacaaggatacaaatccacgatttacctccttgtagttcgttttaacttgccgatgctaccatcatagctatagcctttaaaaactagaggatgacgaggatgagacataatatttgataatatttgatgttagaggatatctatcacatgcatacataggatgtcacgagaaaaaagccaaagctttagagaattcgtatctactatatctgtctttataagtgtgctcatagtatagaaagcaaatattattgattactaattgaatttttatctatgaggaggaaaatatcagtttcactggtcttacactcatgtaaaatcatttttgttgtagaaatatagaaaaacatacagagggcgctatttcagccctctatttccagtacttgtggaagaatattccaccactatcttaacacatattttatatgaaatacggttgaaccatggattgaatatgaaacatcaagcttcaattactgaaacatcaacaaatccacaagaatcagagacaaattgaaacactataaaaaatcccactgcaacatttaatccaacacaaaaaaaaacatcaagatacattggctgaaacattaaaaaattcgcaaaatataccacccataaaaaatacattgtcttcttcctatcctgtagtgatggcagaggaggggtaggccaaactaaagagctctgaaacaactttgccactagcggaggacaaggctgaagaaacgacatcgctggcgacgaagcaggggcgacaaggctcgaggattcccgcccagcggtggcaggtgggagaaacgatgtcaatgccgacgaagcgggagcaatggcgctcggggtttcttggcggcaacgacggcagaccagagaaacaatgtcgatggagacgaaggttgggacgccgccgccctctgtgtgagtgtgggagaaaggtaagggggtccaagagagagggagtcacaagtgtaagcgagttaatggaaaaaagcccgatatagatattttattatcacaatatggttagcgttctctaaaatatactccccatatgagatcgaaaaagaaaaaaaagagagccgttgatgcccaccatccaacggtgggaaaggacgcgctatcgtatcgccccttccacggtggagccgcgtcgtctcccctttctcggctcgactcgctcttgacgccctcccaccaaagcgtcctaagcgcaacgagaaaaagagacgagggcaaaagcacccgattgcccccaccccattccctactccccccttaacttctccactggggactgccgaaggagctagatgttagctaccactccaccaccggagaagacgccaaacgagcggtgaccgtagaggatttggtggccgctgccgctaaggtgagaagggaacacggcaacaatcgagaatgggtagattaaaatgagagggcggaggtgaccggttactttaccccctccacgcacgtgcacacactgatagcacgccttgcccccatctggattccctttgcatcgagggagccagggcttgggagcaaagaagaaaaacggcgtttttctcgggtcagggctaccttctttaaatgaaccaagcccggcctcgaagggcttgcctctaacccaacgagctttccgcgtgtggatatctcctgcggaggcagggtgtaaccatgcactccaagagacccttaaacatcaagtatggctaatattcgattgcccctgaaagggaaagtgatcaaaattcccttgcgcttaacaacccgtcccg

SEQ ID NO: 14172 - DNA, 24026 bp, Oryza sativa
  unsure (1)..(24026): unsure at all n locations
gtaaaaactggatagcaagcttgttataactggttgctgacacatcatcatgacccctgggctccagaggggttgacgccaggacgtataaggtggggacaaatctagtttataganatgttttatttttnatatgccgccacccccccacccccacctcgccgccgccgccgccgccgcccgctccccggcgtctttcgccggcgaccgcagaaccgaccccttccgttcccccgcgcccccctcccttgccgcggcctcggtctcccgcccctcgtcccccctgcctctccgcaccgccgggcaaccagatccgcccggtttccaggcatcccctcgtcgtggtaagccctagcttctgattgtttggttccgccgcgtgtgccccgctgagaaatggaatacttgttttgggatcccgtgcgattcgttgtcggagtgcgctgttggattggattagattggattggtcccccggatttgttcgatgctaggatgcaatccgtccgtagggttcgtggcagatatgttctgttttgggcgtgcggagggttcctgaatttcctatgatcctagcctcctagatgcatccgccagccccaagcggacaagctcgaggtagaaggcgaggcgagatcgggttacatggtgattgggttcttgtggagctgttttgacttgtaagctgggtatttttggcatgttggcagttggcatatgatgttaactaactgtaggggtttgatcttggtggttcgccgctagactctttcacccctataggaatctatacggtagttttttggtgtgtggcaatgcatctaacttttttgttttcatcggtctggttgttttagcatattgtattactgtatcaattttcctttcatgtgcatatcagatatgaaccatattggtagtcttaggggctctttggttgcctggatctaccctggctcgcatgggagatgcagacgcgtccgcttgtttggttaactgcatgccctttggagcctggctgagttcatgcaaaagtaggttagccaggcccgagagaaacggccgatttcttcttcgctcctcagcctggctcactcgatgcaaggtggatgcagcgcgggtgcaagcgttgcatcagtgcgtgcacgtgcgtggcaagggtctagcatccgctcacctcctccctctcattttcatcttcccattctcaattgctctcctcttcccctctctcccttgccgctgccgccaccaaatcccctgcggtcaccgctcgtttggcgtcttctccggtggtggactggcagctgacctcgagctccctcggccgaccccagtggagaagctactgccgctattacatcccttgccatctccatcgcgtcgatgcgctgcctctcttttctgtcgccacaactgccttctccgaccgccaggccaccagatccggtgaccatggtggcgttgagcagctgggagcgccgatgaagcaagtcaacgatgagattgagggtttttttttttgttttctctgttctattttctactgagagaagagcagaggagcgcgcatgtcagatcaggatgagaggccagcgaggagcatggtactggccggcgacagaggagctgggaacggctggcggcgatgaggcaagaactcatctcctcgacaacaaggaggaggacaaacgcttctctctctttttttttcttttttttttccagcgctttgctatcaaatggtggaggaagttttgttgactttttattttttgagaactcaagaaatttcacttttggtgcagagaatgccgggtgatttttgatgccaatattattctttgtatgtgaaaaattgtttatacctattgtctagatttgaaatttttgtaggtaacctcacccaactaaatgaagaggtaactagactcaaatctatccaaccaaccaaacaaaatcttttccaaaccgcatctctcatgcactcaaccaaacaaaatctcatcccaaccgggctaaactgatgcaaacaaccaaacagttgcatgtgtatctcttcatccaggctagactcaaccaggatgagagagatgagccaggctaggaaaatgcaagcaaccaaacacacccttaatgattcattgctgagctgttgatctatccttgctttatgcatttttggcataggatgtgagctcagaatgtaggccttccttggactgacttgctctccatgtttttaccaatgaataaattgtacttgtccaaaagtaagaattgaaattctttttgtttgcattgttcccatgcattcttaactcacaagagcaggacatcaaatgtgttatgaaatctgttggcaatggcaagcatccctgaaacacacaacatatgcagaataaacttaaagagcaagtgtttgatgacaagttttcaaatttttcaatgaaaaacccatcttaatgaatatgcacactgctgtacaagcctgtttgcaaaatttacacttaatatgctaggtccataattgcctacagctcaaagcacaaaaagatgtgatccatccctgaaatatcatgtgcagagagtatttccaacgagtgcacagttcaccaaaataaaatctaatgagatgaaaccttagctcttttaacctactagaaataactaaaccgttgaatatatatagcatgccatgtcacttttatttttatcaaaattggcaatattatgtcataaatatgattttcttactatctagcagactcactaaaacttggtagtttgaagcaaccgtttctagttgggcttggttttatattctaagcagtcttttgatgagaaatgttctttggtgccttagcgcctggctgctagtagagcatgacttgcatagtgcaccgtgctttggataatttgagatgcattttctttgctgcatctcgctattgtgcatgtgtgcaccttgtttgcctttggcagcactgctgctggagctggatgttctgtagtacaattttgtgaatatctcaaacagaagaacattgtgcgaggtgacctaaggtcaaatgataatctaagcatctgtggcaagttatatctaccacacactggttaccatagggaatctatcaaatggtaggttgttcgtgtccagtcactcttgatgtgctgttttctaatttttaattggagtatactgcattttctgattttcatatgttggattttgggatgtttgtgtcagtgtttttctgaagaattgttctaaaaacttcttacttaacttctgttatatatcatacaatttcattaacattttacatcttgttgtatctggttggttcaattaatttttaggtgcatatatatattgaaggcctgaaatggctgaacattgggcagaaggttcaaagcatgcttctgcacaagcatcgtattctagatatcaagcaacatctgcaagatctaggcaaaggtaattgtctacttaacatcatcatttagttttctgctagagaagttggtacaatcctatgagaaactaactgttacaattcaattgataaaatgtattctttcttttgattctgtgtttggaaccaatattgcatccatgtgcaatatttgacacagtaaaggtggaattatatctgcaaaccctcttgtgacttattaagtttgattagcaccctggccttatttatcttcttctactcttggtacagtatttgttagcatacaaagcccttttaaaacaacatttgtgaaaagaacctcacatatttgttccagaaaatggaccaaagctatgggaatatattctgcatactgttacaccacttcacctagaggtcagctgtgttggattaagtgtcgtctccactggtagaaatgtcaaaaggtcaataccacatgaattagcattagtattttgataatgttatggcctattggactataacattagcattatgcctaaccaatttcagggtaacattcatcttgaatgtaatttgcaaaagctcctttgaccaacacattgttgttatcataatacttaagtactgcgggaatagcttaatggcaaatgcaactccctgatagagtagcaccatcagtgttaatgccaccattgagccattgtggtatccccatggccccctccaaaaataaactgcatgaggggtcatcttctggataatataaaaacattttcagtaacctgttttctaatggcattataatatgagatcacttgttaaatatataacctttggtttgcccattattgtcaggaacatcttcgatctattagctcagcgagagatttcccctcgaacaaaacaccaagctaaaaaactttggagcaaatctccaggaaatgatgctgattccaatgaactaagatatgcagctacagatgctaaacatgatatatattcatggtacggggtcttactttaccaggatggtttaagcacaatttgtcatgtctgtagtaatgattgagttacatatattgtactttcgattttacacctaatatttctttggtaaatatttataaaccctatgaactattcttcattgtctattttaactgttgagttacatagttttgtactctcactcttatacctaacttttccctggaatgaaaccttttctgtatacagggcagaatcacagtccctgcatcactggtctgccaaatattgtcctcttttgccaccccccaggtctactatcgcagctgcattcagcccagatgggaaaacacttgcatctacacagtaagtttattatttgcggaatataaggattaaagtgaaggcatgtggactaactccatctcttttgagcagtggtgatcatactgttaaaataattgactatcaaactgggaaatgtttgaaagtgctgagtggacatcggcgcacgccttgggtggtatgattatgaacactgtcatcatgttccagaatgtgtgctacaagctcttatagataaaggataaatcttaccctgtccctgctacaagtcactgcttttgttacctaccttcctacaagtaattttggtttattggcaccctcaaagtcgtttcagtctgtaataaccctgtccctcactgttgcctgtaatttcacgattcacttgaccaatttgttgggggatatttcatcaaatcgtcacaatcagctgttctgctatcatcatgtgttgcacgccacatgggtcctactaatttaccattaccacccgtagcgcaataaggggaagatagattggggggttggggggcactgttgtaggggatatagttgcacttttggatggtacaatgatttacagggggtgctgataaaccaaaatgacttggggttaagtcacaatgacctttaaataaacaactcaagtactgatatttttactaaccatcaggccttatatcagcatgtcatgtttgtacccatatccttatccaccacttggcagcttagtccatagggagcattttatatatgttttacataaaaatgcataaatgctgtttttgcagtcttatttgccacttattattttgagtttcttctgttctatttcaggttagataccatccattacttcctgatatccttgctagcggtagtttggatcaggaagtccgtctttgggacgctaaaacctcagactgtattggatctcaggacttccgtaatatatctaagcagatcctaatgagtatgtctccttccatgggtgaaatctgaatactaaccttttcagtgatgttctcttatttgatagatcggccaattgcatcaatagcatttcatgcaaggggggagattctggcagttgcatcaggtcacaaagtgagattatagtgttaaatttgaaaaaaaaaggaagtctttctgtgcttgttttatgaacaatgatcaaataacatatagtgctcaatgcaatgtattgtgccagctgtacatatggaactacaataaaagagatgaggctgctgctccaaccattatattaagaacccgccgctcactaagagctgtccattttcacccccatggtgctccatatcttcttactgcagaggtagaaataatatactccctcagtcccaaaatataacaacttctctacctacattctcttctcaaccaatcacaaccttcccacatttaattccacctgctttcttaatacccatgtccaaccctaaaactcattctgggacggaggtagtactgttttctgcattttttgctttctttgcataatttcatgtaccgattgatcttatgcagatattcaatttcaggttaataatcttgattctgcggactcaccattgacccttgcaacctcttcgggctattcaaactatccctcggctgtgttttttgcaaatattaattccagaaactgtccacatcatgaggctaattcatcatcaccttgcttgctttggcctgcatacctcagggatgatggaagtttatgtctgattcgcaatgacttggttagtagttcaaccaatgtgcatcagagaccatcatctttagctcaaaatccattggcatcagatgttgaaaatcaacagcctgaccaacttgtcacgcctatggatgtgtgccctggagaaccatctacttctcatgcttctgcatctggtttaagtggagttgaaatgcagattgacagggggcaacctagctccagattactgggcagtagctccactagtaatcatgagagttctactgctagagatgatgtgcaaatgccctccctgagcaacagcgtgccgattccagcaacatctcagccttcagaacatgatggccgtcatggtatgccaatgaattcgtttaccacttctagtggattagatgttcacatgatcctaagaaattcagagggtggaaatcatcatcatgatctcttcagtgactcgcgtagctgggagcttccctttttgcagggctggttcatggcccaaaatcatacaggtttgcaccctgcaccttccaaatgatgatgcctttgtactggaggcctaccttcttgtggtactggcactgctgagactgattaaactgtgtaattgaacttgcaggtgcttctccatctattccgattgatgtcggcagttctagaggatcaaatcgacatcatgcttctcgtcgtcatgttgtgggctcattacgtggggttgggagttcacttctaggcccccaaattgatgaagctgaggttcatgctgcatcattaggtgttggatctgaacttactacctcactgcttgctgctggagctgctgaattaccttgcacagtgaagcttagaatatggcggcatgatatcaaggatccatgtgttacattggaacccgaggcatgccggttgacaatttctcatgccgttctctgcaggtgcttcattgtacttttggttttcttgtattcacatttttcctgcacaacacaaacttttatttcctttctgttgtttcctgtattgctttgcctgaatatgtacataagtggataagttatggtgtgcagcaacaacaaaaacttactgttctgtttcacaatgtttgtccattaagaaaaccaagaatgtggttattacaatgttttcactcattaaatgctttgaaatgggtaaaatggttgcattttgctatgcatgtttttttctcgttaaatttttcttagattttgtacttccttggtttgagcgcatggggtgctgtggaaaaacattgttagacggagggagtatcttttagatgtttgacatgaagtgcgtattttatttttgacaaactgtgcagtggattgttgacccttctttgcttactctaaagttaataattattgcagtgaaatgggtgcccatttttccccttgtggacgatttctggtagcatgtgttgcctgtttgctgcctcaaactgaaggcgaccgtggtagccaattgcctgtgcagtatgattctgcaggggccggaacatcaccaactcgtcaccctctcccttctcaccgagttatttatgagctccgagtttactctcttgaggaggcaacgtaattttctcaacagtcttgttacatagtatgctcttttgctaggtttctcatttgtaaacgttctagttattttgaaattgtgaatgtattttccttacaggtttggcaaagttcttacatcaagagcgataagggcagctcattgcttaacttccatccaggttaacatctcatttgtttgtgtgtttgttggttttttagtgctgcaaaagataagcaggcatctctgctgccacccttctactgggagcagaaacatattatatacctcagataattgctgtcgaacttgtggcttgtgtctcaagcattgtccagtagcagcattataaagttgactggcttttgcatttttgacctaaacttgagaaatattgatatgaaattcaacaactttcttcatcagttaatttggtgagcacttgtttttctgcagttctcacccacttcagagcacatactattggcatatggtcgtcgtcataactctatgcttaggagcattgtgatggatggggaaactggaattcctgtatatactatcttggaggtacatatagttagattatgcataagcatatcagtgaaaatactggaaattctgtttttgctgcttattttaaatatttcagtctgaacaattttcttattatagtttgtaactcctagtgtccttttgtttctgtatgactaacaatatgatttaggccctgttctaaacttcaacttcctcattttccgttagcacgcttcccaaactgctatacggtgtattttttgcaaaatgtttttatataaaagtttctttaaaaattcaaatgaacccttttttcaaatttataatatttagttattaattaatcatgtgttaattgcttgctccggtttctgtgccacttacaagctcagttcttacttatgaatgaagccttaatctcattattcctattcatcacgttaggtctatagagtatcggacatggagctggtaagagttcttcctagtgctgaagatgaagtaaacgttgcatgctttcatccttcccctggaggtggtcttgtttatgggaccaaggtaaatagcaaattagatcaatcaacagtacacaacatatatttgctttgctaattcatgcactcacacatttgcatcaggaaggaaagctcaggatcttgcagcacaatggtgcagatatcacaagcacagggttgaattgctttatcgaggaaaatatgcttgaggtagtccttttttccccagttgtcatatccaaggttttgaatcctaaagactggcagtcgtattttgaattcaatttaattggcatgtgtaatgtgtaattttcatagatttgtcatataagatacgttaatacatcacaattagattgaaactgtcaaaattaaaactgtagtgacatgcatatttaatactacaatattccatattccttttgcacaatatatataaccaagatacctgtttcatctaacataacattttgaataccggtttcgaaaagaaaatactggtccctccagttatgggacatgtttgagtccaaatatttgaattccaaaaccggttggcacataaaatacatcaatgcatcacaatttgaccaaaatggtcaaaatgcaatcttttgtagtgaaatggtttgtatcaaatccaacagtctatattctttttgtgaaatatatgtataaccaagacatcggttgtatctaaccgtatgacggcaagaggcgttgattgaaaagggcttgagctgcagtgacgagtgatgggagtttcatattttatttcctattttcctcgttgaatgtgcctatttttttcctactctatcatataattcaaatgtacttacacatgtcactgcaagaaaatatacagtttgtattaaaattttgttttattctggctggtatgccagatacctgctagccagcagatcctgaacggttaccagctggttactgttgggattccgatctatgatggcaggtgacattgactagactgcctcgagctgcagaaacaagcaacaaggctctttttagatttcccctattgaatgcgtctctccttttcggttgttacacttctctgttacaaatgatgttgcaagaatatatacagttcgtatgatttataatttaaaattgaattattctggcctgtacgttggatactagctggtggctctggagcggtaactgtgctggttatcgccgggattccgatccctggtcataccttgttaattatctggtttacttagtcttatattgtaccaccacagccatattttatgcatttctcgtggcccatgtgtctggtggtggtttcattctctacactggaagtttagtggatgtttaaccagcatttacatttctaaatgtaggaattctggatttaactatcatgggttatgtctggatgaaagtatgaactagttgctattatgcatggactcgttcaatgctggctctgggctttaagaaatttacaaagcacgaatcatgttgtcttcacaaataaactagttgctttatcttggttgttgagcctaagataatcagcttgagtggcactttgccatatggatgcagatttttttaaactagttatgtggtttttgatttatcaaggtcaatcactttttttttataagtaactataggttcaaatatgcaaagctaagacaagatagtccatgttattatgggttgtttggtttgatcagaattcggtccatcgtaagatcgttcctcaaatttggttcaatgactagtattcctcatttttcccacttagtatatatgatgaccacatttcattccgcaaaccaaacttatttaggatcaagtggtcaattgacaatctcattcggccattcctcaaaccaaacagccctttagagttttactgggtctgtgtccgagctccaacccactaaggggcatgtgttaccaagtccatgctatcagcgagtttccactttacagtaatctggtacgaaataaagttggaactaaacagcatgacaattggccgaaatttaacaatgggccgaaatttaacaacggggatgttttctgaacaagtcataaatgatgcaacagttcactccgattttcatgataactctaatatatctttaagcacacgataatggagtacagaaattggcattatccatcacaaataggtcaaaattgtcttacctcattatttccagggaactgtaaataaattattgaccatggattttcagttgggcaatcatcactttttggagtcttctattcatgttaatagttaagacttttgtcgtggacatttagccaccacaaacttagttttacttgataacctgtatgatttgctacttaatacatttgaagccaatggtggcccagttatggttgctagatcttttgcaattttaatcagattgtatgcatttggctcacttctgctgaaactagcaagattctcataaattagtgtcctatctcatattttattaatatggtatctattaatagggcaaacttaggggcagcaaccagacacctgtgacctgtccagatacaagccttgttaggagtttatttatttccgtgaaaatctttccttttgcttgtacctcatttaatttaatgctattgtgtcaacaggtttgataatgatagtgctgctattatgtgctcatattcggtctaataaaatcgatataacggtatgttcctttctttgttgtagattcagagatatgcgctggaaggctgaacgattggttgccatgtgttatgtgtacttctccaggtaattaccatttatcaacatctcaattttttttctgtgtctgttgcattcctggcctcaaacgttatccagttcactggttggagggacactttgctgtttctgttccttttggtcatgaagtataatcaaactttctgtctataggtgatactatgaccaaatatgccttttctggttggcttgctggtgactgaaatcatgattggttgtcactacaggaattttcctctgcaaagtttatcattgtacaagtgagcctcaaggaaatcatcagatttcagcaaagtcatggcagattctcaaatgagtttgctagagtgccttggggataggtatggaactgttgcgtaatttggtttggtgacagtctaagattacccatcttgttttgttccactaaacccaccgacattgatatcatcaaaagatccctattgctccttaataccattccatccaagccttctttttaccaaaagcaattatgttagatgaaataacattcattggcatcttggctttccctcctatcttcagtgcagatggacattgaaacacaaacataccacacattactcattgttagcaatgtgcagtgccactgtgtgctagaaagcttgagtttctggagctgctcgatctctatgcacagtgaggcgatgaacataccacacattactcattagtcggagtaatggcgatggtgtgcttggtggtgggtcttcatgcgggatgcctacttttcatggctgcagcgaggtgaaaagcttgtcaaagcttgtcagtgcagaggtccttgatcttggtgttgccagtgaagactgtgttggatacgtgtcctcatctcttccctcttaattgccagcaccacccattcacctttgccatcatgttaagcatcctgccatgtctctgcaccacctcatcctctccctagggttggctgcaacaatgtagagtggagacagacaaaacatgagggtggtcagagttgggcacacactttagaccccccaagctgatatctttctcttcaaactctgtcttcgttacaaagttctccgattaccatagaccccccaatctaatatctttctcttcaaacttagtcttcattacaaagttctccggttaccagatctttttttggtaaaggtttgtcttgagaggtccgataccagctttcacacttaaattgatctgtctggattagccaggccaaattgtagtgccgaaatcgttttatggctgttgcgagcttagccttggatggaatggtatttggatggaatgatgttaagaggaacatgagtgatctttggatggtattaaagtgctcatgtgaatcagtggtataaaacaaagacggtaatcttttggtgtcaccaaaccaaaatttccttataatataccataatactcatgctatataggtgtatgtatttgcttctctgctgctgggtatgattaatatgaattcattatctttgtatgtgcatgagatttatcaataaaatttctgccacgctaaaagtagaaattaccctgcacagaataatagatggcccagaaatataaaacctgcttcaaatcaatatttttaatttttgctcgagggagtaaaggagtcagtgaaacaggctagctgttttgttctgggaattttgtcgcgaccagtttgccagcacggcttggtatgttcaggaacaaattgccctttattccttgtatatagtaattatataaggaataataattatgagcttatatatagtaattatatacccaaggacacaaacttatatacgttgttgctaacgtttctgcattgggtacttttttttttgttgcaaactgaccatatagctgacctgtgttacacctgtgctattatattctttcccgccaaagtgactagttttaatggattgccatttgcaacttaattcaggtctgtgcagagggagttggaagatgtaaatcaacacaaccatgttgctgctgtcaagtcatcacgatgctgtaattacagaattgtacatgtaatctttaatcaacttaacttgtattttagaaagcacacaatgctaacccttttcttttcaatggcagaggtatttattgttccccttgtatttttcgttgtgtagtcttttattccttgacggggtaccaaatgccaatgattaaagtaactaatcatcaattcatctttggttcaaagatgtactctgaacttggcgaagcatcctgatatcattttggtttgtccctacaattccagaaaccgatagacctgacaaatcgttgtatagtctcgagcaaaagaattttatttgttgggcaaattttgctaccagacatttgcgactttgtggttttagctgtagggcaccacgcgaagtcacttttggaggaacacgctttgtaaatgtggttatttctcaggagacactcacactccatccattaaattaatgttttcatgttgactaaattaccccttatctcttcctctctcttcctcttttctcgcttctcccttgggcgacatcagcctgctcgatggcggcgcctggagcacgagcgacccgctcagcggcggcgccccgccgctgagcgcgcgcggcctaccttggccacatccacagcggcgctcctccgctggtggcgtgcccaacaccacaccaccagaccgcgcccctccgcctccgagcgcaggggagcacgatggagctcgacgccggctgggaagctgtactccgtgggtggaacgggagcgcgtggacgccggctagccccatcgccgatgccattgatgacgggaaagaaaataaacgccattttattttaattcttgttagagaaatatggctgaacatatgttcaaaactagcaaatatgtgtgctaattaatatgctcaattaattttgtttatcactatgcctgtatcactactagcacggcttgaagctatgaagcgtgaccgaagcaagtgcttatttaacttatggtgaattatgcaaaatttatgtttgtatctgtgatttgtatcggctcgtagaggaccgaacctgagagcgagaatctcgcctaggcttgtatctgctaacgggaccaaatcagagggtatggtaggatgacatgaaaagaatatgcatggaaaccactcctaggtccgtattcatctggccggaccataggagaaagtgtgaaatcatgttaaaagccatcaaatgaaacgaacttccttgtctcatacgcgttggctgagacgaaggacacaacaaagaggaaaaattcctttggcttgtactcatgatggccaagcctaggaacatgtcaagaacataattccctagttcgtactcattggccgaaccgaaagacagcaaaaaaatacattaacacgagcagaggaaggagaattgagagattcctcgactcgtacacaatggccgagcctaagaacgaaggaggatcatgattcccaccttggaacacctcttattcttccggcacagcagagcgagaaactagcacggcggcaattgctttgcagtagcgaactactccctctgtcccataataggtgacgtttttgactttttatttgcaacgtttgaccattcgttttatttgaaaaattagtgcaaatataaaaaaagataagtcatatgtaaagtatttttgataataaagccattgacaaacaaaataaataataattccaaaattttttgaataagacgaatgatcaaacattgacaaacaaaaactcaaaaagataagtaatatgggacggaggtaatagcagcgattcagcacagcagcctttcgccttagccagccctcacaccaaccttcttggaacctctccccagcgaactcccctttgcctctagccctgatcctctatttatcgaggaggattaaagggggttaatttgctttatgtgattttgaacaggatcccgcgcgcgcgcagagatcgtggggtggttgtgggcaatggcttgactgcatgcacatccctttggctgatatgtgggcccgttcagtttgacgggacgaatgtgctggtatttgctgcatgcatgcatgattagtggtgatcgtgggtaggttatgggcttgaccacttgtctctttgctttcactgacgtgtgggccctttggacttgactgattttttttctttaaatttcagttgtttgtaaatacatgcgtgtctctttcttgatttcaaattttattttttttgcatgcatgactattctgtatgtcctatattttgactgcatatactcccatttaattgggcgcctcaatttatttatttatttacttttataaacactttggatatgagtcttttctcttttttttaaagaggcacacgtatatattctagtgcatcattttctatcgagcggactgtcactgccgtaaatttattttatacgacacgcatcgcgtcttgacatgcatattatcacggtggctttctcaagccaacatctagacatcgagataaaaatattggataatgtcaaacgcgaccccctttaatttggcgcgcatgtaacatgcatttttattttaagtcacgactatttagagtataattttttcactagccagctaaacatctattttggcttacattttaatttttgtatgctattttatatggtgagtacgccttttctgaaaatattcggggtgtgactatttcgaggtagtgagaaaatcccacttcatggccatatgttttaggccaaatttcgtatgcggatacgacgagaaagctaagtattagcgttcgccggtccgacgaaaagcgcatgaaaaatatttgttcacgctatatttatgtggaacgcgtatatgcattcctattttaagccaaaaattatttttgtccaatataagtgaattatattttatttcatggccatttatttcgtggccgctatttatttaaattacttcaccatctgtctcccaataaaattcttatttattattatatatattttgtacgcactatatttaagataatatattagtttataatttaacaaattatatttatatttaggacacgagccaaaacccgtgtcaacagccatccgcaatgaggtgggctcggaaggcctctgccatactgggggtagcgacgagggtggggcacgcgtccgggtggcaccggcagaccagcagcagcagcagccacgcgttctggtacatctccagcaacgtcgcgccggcgccgccggagaaatccatcgccacggtggttggacttgtcgcgtgagctcagaatcgaggaggagggatccgacatgtggcccaagggcattcattactttcacgtgatttctgtctcctcaaccaaaaaatattattttaatgggtgcgatgtccaccagcaaatattcaacttttgagagtattctttcccaaaagtgacttcgtgcggtgtcctacagtcaaaaccacaaagttgcgatgtcctgtagcaaaatttgcctatttgttatgcttatttcaagcatttgtaaatttttgctaagcttccgccgtctgatccaagtttgtcaattccattcgggaggccatcccggtttggctcttggaattaggggtgagaaaaaaaaaacaaaccaaaaagactgaggtttggctcttggaattaggggttagtagaaaaagactgaactgaaagaccgagaccaatttagtcctaagtaataaaagactgaattttgtatggtaaatccggttagtctcattggttaactgaaaaggccaaatttaaaaaaattgtcaaaatacaacctataatccactaagttcaataggattaaactctaattttcacatctctacttattcaggcatgtaacctaataagagtcttctcatacgtgtttgcgattttttttgtgatttttgtgttgaaaatttcaattatttctttgcatatatgaaaatgttactgaatttcggtcaggactgatatttttgtgttgaaattcggtcttcactttttaaagacgaactaacataaagaccaaataccgagactgaaattttcggtcagaccgaatacccacacctacttggaatatagtgttctagtacagtcgatactggtgtactattatacagttcaataaaacaatataaatatattaatatacgatatattatcaaagtttcacatgtaatcatgaattaataaaccactaaagctaccatttttctctttattttatttttttgggcgcctcgggatgctgccacgttttttttttctcctttctttttttttaaaattttttggcgtcttgagatgctgccacgtttgtattgctctggagcatgactcgatcgggtgagaggaatcggcaacacgccattcaactggtcattgcgctgttttagcacgcaaggggtgtaagtgggtcagccgcgaacccacttatagatcaaaataaacggacttgcggcttattttagcttataagtgggtttcgtgggttagcctaagcacggccgtgtacatccgcgaaggaaaagacgcgtggtagtatttttgcaaaaaaaaaactcctcacatttacactgaatatgcatataccctcgaaccgactaaggcaccggtgtgttttatccggaaaactactcgtctttgacagaaatacaatcccaagaagcgaaaattccgcttataaggatagcgctctaaaacagggaaacgtagggtctttcttaaaaaacaaccacatatatactactagcaatattttgggtcggaagaagtagaaaacttgccgcggctttgccgccttacggtgatgatcagttatttgaacattctctcacgtctagagatatgtaaagtttaggaaagttagcacgaaacatggcacttgacaaaaatataaaacattagtcactaaagaaaaaagttcatcactctccaaatttgtttggtactatttcatttcaaattccaaaaatacgtgattcttgggggcacaccctggcatatattcagtaacgaaagtttcataaactaactattcaataaaattcaagggtctatgctatgagcaagggagcttctggatctactgaatgtttagattccttcatcaagttcatcttcgcctataaaaatgaaatggaatgaaatcagtactgttaaacacatgcccaaaagcatcccttaacactgaagtaactgttcagattatgctcatatgttctgttcactgctttaacgaaaacatagataaggcatgattagctgctaagtagttggagaaaattgcacaaagaaaaagaaacaatataaatttagaaattttaatatctgcaggaatgttggagatcatcataacacttccctactcaaatccatatgaatattttcaagttctttgatgaataaagcattttatttacttttaatacttttattttgctatatcataaaagaagttgccaggaaaaaaattctaatgtggtgcatcgaacaattatcttatctggaacattgtataagggtgatatcaacctaacagcaagcatacatgtcaagcacatgtatttcgcaacaaaatcaaattatttactactctcatatgcaagcaataggacactgttatctgcagatgccacacagttctatttagcttccatagtatgaatgaaaactaccatgccagtacatatagaaatatgtagagactttgaatgttgaggtgttgaacatttcagaacacttcacagagcaatagcacttggcaaattggcaattacatactccctccgtactcataaaggaagtcgtttaggacaatatttaagtcaaaccttgggaatataaatcataaataactctcaagttgttgagtttgaaaatgtaaaaattatatgaatatatttgtcttgaaaaatactttcataaaagtatacatatatcactttttaataaatatttttatagaaacaagaagtcaaagttgtgttttggagaccgtgtcgcgtcctaaacgacttcctttatgggtatggagggagtatctcggaacctcttaactagttaaactgtagcagttgatgatcgtggcagtccttaatcattggtcaaacccaacaatgttttcaagtttttttttctcgaacacacaggagagctgcacatcattatattaataagaaggaaaagagtccaaaaggactcacacaagcacattagggcaggttttagtacaaaacggcttgccaaagaaatacaaaaggattatgaccatctgaaatagttagatggaatgttttcatgttttcaaaggaatattatctgaggaataagcatcagctaattttgtgccaaaagctacgctaagacaggatgaaatagttagttggaatgattgggcataaagtattctatcccagatttcctggaaaggtgggggaaactaccaagctgaagtgaagtaggggcacacagaatttccagtggagtgctgaattggatataggaaagacgaacgtgaaagtactccacttggccaatactattttatatttcacttattagctttctcataagggattttagtcaagcaacaccttttgtgacgttttttttgggggtattgaggggtccttttggatccctcgtttgtacatatttcttcttcttaataaaatgaagcgtagtcctgtgttttcaagaaacaaaagggattttatttttgggtatattattctagaatttcccacagttctctttaccctggtgtctccaaaaattatatctcatctggaacatttgttttatttaaaaaaagtaaggatggctaccaacagcaacctcctgtcaggcacatgtaaattaaccaccaactataaagctaataagtagttcagactgagcagcagccgtacccagaagaaatacaacatttctgccttagatctatgttcacatgaatgtcaaaacaaatgataatatatacttcctctgagactctgattccaaatacaaatggttttttatacttgtgcacaaggattaagaaagtgatgaaatcagctcgttgcccttcatttatacacagtggggacatgttcacgagtggtaacatgtattcataaaggacaaagaaggaaaaaaaatgagagtaaaaggtgcctcaagttatgacttatatttggaaatgagttaggaattcaaagatgacttatgcatggaatcagaggaagtataatcttacctttttcacatctgaatatagatcttcaacccttttctctgtctgctttgcaaatgaccacattttgtatatactagactccatctttcttgattcatcaattagaatcaagaagtaccaccttctcgattaagaaagtggtgtttgcagacaggctatcttagaggaggtgtttgcaaatgacccaagaagcaccaccaaccacacagaacacagcgccacagcgtccaatctcctctctcgatttgacataccttaggcgacggctgcaactatttgtcggcgttgacccacagctcccggaaccacggcgtggaagggggcagatcggacgtacgtgaggacgaggatgccttgctagcttcggacgtctgtgctgcgtcagctgttcccctgaaatccatcaaccgctcatgggtcacagcggattccggggagcgaaaaatactttcttcgcacggtttgtgggtggaggggattttgcttcgcctccaaatgacacgcttagcattgcttacctcaggaagaacaatgcatcgccaggaaccaatctttttttgagctgacaaagacactccaaccggttcacggttgtaagcagatgtctccatttgttgtcctgaaaaaaattggaaagatatgagattgcaatccctgcaagtgatatgtagtgtaagtattccaagaaaaacatcagtagctgttacttattactctgcacaatggcaagcataagtgagaaaaagtgttacaccaaaacatcaagaacaacagtgacaagaaggttaaaacagaatcaaaccaaataatgagattccaagctcaccacggaagatgtgatggaaaggtcactcagttccatggagatctttggcaacccaaaacaatgacggggccagaacaccaagtaatttactgagtgttttatgtcacagctcataagtcacaactaaatgttctgtccctccctgtgtacctctgatttgctgatacaaacttcccaacacatcgtagatagaaaacctatcttggtgctgaacatcactggctacaaacaaatgccgtgtcttctcaacctcaatccagctgcatcctgcaggttttttcatatccttggatttcatcagtttcctgacatgctcaacactttcccatttatcatcagccgcaaagatgtttgacatgatcacatagttcccgatgtcctcagcctccatggagaacaagcgatcagctgcaagctgaccaattttgacctctccatggaccttgcatgcccctagcaaggagccccatgcattggcattgaccacatgaggaggcatatccaacgcaaaactgtatgcatcttggagacgcccagaacgggcaagaaggtcaaccatgcatgcacagtgctcttctgttggttcaactccatagatctctctgatggacttgaaaatcttaattccagcatcgacaagccctgcatgactgcaggctgacagaagagcagtcagaactacatggtctggcttaatgtcaagtgtaagcattttggagaatagttctaccgccttttctgccattccatgcattgcataagctcctatcatggctgtgaatatgacaaggtccttatgcaggctaacttgaaagaggttgtatgcattggctatgttcccacacttagagtatgcatcaagaagtgctccttctagatgaatatcttctagggatgctctaagcatgtaaccatggcattgtttcacaagttgcactgagctcagatggatgcaagccgaaagaatatttgtaatgcttatagtatcagggtttagtccttcagattgcaactgatggaacaagcaaaaagcttgatcacacaaatcgttctgtgcatacaaccggctcatcagattccatgtagttaaatctttctcagccatatggttgaaggtcatctcagcatcctccacacaattattttttaggtagcaagaaatcattgtattgccagtaacaatgttccgtcctgcaaggcttctgaagagtgtttctgcatcatgcaggtagccacactttgcatatgcgtctagaatagcattcgcaactgaagaatcaccagtataaccgactcgcaaggaatatccatgagattcttgaaccatcttaatcccacagaacgtactcatgcggataatattcaagatcgtgacagagtcccactgagttacgtcatgccacatttcaccaaggagtctaaagaactgttcaatatggtgttcactgtttgcacaagcagagagaattgcgttccaggatactgagtctttgttctgaatagtgataaaagatcgaaaagcagcatcaaacctgtcacactggctgtaaaagctgacaagagcattcattaatgatgtttcttgaagaagttcaggatgtcgaaaaatataaccatgaaccctgatgcccactctgagattgcctacttgggcacaagcagtaagtaggctgataagagaaacagaatcaggagccattccggcaaacaaaagcccctgaaacagtttcaatgcccttgagggataccgattcatcacatatcccgcaatgacagtgttccatgtaacgatatctcccatttttgaacttctaaatattgattaaacagccctcatttcacaaaccttggaataatgnnnnnnnnnnnnnnnnnnnnnnnnnnnnnnnnnnnnnnnnnnnnnnnnnnnnnnnnaanggagatcaatcatcgcgcg

SEQ ID NO: 14173 - DNA, 5777 bp, Oryza sativa
  unsure (1)..(5777): unsure at all n locations
ctgcgnnaaaatagcgccngctnnnnnnnnnnnnnnnnnnnnnnnnnnnnnnnnnnnnnnnnnnnnnnnnnnnnnnnnnnnnnnnnnnnnnnnnnnnnnncaagtgaacagaagggaagaacattagccaatgttgaatagtttggaaggcattcctctgagatcatctgaccaaacagtgcaagtgcttcttcaaacaacccattctcagaatatcccgcaatgattgagttccatgaaaccacatccttgcaacaaattgtagaaaatgctagatgcgcatcatccatagctatgctcccaccacattttgcgtacattgataccaaagcatttccagacagagtgtcaaactccaaaccagtcttgatgacatagccgtggatactccttccagccctcagcaccctcaactttgcgcacaccggaaggacgacagcgaccgtgactgcagttggcatgctctcatctacaccactagcaagcattgcacggaacaaatggaacacatcgttgtaaagtccagcacgggaggaggcagtgatcaggatgttcctacataccgcgtcggagcagctcatctcatcaaacaccgtgtgggcgtccgcgagagacccgatcctcccgtacatgtccatgaccggctttgccaccaccgcgccatccgcgtacccgaccttgacagcgagcccgtggaggcaccttccgagcgccgcgccgccgcggcagtcggggagcgcggacgacgatttgaccgccgcagcgagcgccagcctgttggggcgaagtccccgggccagcatccaccggaggagggaggtgcacccgtagtggtcccctcccactgcgcgctccctgagcagcgcgctgcaccgcatgcggtcgtccagggcaggcactgcatcgaacacgtcgggcgcaccaccaccgcttgtggctgcggctgcggcgcggaggtggtgggagagccgccactgccccctgcggagcgtggcgtcggcataatggcgacccggcggccttgcgagagggaacataagcatagccccttatatcaccagtattaatttccatgactgcaacacataaacaaatcattgatgcaatgaaaatgtgaccatctcgttaaataatctcatggtacgtgatgcaaactttatttttcagcttctcgaacaggaggccacaagatcaccataaacttcaatgtagtactacctccgtttcaggttataagactttttagcattgcccacattcatatagatgtcaatgaatctaggcacacatatatgtctagattcattaatatatgtctagattcattaacatatatatgaatgtgggcaatgctagaaagtcttataatatgaaacggaggaagtaccaaattgtcaatcatctcaacaacacaactcacacaagaacaccagaaatgccacaaactatcattatagaggaaaaaatcaacttgacctatgcactaatttgcttgaatattaatgctaaaaccgatcatacacacatcaagtcaggtacagccatgactcatgtacgattttttttaaaaaaaaatagcacttcttccctcagcataagcatctcaatatgttattccctcatacatgtacactgaaaaaactatgagtggacatattttgtaaatatatccttatgaccaattaagaaggactcagcagattcatttacatatggagcattcatattgtggcagctttaattataaacatgtagagaaaagtgataaaaagttaagtcatttcccccttgcagattaattgttcagaacttgagagatcaaatatctaagtgcacgttggaaacgtacgagatcaagtatataagaaggataagcaaaaactgtattttggttgattctaaaatatactatttaagaaccgaatcttagttgatcatgatggcagaaaaaccatggtcggagctactctgcctagactcaactgaacaacaaacttaagatcccctgcaggtaaatatttgagaactttcatctatactgaagaaagccacaaactcatatcagcggcggatccaacttgggacatgggggtttgggtgaagaaacaaactgttattacttgaattaagagaggtttaaggctatcaaattaaggaggaggaaaagagcttcttccagatctagaagagaagctagtagggttcacgaacgcaagcaaattccagtcccggtggggtgggagagagagagagatgaatcagaaagggcacgcggatgctcaccaggatcccctcccctccgctgctctgctcgtctcgccgcccggccctcccctgttcgtcttggcggcggcacaaggagcggaggagacttagatttttctttttcttttacgcgatacccgcccttttctcaatatttttagagtaaattgcactatggtatagtaagttacattatgaaaaagaaggaactattacccaagttgcataatgaaccatgtctataccaaacttttcacttaacattgcttggaccaggtatagcaatctaggtttttcactgccagcgcggctccaacatcgcgtttacttagtagagagatgaagtggctctcgtagggcgggctcaaggccgacgtcgacaacgccggaggagattgtgccaacagcgtgagtggtggacggcaagtaccaatccctattagccaatccattatccagcctcacaccctcgccgacgcgctgtcgggcgcggtgaaccatccactccgaagcatggcggcagccggcaggtaatgccaggcatactggcaatggcgttgatcttcttgtaatgctagtgtgagctgcatcatgaactgaataaggccacgctgcgaattaagtggcaatgtcttctacttcgtgcgcttccaccatcgatctacagcctgcataacatcctgttaatcatatcatccgttgcttctgcccaaatgaaaatcgtaatcccgttacctgtcccggtccggcagcggcgccaacagccactggaggtggaggctgggaaaataaccgagaaagcaagcatgaatcaatccattaactcctcccaaatgtatgtggctctaatctttctctaagctgtactgtcctgtgctcctggccaccgcctcctctcctaacttcaccagcgccgccgatcccctttctggtttgcgtgatgatcgaggctcgctcgagcttatcgtgatgttaattacatggctggagtagaaaagtcatcttagcagccagcccaactctctcagcctggtccatgttgcaaataattgcaaagatatatggcctaaattgaaaagactaaccatgacctggtccattgtgaaacaatggtcaattcagtcaatatttttattattttaaaactagctaggactatttctttatataactggtgacccatgtatcatcaatacttaagaaaaaattaagtgattgtgtcgacaacaaattcttcataccaccagcaaccactaactgcaccgccatcaccgctctttctccatgagccaccatcgttcctcctctttgcctttacatgcgcagccttaccctttagtaaccgacaaatctttttctcctctcctatcgtgatgcacactattgttatggttgctgttgaggtcggggatgtcgggcttacatggactttgggaggtaggagctgacctaacaaagagcgaaggaactatatctaggctccttgctagatctatcggttatccaactatcggagggaaaaagaaaatggagagagagagagatagttaatgtgcggagtaattgctgagtcaccggacttggagatggatagaataaggtggtccaaattgaaatgtaaagttagctattgtgtaaatataaagaatggttaaagaataacattatatgaagcttttaagaatttttaagaatacgtagtatggactgtaatttactccctttgtcccacaaaaaatgaatctagaactggtgtggcatattctagtacaataaatctgaacatatgcatgtctagatttattttactaggatgtgtcacatccagttctaggttggttttttatgggatggaaggagtacttttttctctagcacaattaaagataattgtccattacccgatagtcttgtgatatgctaagtatggttgggtcggtgtacttagctataactaataatctcatgatatattgatgcatgacgatacagacttctactcacacgggctaattaattatggttagatagattcctctaaaagatgataaaaataataccatcatttttgctcaataataaagcattcgactatggtcttcttttctcattgcatgatatatgatgactacattagtaggtatttccataattctttcatattgttttttattttctacatatatgttaatttgaactaatatttttctcataattaaatagataataaatcattttccatatttctcctataaaatgagaatagggtattttatattttgaaaattatattataagtgtatgtaatttaatgtgtaagatatggacttatagtataagatttaacttttttctaaaattgccgcatcatagtagataggtagttaaccgaacaactataaaaaacagagacaattcattgtgtgtcactgattttgtccttgctctacaatatgtcgttgggtttctcaagttctaatatggcatcacattttacttaacttctataatataccattgtcatctagttggcctcagttagcattatacaattttatcatacagatagtaaaacttacaaagtttgagatgggcaacttctctgtctcgtttataatatgatatttcggaattttcggccaaattttggaaatttttttcctagggatatttcgatcattaggacaaaattaagtactaatggaatttaaatggacggtgatggtatattatagaatttaagcaaaatacaatgacatactgtagaacttaacaaactcagtggtatattatagaacagggacaaagtcagcggcacacgatggattctctctaaaaaataatctagttgaattgtttcttttttattcaaaacaaaacattattacctaaatatgttcaaagaacttcgaaagaagtaagaaaaagaggaggttagtcactagcgcaaacacatgagggtggttgctcacattcatggtatggtatatactcacattaatcgataatatactaatattattaaaattgttctttgtagtaaatggtgtgaaactaaaaactttaaccttatattctattcttctgttgtttcatcttcttcttgttttctcattcttttttatttttgataataatattactacaaccagcactattacttgcacatgaatactactccctccgtctctaaatataagagattttggttagatgtgacacattctagtacaatgaatctagacataaagcctgtccagatttgctgtactaggatacgttacatccaactaaaatcccttatatttaggaacggagggagtagcaactagctcatgtgtgtgtgctccataatatatattatctatgtttttacatgaggaaacaataactattatctttgttaatgatattatatttatnnnnnnnnnnnnnnnnnnnnnnnnnnnnnnnnnnnnnnnnnnnnnnnnnnnnnnnnnnnnnnnnnnnnnacaagcatntcaaggggcagg

SEQ ID NO: 14174 - DNA, 14634 bp, Oryza sativa
  unsure (1)..(14634): unsure at all n locations
cttgccaactgagacctgcttttgannnnnnnnnnnnnnnnnnnnnnnnnnnnnnnnnnnnnnnnnnnnnnnnnnnnnnnnaaataatgggatggtacatgcatcgagtttgttatccgagtaaatgcgagaagactaattagcgcgtacgcgcgagatgagttactggcgcgcacggacatgtgtcgttagtgtaacgcacgagcggtgctatggaaaaaaccgatacaaaaaaaagcgattagcatttggactagcttggttagttctggatttgttttcttttcccggataattaggcataatcaatgttgttttttttgtaacttttcaaatataatttaagtctttcgattacccaaagttagaaacttcatattccaaattgaaaactttcaacactaatttgaaactttcaactcatatttgcaaactttcaagttaagatttgaaaacttttaactaaaatttaaaaactttcaacttaaatttcaattatttaaaaaaaatcaacttaaaatttaaaactttcaactcggatttttaaactttcaagtcaaaattttaaaactttcaactcaaatttgaaaattttcaacttaaatttaaaaactttcaacttaaaccatgaattctttattcatatttgaaattttggtgtatccatataatatgatgatcaattaggaacggagggagtacatgcctatacatcatataaaccttatagtttttgcctacaagttttgcccatggtactgttttactatactactgttcagccaacagaaagtcagcgtgtctacttcgtatgatctgccacgcgtcaacgatccgtcccctcttgtgtgatctgccacgcgtcaactatccgtcccctcttgtctgatctgccacgcgttaacgatccgtctcctcttctgcttctaccctcccatgaaggcgcgattagtttctcctttggtttccctgtcgatcccctaccgcgctacctattcttgttcgccgccgcctgctagggttcctgcttcgacgcggccaacgccactgacgtgcaccgccattcttgaccgccgcggctggccgggtgagcttcttctacgcccccggtgaccatctagcgtcgttcctccggcatctgttcagcacctccactaccctcgaccttgcggggctggatccggagtcgcctgccttctttctaggctttcatggccagccgtcgctgtctccgtgcagggccagtgatcaccatcgttgcttcccatcgtgctaggtgcggatgccggtgtcttcttgcgggtcacagtgttaactgtagccgttgttttatctcctccctgcattcctcgcaggcttggttttgcaagatttatggtgcatcgaccgcccataagcacgtggtaaccaaaacgtgaaaattcacgtgggtgttcctgctgattggattcctcaaattaattgttcagttctccttgcaatcctttttctcacttctctttttcatatcaactttgcatgactagcggcagcctgtactttatttttctatttttctatggtgttggtaaatcaagtctaaagatatgaggtaaatcaagtctaaagatatgaggttacatatgttttacctacaatatgcttatgaactttcaatgttagaatgacatattttgttgatacctgcagttatttttttaagcacaaacactaagatcacatatgtatgttctgtttgttgattaccttttcctcagatacacatgctccagttggaatgtgcatagccattatgtcttgctttacatgttaattaattaactgatttagtgaatgtttactacagtgattggtccgtatcacaaagtacaatggacaagtgtgactgaaggtaattcactagccttttatgtatatttatagttataaaaatgtctgcagtgtgcatcagacaagcaaagagtatatatgggcggcgatggcacattcctatggaagggatttatgagtccaatgtcaaaatcctctctatcagtccatataatagcaattgcctaccatttatatgtatgtcaccccatcagagttatattcacgtgttcttatattctaaatccatatgttgttgagatgtgttcttcaatcgatatctatgcagagtgtcctatcataacattaacaatgttagaccatattttggcccttttcatagaaacctaccaaaatagcacttagactgacttggcaacaaagaagttacttggtcagatatatttttatgtttgagcttacttccatagtttccatctatgcagcgctcaaatttattcacccgtgttgccattcgcttaataaaccctattgttttgtcctataaactttccccacgttagatgtctacctcggctgccacgccgttgcctgatttcgcaccgtcgtagttgctcctagggttcaggttgagtttgtgccatcctttatgcctttatttttcacagtgatttaatttgtgtttattttctatcacttaatctctgctaaatgtgatctgcaagtattgattggctggtgagtttgcagtgcaagactcgtggctttgttttggttgacgaaggtagtttgatctaactataacttttagttttactttattttacttctatccatacagtctcgtagcctcatgctttcaactttctgatgctatagtacaggtgctacattcagctgtgctcttatgaattgataaataggtttattccactgaagaaacacttctggtagatatgttgtgccaaaacagcacttagattggattgacaggaaaaaatgcttgctcagatgtccttctattttgtgcttacttttatggttcacatatatgcggtcttaaaatttattcagctatgttgccagtgctttctacctatagaattgaacttctttggtttacctccaaggtaagtactatctacatataaaagtaaaaataatagttatagattcagtatgcagacatttttgttctccacaacattcttatgcatagaaagcaagtccatctgtttgcatgggtctagcaaatggtgtgggattgctatttcagtttctttttgattaatcggggcaacaacatcaaattaaaaaaacatgtgcatcttcctcctttcagtagcggagccaggatttcaaagttgggtattcccgtctaagcgctgaggcgctggccctgcccctcgtggccaccggccacccaaccggcctgaccgcccgagattggcggagtggcgggcgtcggccaccgctcgccacggcaatggcctccccctccgcgatagcacggtccagctcccgctgccggttgccgcctcgccgcgccgccgcctagggtttggaaatggggagcggcgcgaggggagccgagccagggagggatgggtcacggagagagagcaagagggggccgtctagaagggtggtggataagtgggtcaactgatgtctgatgggtcatgacggaatgggtcgggttggtggaggcgtcgcaagaggccggttgggctgtgtttggattgaagaattgaggatttaggtgcactaatatgtgtacatgtgtatatactagaagtatacttgttttgtgataaaaaaagttgggtattcctgggaatacccaggaataatggtagctccgcccctgcctcctttatgcagctgaagtgatgcttcttatacccaggttatgttcagaacacagccatatgtgcagtttagtcgacttgctttccacctctctatatggaaacatgcatatctatgtgttaggattaattccactgcttgtgcaatccagttcaaacactgaaggtttattctacttatcttttgcaccttaatttcactcatgagcaaactgtcttggtctctgcagctgcatgggaggtgaaacgcaggaattcggcaagaatgacatgctgcaatttcgtggtctcttcaagcacgtgtactaattatccttacattctgttgctaaactactgatatcttcatactagaaatatgaaattattttgtttgtcacatcaaggcttcgtagcagccaactgcatgtactatttcttttgaactaaaatagagtgatagaagcccaatgaggtactactgaactgctagcagcatctatcttattctccttatagctcaaaatgtattgcatagttatcagtcaaatgaaacatgactccactatctaacttattgttctatttctaccagattatgtagttctgcaacattcagcgactgtaatggcatatattttttttatggcatctcaaatttatgtcccgggtttttctgcgcacaatatttttccctttttggtaatttacataactactccctccttccctaaatgtttgacaccgttgacttttttaaacatgtttgaccgttcgttttattcaaaaacttttgtaatatgtgtaaacctatatgtatacataaaagtatatttaacaataaatcaaatgatagaaaaagaattaacaattacttaaatttttttaataagacgaacggtcaaacatttttaaaaaagtcaacggcgtcaaacattttgggatggaggtagtataatctttaggtgtaaattagaacatatcatagatactaatataatttaggtgtgaattactgatattataacatatatactaatctataggtataaagagaaaaactaaaatagatactaatctttacatatgaattaacacttgaactgctttcagaggacccagcaaagtggcatgacatggcttgcatgtaacatagctgtaccttgcaatattcttaggtattttctttggctctgtgttgactggaagtgaaactgtaatgtttgacataatcaagcactgctttgaggaactacaggagagattaatactttctttgctccaatacccaccattatgagtttatttttgttcttttcttaaactgcagcggttcagaaaggaaattttaatggttagggcaccaacaattgaagctgtaattccctgttccaagttaattcatgattctggagaccttaagtatcatggaatgtaagagttttatctttgattcttttccatgttacctctgtgcttgatattaggcactttgatgcccattaaaaaaaatatatcctttcatatatatcttgcctttttgtcatgtaaaatgagttcccttcatatcatctctgggacttgtgaagtcagttatacatataaaataaattaatcaagtttagcatgtttgcccatctatgtgatgtttgcacatttgattggataagtggttgcaaataaaattgaatataacatctatgtccatatatggctatgttcgcacccgcggcaacgcgcggggtaccgtctagttacaatgaaatctacatataaaaaataagatttagtttatttctagtctagtttttttatgatgtattggattttttacatttctttagagataatattttataacacttagataatttattgttttataaatagattagtttatcgtgcccctatttataaaatcctacatccgccactgactcatatatgttaaacttgatttacactatataatatatcacaaatagatatttttgaagtgcaaaatcactttctaatatgcacttgtttgtactacctaccctactgtgatgaatataggagtatagggctacgttgtaagcactgcccatgcactggaccagcggtgtgtcggtgtggacagcgtggggtcagcgctttctgatatgcaccttgtttgtactacctaccctactgtgattaatataggagtatagggctacgctgtaagcattgcccatgcactggaccggcggtgtgtgggtatggacagcatggggtcagcgcggacggaggcggtggtgacgatgtcttcccggatgtggaggtggcgacagctgagtggaggcgggcaacggatcggggatctacagtaccggcggcgggataacacgacggcagcgacgtgacagtcggcggtggaagagggcaaggggtgggaggggcgattgacagagggaggattgtgcagcggagaggaggagaccagtggtgaatcggggtgagggagtcgattgtgaggagggcgacgggatttgggggccgcgggttgttactgatgtaatagctaattaaagcaggactttgattcctccgaatgttattgtttccgaatgttattgttgcattgatttaattctttccatagcatcgtacgggcaatttgctagcatataataaaatttgactcgttaagtgctattctacaaacacttttaattcgctaaatgacactttaataaattaaatcgaccatcgattttcaaccatttagacagtaatatctattttgtaaaaaaaaaaccggaaaccccatcccgaactttccttgcattacttcatctgttttattatcttcatgacaaattaaaattatttttatgggcaaaaaacccataaatagacctctatctactatgtctagcggctctccctatgtcattttaagaatgttttctaactcactacgtggtgatactgaattagataaaatactagaaaatctaagaaaaacaaagtattcgactatcagtttcttattttaggtcgttagttatttcctttaataaaagaaaacaacccaaacatctctccctccctccgcccgtgtatgatgttaaagtccatttaacatcttatatatgcttctaagccactacataacattattaaattagagaagaatctggtaagttcttaataaaaacatccacaaaattgtgacttaaatcgatggacacattattttaggttggtatatctatttttttccaaaaaaaaaatcccaaacctcccctccctctacccccatgcagtgctaaaagtccattaaacatcgtatgctaaaagtccattaaacatcgtataaacgcttctaatccgctacatgatgttcttaattatggacaaaaacaaaacatccaacaatcagttttgactcaaattgatggacacattattttaaatcaattgagacattattttaggtcgttagatctatttttttttaaaaaaaaaatcctaaacctccttccctcacttcctcctccgtgcagcatgcggttttaaaagttcattatacattctataaacgctatgttacgttgttctcttaaatcagacgaaatcctaaaaatgatgataggaaaacaaaacatattatcattggttttaacttaaacatccaacccattattttaggtcattagattaatcattcagaaaaacatcccaaacctccctccctccctgattgcccgtgtgcagcgtgcacagttccttttctctttcttttttttatctccctgacaattaaaattaaaattaaggtagatccaaacaacaggctaatctagcacacagtgtttcttttttgttttctaagagaagtctagcagtactatttgatggcatcagagatctgtgattcttcaatcaaactctcagagcaagtacattcttatgtttcaaggctgagagaccccaagttggtagctttagcttttaggccctgttctttcatgattctggattctaggtttttgtttgcatgcttccaagctcttagatggtttgtttcgtgcaaaatttttataatataatttttattgtaatacttttctaaagcatcttttcaactttgttgtagttaatttattcgtttatcccttaaatagatatcataaaaaaaatagattatccatcaatccaacgtgtttagctatctcaatcatggccttagcgctagctaacagtgcggctacaagaattcatatatagtcgagcaaatttgcaacctaggaagagtttgtaccagtacatgcatttctgatttctgtatatactataaaaatacccgtgcgttgcaacgaaaaactaaaattataacaaatataaaaatattagatgattaaggtttagttttacatattgaaataaaaaaagttcaactgaagggacctaaagtgaacttattccgtgcggagtgtacatgcggtccatgaggtggcccaatagtgcgggcggcctgggaacaattcggggacaacttgagcgacataaagtaaacttatttgtgcggagcgtacatgtggcccaatagtgtgggcggcctgggaacggcgcccggcccgacgcgggagaagccgtagccatccgatctgatggacggtcctgattgatcccgatctatacaaatactcagcagcccaaaccctaaccctaaaaccatttcctcttccccatctctctctcactcaaaacaacgtcggcggcagagcctcttcccaacctttctcccaccagcgccggcgttcccccttccccttccttcaccggtgaccggcgccaccgttccatcttcccctctttctcctgtctcaccggcacggcgcggcgactgggaggggacccaccagcagcgccgtttcccttggccactccccccttccttcaccggcggcgctcttctttcggcacgaatccggcggcggcggcggctccctcaaccccttgtcacctccctcccgcggtatatccgncgncggtgncggtgncggtgncggcgtcgncggnagaaggtggatccgccagtgcggcgggtggctccctccgccccctctcgcctccctcntgcggcagatctagcggcggtggcggcctcgcggcggccatgggtggatccagtggtggtggcggctgcggaggacagatccggcgacagcggcggcggctccctctgccccctctcgcttccctccctcggctgaaacgacggtggtggcgggcgtcggcagcgcagctcggcaagccactgccggcggccactccgcgccccttcaccggttttggccatgggaggcggtggcagcagaggcggctatggaaaaatctgctcgatttctgttcgatttgttttttttatctccgtttgctgttcttctattcttatatttgggatctaacataaactggattaaaactttgtgtgttatttgatgcgcactctggatgatttgttgtttgttggacttatgatgttgcggacgaaatttttttaattaggttaggtatatatttgggagggagctatcggggtgggaatcggacataaaatttgggtgctacggatgcgatcgatctgagaaaaaatattgggagcgatctggaggcggagtaaaaaaaaccgtgcgccattgggaagttgaaaaaaagaccatgcgaaaaaaaaccctagcgctatttccatttgggggtgacttatgaaatttttcggcaaaaacaccttgaatttttatctatactaatataaaaagaaggagttcaccactccaatccaggagttcaccactccgatcctataggccaaatcaactatactccatccccagcgtcccacggccctcccacggtcccaccttcccaccatcgccttgcccacactggggataccatgactcggatacagaaacaaaatctgtcccacctcccaccatcgccttgcccacactgtggataccatgactcgaatacataaacaaaatcgcatgatttcctcccaacctccacgagaaaaagtacaatatgccactccattcggtgggtttagataaaatgctatccaatacattgtaaaggataaaataccactcaataggttacttttaggatattttgccactttgagagaatttaagaccaaaatacccctggccgtggatagagaggaagagggaggagcggaaggttgacccggacgacgctaatgctccccggcggcgggtggcgagcgcaccggggtgggctgcgacaggtggacaaggggaggaagacngcggccgaaagggaggaagaccacgactgtgatgggggaggaagacggcggcggcgatcggggagaagggcaacgccgacgggagggaggaggaggcgacgacgatgacgtggagggctctgcagcgctgcccgcgcatgcgctcaccccctccggtgccacccctgtgcgcttatcggcgtcttctttctctcctcgtcgctgctagcgggagcacggacggtgctcgttcttccctcgtcgctgcccgccgccgacgaccacggccgctgccgttcgactcctctctccggctctctctcccttcctctctctctctccaaagtaggggcatatttgtcttaaacctcctcaaagtggtaaaatatcctaaagataacctattgagtggcattttatcctttgcaatatattgggtggcattttgtcgaaacccaccatatggagtggcatgctgtcctttttctccaacctccaccacacaattttctccgccttcatcgccggagtcttttacccctgtgccattaagaaagttagaggttacgtgtgtgccacaaaaaagttttgagtcacctgtatactatgacacaaactttcgtttacctatgcgccactttggatggaatcagcactaacggagactaatggaggtttaaaggtttattttgcccttgctctatttcagccactttgaatgaaacattgaacatttgaaagagaaatcggctcacacaccgcataaaggctgaaatgtaggttgaaggaaaatgaaataaagtaaacattctaaaaaattgaaaataaagttaaaacaagaaataaatatggaaaaattagtaaataattttaaaattatggaaataaatagaaaactgggaataaataagaaaaaaattcgtaaataaattttaaaaaatcataaataaatatgaacatatgaaaaaataaggaaaattcgtaaaaagataaggaaaaaaaatgcgtgcataagtaagaaaatgcaaaaaaaaaaagaaaaagcagaaataatacttggttataggatcaacattcaagcaacagctagcattacagaatcacacccaaactgaacaaactctgaactctgcaacaatatgtagcagcaagaaagcaataaatgcaacaagctgttcgtcctcacagctgcttcagtccgtcggcgaagcatgagctgaaccgcgccatgtcggactccggcagcgccacgccgatctagatgccgaccctgccgtcgcgcgcctccgccatggacaccgtgccgggcgtcttgtcgatggacaggagctccaccttcatcggccggcccagcccgaagtcggtgtcgtacacggcgtaccgcgcgagccggcgatggacatcggccggtgcggcatcagcgacacgatcttctggaaccacccatcggcaccgtccagaacgccgttgtcgagccccctgatggcggcgccgatgcccgccgccgccgtcaccacgccgccggcgccgagcaggccggccatgtcaagcaagggcggaggcagttgccgaggtactcctgcggcaccgagccggcctgggggagccgggttaggcgcgccgccggatctggcgaggtgacgcgagactaggcgaggcagcggcggcggcgtgccggcgccggcgacgaccggcggcggctataaaggcggcggctaggctagggtgaaattgctcgggagaggagcagagatgaaaatgcttcaggggcaatttagtcattttcatacgtgggtcccacatgtcagagcttattatctaacaaaagatggatggaatggcagataggtaaacgaaagtttgtgtcatggtatataggtgactcaaaatttttttttggcatataggtaaccttcaactttcttaatggcatggaggtaaaatactctcgtcgccgcctcttccccttccgcgcggtgcctccatccaccgctgccgcatcggctcctgcctcctgtcgccgcttccgctgctcctgtcgtcaccgatgccgctcccgtcttcgccgacgacgccggtgactccctccaccgccccgcctccgtgccgctcgccaccacaattggacctgctggtccagggttccgttggcgccacagccccgtcgccgaccggtggtccagccttccgccagcgccactgctccgtcgttctccggtggtccagctttccgtcgcgcctccggtcttgccgccgttacgaggggcatagtctgccgtaggtacttccagccgtgcgtcaaaatttcttctgctggtgagatcgagtgagaccccattgactcaaattgactcttctgaatccccattagtcttctgtgtggattcttattcagctgaagggtatgcacatatattaaatctctcctcttaatggtgtgattcggttcttatcaatccatatgtgcatcattgcaggctatatcctatcaaggtgactggtgttgctccattcagactaacattgtagacttgtagttgccatgctgcgtctcttccagattactttatagagaaattatattgtacaggtttgagaattgttcaagtgatactgcattccaccatttgatttctttagctagggatactataaaattgtcgtaatacaagcttatacggatatgctggggatgggtgaacaggatggaaggcattttttataggcccttgtcagatgatggcttttggctttaagatgctctatgagaagggtcaaggagattttgttctgttatttatcattgattggcatttggttgatatatatgaattaatatactccataggcacaacaaaaaggtaatattcatatatgcaggattatttctttgctttaagtttttactaatttttactatggttattggtcactggtcagataaggtacatacatatatttgcgtagtataaacatattaaagaaactcagcttagtgtatgcaagggggcatggaacaactctgattctgaataggaataacttcttcctttttctgggctaggaatttgagtgtttactttttcattaacaagccttatgtgctcctagctagcagctgccggtgaattgataaaattttggtgattttgtcctaacgcttcaaattttgttttgggtagatccaaggacaaatatattctccaaacagatgaacttttattaaagaaaaataagatattttattttgaggcacaagtatgtgctatagccccaacctctacccaggggcacacgaccaaaacacattccatgatgctccagaagtctagcactgctacaacatgcataatttcatctttatattggcattgatccgggattatcctagccattgtcacatgctgctaagaggcggtccttttttccttctttgtgagaggaggcaaccttcatataagcctggtggcatctctgaccacatgcttggaggatggaattaggcaatgtgatgcacatgacttcaatgaagcgagttaatcggggttgtagatttggaggatggcatcagggaaggtgatgcacatgacttaagtggagcaagttaatcacgattgcaggtttgaaggacgccattacttacacataattccctgtcagaataatatttgacattcatatgcttgtacacatatgaaatcccaaaattatctacctgaatgttcttgtttgccacatgcataccacaacactattgactatttgtgaattatctgaaatttgcattttacttatgtatgctgatggttctctctgctcaatctcaattcaaagagttacatgtcattttccttataatctactgttaagttcctattgaatttatattcgctgaactctacccaaccatgtttgctgttgctccaaccaaaattaggaggctttatagtctttgtgtgccatacaactttatatgtgaatttgaatttagttttacatggtctgaacttgggcttgcattgctcaagaacttggttgacaacattctgaaattgtccttgcattatatggcatcctgtgtagtgtaattaatgtattgtttctattcttccctgtgaactattggttatgtactgagttaataattcctgacagcctttagaaatgtggaacactttccttttttttgttacaaatttcctaggagcaaaaaaatttccaatcacatctcatgttgtgtcctccaaaaaaacaaaaaaaaatgctgtaattttctgtcatgctgatgacaaattctttatatatacctcaaacatgctattcattttctatatttggagtctttgtccttgcaatatgtgtgaaccatagatgtctaacatttgccagattagtgattgaacatttcatatattattttctgagcatttggcatattagtttctgacttgtccttatgatgtaggagcatctgaatttagaatctgaacttcgacaagcatctaaatattgttcaatgttttaatttgctgtgagctaattaaagttatgaatttctcatagctcaagtaccttannnnnnnnnnnnnnnnnnnnnnnnnnnnnnnnnnnnnnnnnnnnnnnnnnnnnnnnnganncgagcgatcagtcattcaatngtacacg

SEQ ID NO: 14175 - DNA, 21136 bp, Oryza sativa
  unsure (1)..(21136): unsure at all n locations
tgcgacattgactgccactctcttnnnnnnnnnnnnnnnnnnnnnnnnnnnnnnnnnnnnnnnnnnnnnnnnnnnnnnnnntgacctacattattaaacagagggagtatcttttttttagaactacatggaatgtatctgaattcaatgtgtggacataccattgccattttttttgaagtcaatgtataaatatgcccttgcaagcactgtttcttcccatacttttacttttttaaatatacattggaaaaacgtgccttgcacgggcattattactagtaataggtaaagatataccaagtgcgaactgccaatactttttgctacgagaaaggagagggcataggtgtgttgtgttttcggtatattggtgggattgaattagcaccgccgctgggaaagaaccagggtatgatggagtaatgaatgcctgactctagctagtgacaagggtttacatgaaaacatctataaacttgaaaactattgcaaaaaatactcaaaagcttttaaaacgcacacatataagtgagaatttagataaccatataaaattgtaagaccaaactaaacttcgttttggagtcatgaaattaagtaattaacaaatggctaaaaacattgatcttcagtttttattttttcttacctattttgttaatattgtatctaataaatgaagtcaattttaattaatcttgtaattttgtaggtttactaataacactttgcagtgttcaaaatacataatctatatattagcgatatagaaatgttcagttttgagcttagaacatatccccctgatgagaaatctgcacaaagaagtgtaagaaacgtcaggaacacatgttgtatctgacatgaaagagcaacaaacaaaataataagaaaattatgtgattaactgctatatatcctcctggttatgcatgcttttagttctgttgcaaagagtgacgttgaacccccaccaaagaacaatctttccaatttccacaaatgacagcagcatttgcacttagacaatccaaccaaaccactcaaactcattctcaagcaatgcaactaaataaatgaaaatttaaaataccatattattttgccatggtttattaaatataaattagaaaaattctaaatcgttacgagtcattcatgttaaaatacattttcaatcatgtgctataaattaaataacatgatatggttagaggtaatggctagcacagcatgtgtatatatcagaagcccatgtatcagatgctaaaatgccatggcacatttaacaatgtcctcgataagcaaaatatgacttatagagaaaaccgtaattttggctcaaactgaagatcaagacagagagaacaataattttgctcaatctgaagaccaataactgcactgaaaggaaattctaccattataagtacgagaatcagtccaccatttgggtaattttgtttggcaaaatttgctacaggacacgtaaaaaacatgtaattagctgggattagctgggagacaccgcgaaaacgtgatatggctgatggacactacaaaaattgtgtaattggttttaggacactggtcgtattattttattatttctgggtcaaaagagatgagatattttcctaaatacccggattgccacttctctttcttcgttttctccttcgccgggaacgcgcgcggtgagggtgaggtcggcgaggtcggcgcgagcggggcggtggggtgagctaattacatattttttgtgtgtcttgtagcaaattttgccattttgttttactaattacattatgaggcaagtactaattgcaagcatattctcattttacccactattatcttgtaaaaagtcgaaaactgaaggcattcctaggcccctgacaagtcttgtaaatcaaatatgttaaagataaaatagcatgtttatcttctttctgcttttgccgatctcctatccaatcttcccgattctgttatacatcggttgagagattctggtatggatgtagctatatatgtacacatgttccgtgattaatcgatatcgcgttgagctatccctgctttcatggtatcagatactcccgatccaatcgcttccgctaaaccctaaaacctcatcgccgacggctctctctcctgccggcgcccatgtagtccgtcgacgacacggctcttaccgcggcggtcgcctccatcaccgacgccgccacctttgccatccggcaggtccttcggcccgacgactcggcctcacctgacgaccgtgccgccgccacggctctcatcgacgcgacttcggccgcgactgccaaggccgtccaagcggtgatttctgctctcgtcatcacgcctatcaacgacacggtggccacagcgtcaagttctaccttcccgacaacggtcaccgttgacgccgcggctcttcgcgccaccctcggacttcctccagccagcgcgaccacgcaaccgcccatcggcctcggctcttcttcaccggccgaccacgctagcctgttcgctgcactcagccttcaaccaccacagcacgaacgagaacgctaattagcgttcagtcgcgcgccccctcccccgcgcgactggacgcgtgtcgcgcgcggggaggagggtggaggacggcgcgtggaaattttttttttctggtggacggtttctttttttcttttttctgtttttttctttcctttttttggttttttctgtttttttcttttcgtatctttttcagttattttcgttttatacgtatacagactttgtatacgtctatacaaactttgtatacgtctatacaaactttgtatacttctatacaaagtttgtatacgggtatatacaaactttgtatacgcgtatacaaagtttatatatgtgtattttttatttttatacatacatgtaaataaaaacccaaaacttttgtatatgcatatacaacgtttgtatacgcgtatacaaagtttatatatatgtgtgtatttttttatttttatacatacatgtatataaaaaccaaaaatacacgtatacaaagtttgtatacgtgtatataaattttgtatacatcatatataaactttgtatacgtgtatatatatatatatatatatatatatatatatatatatataaacaattataatagtactagtattacaagtagtagtaataatgtactagtggtagtagtattagtagtagtagtagtattgtagcagtagttgttgtactaatggactaaggcaggcaggactgaccgcacgggtgcaggcccgcgcggttggtcgccgatcagccacaccctagcacgaacagcccgccggctccatgtccgggggcgctctgccaacctctgacactgtcgatgcccttcatgcccaggcggtgtctgttctcaatgtcaaggtgcttgtccccgtcgtcctcgaccttggcgccgcaaattaccaaatatgccctcaccgaccacgtcctctctgacgacgcttttcctcatcatgcgtcctgggctcggacggattgtgtcgtgctctcgtggctctatgggaccatcgccaccgacctcctggagaccatcattcagcctgatggtaacgcacgcctcgtctgtctctccctcgagcagatgttcctcggccactaggaacagcgcgccatcaacctcacggctgaatttcacacgttcgtccaaggtgacctcggcgtgaacgactactgttgacgtctcaaggctatggctgacactcgcggtgagctcggcgaccccgtcaccgaccagcaacttgtccttgcaatgatcggtggtttaaaccctaaatatgaaattctccaaactattattcctctgcagtgtcccttcccgatgttcgtcgaagcccggatcgagtaagctaattctcaccgagatcaacaagggcccctccaaccgctccaccaactcctncaccgccctcatgaattgcacgccacggggttcgggaacctaaatcaaagcggcggcaacacacaaggtggcggcggcaacaacaaaaatcgctgtcgacgcaacgggaacggggccggcaccgcggcggcaatggcggcgccgctcagggcacatgtggcaaaagcgtaggtcaggctgcccctcagcctcgcgctggacaggcctggcccactcctcagcacccctgggtcggcacgattcaaatgtggctggccggcccgatgctgcgtgctccagggattttgggccctcggcccacttctcattttgcgggcgtggcaatgtccggtgggcaagctgccctcccgcagccggtctcccaggccggcccttaccttccagccggcctcactcagcagcaacaacaactgcagccatcggcccaaccaacgtcctggtacggagcctccagcccaacacttgcttgggaccaacagactttggcaagtctgtttcaaaccgacaccctcacgacgcctgcctccaacggctggtacatggacaccggtgccacctcacacatgacatcggacaccggtatcctatcctctcacccaacctacctacgccactctgtcccacattatcgtcggcaacagttctcttttgcccatcattgctactagcagtctggcaatgcttcatttcttcacgctaatagaatgtttgttctcaataacagtcttgtttcacctaacattatcaaaaacctaatctctgtttgtcggtttgtcactgacaacaatctctccattgagtttgacaagtttggtttcactatgaaggatctacttaccaggaccgtgatcgccaggtgcaatagcttcggtgacttgtactcctttctggcgaacttcttcacctccattgccagttccttcgctgccactaccaccacactctggcatcgccggcttggacacattggtcacgacgccctcacccgttttgctcactccttggtcatctctcctcccaaatgcggctcctccaccgtatgccatgcgtgtcagctcggtcgccacatacgcctatcttttgctacttctttgtctagggctaaggccaattttgagttaattcattgtaatttgtggacctctccagttctcagtgtgtctggttttaaatactaccttgtcattcttgatgattgctctcattatgtttggacatttcctcttcgtttgaaatccgacacattcaccactctttcgcattttttttgcctatgtcaggacacagtttgctacacccattcgcaacatccaatgcgacaatggtcacgagtttgataactccgccgctcgatctttcttcctcaccaacggcgtcgccatgcgcatttcctgcccacacacctcgccccaaaagggtaaagctgagcgtactcatcgttctcttaataacattgtacgctcgcttctatttcaggctcacctccccggctcattatgggttgagtctcacccaaccaaaactttagcccaacacactccctacttcgcccttcacggtgtccacccctcatacacacatctttgcgtctttggttgtcgttaccccaacctatccgccaccgcaccccacaaactctcgccacattccaccaagtgtgtgttcttggataccctagcgaacgtaagagataccggtgtttcgatccgatcaccaacatggttattatctctcggcatgtggtgtttgatgaggatacatatccctttgccgaaatgactggtgacactgcttgtgctactgatcttgctttcctggaggattttacttctcctatacaggctccaattggctccaatcgctcggggaaggctggcttcacttctcttgggcccaccggcgcatgcatcgatcggccgacccctccctgcttgccgggctgggctgggcgcctctctcctgggccggcacctgcgggctcatctgcgacggcccatggggtctctactttagggccagcttctccggctcggtctgcccacgatgatgccatcttggcccatgacggcgctcctcatgtccacgacggcgctttcttcctggctcatgacggcgcaccttccccagctcatgacggcgcgtccagtacgcgcttgctgcgtgccccgcttctctagccgtcgccactcgcggtaccgacgtgcgccagaagcgcccgcgccctagttacatggccaccggttacaggcttcggcatctctcccatcgacaacaaccacgccatggtgacaaggggcaaggctggcgtcccggttgccacttcacgcctgaacctccatgccgccactctctccctgatacctcgcacctaccatgctgcgctcgccgacaccaactggcgtgatgccatgcaagaggagtactcggcaccgatgtcaaattgcacttgggaccttgtgcctcttccaccgggcacaaacatcgccaccggcaagtggatctttcgtcacaagttcctcgccgatgggagtttggaccgctacaaggcgcggtgggtcctctgctgcttctctcagtgccccggcatcgtcttcgacgagacctttagccccatcatcaagccagctacagtctgcacagtgcttagcttggcagtctctcgtaactggcctatccatcagctcgatgtgaagaatgcttttctccatggcaccctcgcagagacagtgttatgcatgcagccatctgggtttgttgatcctgctcagcccaactctgtttgtcgcctgaacaagtctttgtatgggcttaagcaagctccttgcgcctggtacagtcggttcgccacttttctccgctccgttgggtttgttgaagccaaggcatatacttctctatttatttgtcgacgtggaggtgatgtggcctacctcttattatatgttgatgacattgttctcactgcttcgtcgacatcgctgcttcactggacaatctcttctcttcagtctgagttcagtatgaaggaccttggtgagctccatcactttctcggtgtttcagtctctcgccattccttcggcttgtttctcactcaacggcagtatggcttggagatattggagcgtgtaggtatgttcgactgcaaaccgtgtagcaactcggcctggtattcagtatgctgttcagcagatttgcctccacatgcatgatcctcgagagtctcatctcatagctctcaagcggattcttcgctatgttcgaggcaccctggatcttggtctccacattcgtcactcagcctcacatgatttggttgtctactctgacaccgactgggccagttgtcctgacactcgcaagttcacctcgggatatgctgtgtttttgggagataatcttgtttcttggtcctccaagcaccagactatggtttcctgttcgagtgcagaggctgagtatagagttgttgccaacgctgttgccgagacatgttggttgcgccagcttctccatgagcttcatgctcctccagtcaaggctactctggtctactgtgacaatgtcagcatagtttatctcttgactaacccggtgcaacgccagcgcacgaaacatgttgagattgatctacactttgttcgtgagaaggtcgccattggttccgttcgcgctcttaatgtgctcacacattatgctgacatcttcaccaagggtcttccaactccagtcttcacagagtttcggtccagcctaaacgtttgttcgaacgacgttcagtctgcgggggcgtgttagagataaaatagcatgtttatcttctttcggtaaccgcgcggttaccggccttaccgcggggtacggtaatagaaaaactgcagtaatctttttaaattcaaataaatttaaaaaataatttaaattttgataaattttacacggtttttcacggcgcggtaaccctggccctgacggtttgggaaaccctttttggcatgcatactggatgctcgaaatcggtggaaggctgcacaaaatttgtactgcccaaattagcagcgagcagagccaatgaaaatctgtaaatcccccacagtaataaaggaaatggaaatccccaaatcagctgcagcgagaggctctggcgccgtcctcgtcatctccacactactcgagtagtccatctgcacatgaacagcttggtggataggcagatcggacggtcgaacacaggtgatgaatgaacagtgtaacagttttactaatttgttgacaattagtaaaaatgtattcgattttcaacttttttgggttcaaatttcctgaaaacttggaatttcagtctaccgattctttttggactctgacatcttcatccttcctcagaagttagcaacaggcatgggattgcaacagtaattagtatagcttccttcactgttcttcgataaaaaaaaagaaaaaaggaaaaaggagtcgaggacgagcagagagcacagcatcagttttatttcatgactacacaacgaccggtctctggtttgcctaaagcagcgatcactccatcctagatttaaatcttattttagcttaaaaagtactatagtgcatgtttttttacctctttaatcacttgtatcttttaaatcatatattatttttaagatctatttgtatcattgtactccacttaaaatatgtgataaaacgagatccagattgaatatattaaaatattttattaatttaaaagtaatttatttaaattgtaaaagtaacttagctatgtaatagaagtaactctatatagaagtaattacattatgagtgagttccaataagaaactatgtggagtaaattcaaaagtgtagagaagattttcatgtaaatacatttatgaaagtaaatttaataaagcctgaaagtaatttacaaaaatcataaaagtaacttagtataaaatgaaagtaagttgttatgatattagaagtaaattcgtcgtaggaataaaaatataagtctatttagaaattaaatttaatcaacacaaattatgaaactgagtaaaaacaataataataaaagtaatcaactcaaagcattatgaaattatgagaagtaatttaatcaaatctaaaagtaatttgtatataagataaaagtaacttacatatattataaaagtaatttataacataaatgttttttttatcataatattatcatgtaagatcttgttataaagatttaattgcaacgaacacaatggtgtaatcggattatagatcggataagtaatttaagtgaaaattttataagaagaaaaaatatgcacaacctaatagaaaaactgcttacatgcatgtctgtaatgctactaatacttctcacgtaattgtccacgtcgctcgttaagtctaaatcgagatgcctctcgaaatagattttgcgtttattaagatactccctctgtttcacaatgtatgtcattctacatcaatatgaatgtgggaaatactagaatgatttacattgtgaaacggatgaagtagtagcgagagatgcatcaagcatcaatcatggaaggttgagtagctacgatcaggtgtttgtaggaaatactaatatcgtctcaattggctagccacagaacatagccctgcggcatgtagtggcagatggcgtcgccacggcttgccttgaggagctcgaagtaggcactgtcccaggtggtggtgttgacgtggcacacgtcgacggcagtggcgccgcccaggcccacgccggcgacggcgtggaggtcgaccctcagcgccaccgcgtcggctggccggtggcagtagtacacctcgtatggatatggcatagggtggcacgccaccacggcgtcgccgccgatccgggcgacgccgtcggccgctaccacgtacctgcggggctccctcccgtgcacgagcgtggtgaccgcgcgcggcgcgctggtgcccagcgccgaggcggcgaagtcgagcaccgcctcgcgggaggtggcgtggctcctcgccgccggcggccgtcagttcgccgcaggtgcggagggtgtcggcgacctgcgccgccttgtcggatccagggaggatgccgaacatggcgaggatggcgtccatggcgcgaaggttggacggcacggcgtcggccttgtccttgtagatgatgaaccttggcgccgctgcagccacgccgtggtcgtcgtgcgccagcgtcagcttcgtgccttccggcaagacacagcatcccggccgcctttgtgtttttggcattctctaacttgaggatgccagccaaggctaatttcagctggctgcatatatatgcaaggggcggtcaagttacagaatgccaaaaaacacaaaaacgacaatgcaactcagccattgatttgtgtgatccttcaatttgcagtgatgatccaaaactaattctaatctgcttagtaactaattaatactagtctgtatgactgtatatgctgcccttttatagcataggagccatgaaaagcatgtgtcatctcggcaaagagaggtgcaaagtttgtgagtttcctactctctctgcatatgcatatgcactaatccctttgtttttgccctgataacctatacatctcattattgttcctttttttttcaggggaaagggataattactcattagcctcctcacagataaactgcgagataaaagtacacttattgtccggccaaaactgtgtgatcttgtcacaacggcccttatttgctaaatagtgactaatattattttgacttctaagacacttactgaagctaatatccctatttcccaccaagagagaatctatctccctgattaaaaacgccagctccgatttagcacctgttgcatcgcggaaaagatggatcatcgccaagcagtctgtctcaatcactattggcagcagggtccattgtagggcgagggcaagactatccctgcaggcaaggagttccgtttccaaagcactgctacagcgatcaacatgtccacaagcagcaaaaataacctctcctgtgcagttgcgcaacacagcgcctataccacccttgccgtcactctcctggaatgagccatcaacattcagcttcatgcttcctaggagcggcttcgaccatttgtcaggaacaggttcttgactccgtttgatgttgtgcgacttctttagaaccacatccacaacatgtttccccttctcaggacttgcttgggggtgttgcttgatctcagcaagggagaggacatagctttcaatgaaacgtttggacactagtattcctggggctggtttgccatgcactatttcattccgtgtgtgccagattcgccacagtaccattaaaagcataacctgttcctccggctgcgactgctccaataggtccaagatcactttcggatctccattgcgaatgttgctgagagggttaagcttcatatcaacagtcatcgcttcccagaattgccgggcatgtgggcagcgaaacaaagcgtgaacaacatattctgactccaccccacaaatggtgcagatgtctgaaacttcaagcttcctcttcttcttattttccaatgttggaaggctgttagtaatagctcgccaggcaaaaatcttcaccttttggggcgcattgcatttccaaagggcattccaggctctgctatttccattcccggacgaactcgagccttcatcaacctgtgccagagctattgccagatgataagcacttctgacagaaaatctccccagtctatccggatgccaagcaatgaagtcatcctccagccttgaagataaacgaatgtttaggatggcctctgcgtccatgggcaggaaatgctgcgagattttgtcagtatcccaggactcggactgatcaatcaggtctgaaacccatctcagtctgcaatttcttttagctgagatgggtcttcttgaaaagctccgcggaatccagggatccctccacaatctgactgatttaccgttgccaatgcgccatatgatgcccttcttcagtaattctaaaccatattcgatcgctctccagcctggagaggcattacctccaaaacttgtatcaatgagagaaccgtccgggtagtatttggccttcaaaattctagcacagagactgtctggtctgtccaacaatctccaggcttgtctagctagaagtgcctgattaaacagcctgaaatccctaaaccccatacctgccttcaacttccgagcaatcaaacagtcccaggatttccagtgcgttctcctcttccctttctctgctccccaccagaaattacgaaccagttttgtcaattcctcgtagaccgactccgggagcttgaagagtcccataacataaacaggcatggcctgtaggaccgctttaatcaaaatctccttccccccagttgacagaagtttctccccccacagcataattctcttccataatctctcctggaggctttggaattttcctttggtcattctaccctcaggcatcggaaagcccaaatatttatcttcaaaggaggtacttatctgcagggcctgctttatctgattttggacagcaataggagagctttgcccgaacatgatggagcatttgcaaggatttatcaattgcccagtgcaggaagcataagtttcgagaacttctttcatcactaccgcctgagcatttgccgctttaaagaacaacagcgtgtcatccgcaaacagtaaatgcgacacagcaggagcacgccggcatatctgaattgggttcatagctccctgatccactttctcttctagtaacaaggacagtccatcagccacaaaaaggaataggaagggcgaaagaggatcaccctgacgcagacctcgtgatggagcaaaggtgttcaacagggttccattaagtttaactgcatatctcaccgaggttatacatgccataatccatttaacccaacagtgagcgaaacccagtttaaccattgcttactccaaaaatttccagtctacacggtcatacgctttggacaagtccaacttgtatgcgcagtaagcattctcaggatttttattcctctgtatatggtggaagcattcgaatgctatcagggcattatctgttatcaatctaccagggacaaaggcactctggttctgtgacaccagatcatccaggattggtcttagtctgttcaccaaacacttagacactattttatagaccacattgcacaaactgataggtctgaaatcctttagttcctatggttgctcagttttcagtatcagaacaatggcagtctcattgacccccgaaggcatggtacccgaagagaaaaattcttgtacagctcgcacaatgtcgtcctttagtatagcccaattcctctgatagaaccgaccggggaatccatctggcccgggagcttttaacggaccaatttggaacagggcatttgcaatttcctcttcactaaaggttttgcatagtttctcattcatcgcatctgtgactttcggcttcatcaggctagtgactcacgaatgatcaatactggggtcggcagtgaacagcctttggaaatactcagttgccatacgttccaactcttttgtcgtactgtgaacagtaccgtcactatcccgtagctttgtaatcttattcttcttagctctccacactgctttgctgtgaaagaaacgtgtatttctatcaccttctttcagccaagcaattcgagatcgttgcagccatatcatctcctcacggtacagaagttcattcatttgatcggacacccgtcttatttccctattgtcggcattacttagaagaagttcagatagtttctttctatttttctcaatctcccggctgacattcctgaactttttcttactccatgtgcgaagatcagacatcatcctaaacagagcttgattaatgtcgcgcagatcctgcttaactccggaaacgccccaagattctgctataacttcagagattgcagggtctctttcccagtaaatttcataatggacacacttcacaggattcctgtgaaggtcttcagaagaaaatttgacaaggatggggcaatggtctgatctaggagaggacagatgaaacacctgtgctgtagagaacagtcccctccacccatcatctgcaagggcgtagtctaggcgcactttaacattgctgcggccttctctcctattatcataagtgtatggcacccccgagaaccccagatcatggagatcacatctctggaccacatccctaaaggcttgcatttgcagctcacttcgttgtttcagagagaagtgctcaaactgccaaagagtctcattaaaatcacccaccactaaccacgggggatccgaaacttgcttaactgaatttaacaacgcccacatacgatgtctattttccactctaggttccccgtacacaaaagtagcatgccagacaggagcattcacagataaacgaacatacgcgtcaatatatctctcattcatacttataatttccacatgaacagactcatgccagaataaagccagacccccactcatcccatcactgttaaccccagcaaaacccttcaaacccaatctattccgcagcctacgaaccttctcaatcttttgcctagtctcacttaaaaacacaatatgggaacctgcctccttcactaaggcacaaaggtcacgaactgtcgccgcgttccctataccgcgacagttccaagccaagcaactcattgctcctgacgggacccaatcacaggtcccgtcagtttaccagcggccccatggctggttgcctccatatcgtctgtgtcctcaccctctgcagccttcttgagtctcttcactgctctagctgccttgccgatatccccatgcatggaattgctgccacctgtgtattgttggtattccaacaatgcttgctgaaccctcccttttatctggagtcctgactggtctggcatcctcttcctattggcatcgctgatctcctcggatgacacttccccaaacgaggcttgctgttgaaggttcctcatggctggtatcatctcagaagcagaaatttcatcaccatcagtcttcttgggtgcttccttctcctattgttgctgggctagcttcccagcagggacaaccatcgatgtttcctgagttttgtcccccgtaacatccatcttcccagcctgttgagctaacatctcatcaattgcagtgtccccttccctttccttaaactcaaacccatcatgggcatcaactctgggcggtattgcttcctgcatctgaccatcttgtttgtgtctggaggacgatgaactagcacttcctgcccctctgaagaacaagttacgtgcaacacttgatgtttgggcagctttcactttactgatcttcttctcaaaaggcttaagggggggagcatcgtagctcagctgagaattggaaaggttgatcctcattggcagatcttctattgcaatctctgtcggaatgaccaataaaaccacagataaagcaaaagtgcggtacccgctcataacgtaaatcgaacctgcgaaggacctccttgccttggacagtcatccttatagctatctgtgatttcagaggacgcttgacagggagatcaacacgaataatgcggaagaagtcatgtttgttgcgtccatcatccctcacgtctacctcacgaactttgccgagtttgctcccaaacatcccacctcttacctttgtcatcaacaccagagggaggtcatatatgcgcacccagatcggaacaacatccaaaggaacattcgatgggcacgtaatgccatcaaaactcgctaccaggagtgcatctcctctgtgaatccaaggaccccctttaatgacaaaatcagtctccctctaccgagaaggttatgatgaacatgttgtcacgtagtgatttgtagctcatatctgctctcaacctccaagctctgcgcatgtcgtcaaacagggccacttggttcggagttctcagagaatagaacctcgccaagatcgtccacaggccagcagtctgcagttcatcatcctcaatattcaccgcaaccacatcctcctcatcctccaccagatctccttcagtgaacactgcaggacactgtgttgcatcaacttggttgttctctgcagatcccctcctcgcagccgttgtgtgttcctggccctgatcagatgtgcccgctgctccctcgatcatcttcagaggaatcctgtcgagaatcaccgcgtccgtctcattaccgctcatcagcttcgggtgggaaatcgtcccaatgacgatccctttatcacccccaccgacattggccgccatgagacttccgctagatccaacaaacaaagagacggggttgacaacgcctagccctatcgccggaaaaactttgaaccgcaccttcggccaccactgtgacttgtatttatactgcaatgccacagaattaggtctccaatacaactcgaacttcggataccaaaacagattcaatctcctcccccttctagaatttcgcaagggccacagatcccctggaacaatacggaaagcagagaacgaacctttcccatagatcaatccgcctaaagggaaagccttcaacttatctcctatacgagtatgatcaggccaccctaccagatcacgtttcaacacagggaggaaatcccccccagaacaacccacggcgggtaaaacccccggagacatcaggagcagatcagaggagatctccatccagacccatctcgccacgcgcgagagctctgccgccgcccggtcgcccgggtggcgcataaaccctaaccctaacatctcattattgttccttaacattactaacgctgatatatactgtaaaaaaacttcagcatgtacaaattgatgaaaaatgttcattcattttgaaaataatttacatgagctcttcctactattcttctgctatatattggctatttagttcaaccgcttctggatagataaacctgtgactcgggggtggagctagtgttatagcaatggtgtcacatgacaccaatggtctttgctataattttgacaatctaacgcttttagaaaacatatttgaaaagagaactatatcaaaaacttatttcaaaaataagccgtcacctcagtccaatggctctgtgccagcaatcatggcgctaaccctatatatctgttaagtgagagtatatgttcctatcgtacataaaccatcttgtaccgaagtggtgttggtcatccgtttttttaaaaccacaagtagacacgtggtttgatcacccggttcccatgttttttttgtaaatttttgcgctatttcccgtgagcgatgatcataaaggcaaaaaatacgtcgagggggagattcgaacctgggacttcgtgacatctcactaagcaagtgaaccactacaacacatgcaatgaaatgctcaaatttagcacacgctgtgtgcgcggatggcggagtttcggaaggttgccgatggcggtgcagatctggccgtggctgctgtgcacgaggaaggagggaggagtcggcggcgttaggatggaggtcgccatggtcatggcacttcgacggttggccatggcgggggcaactcacggtgtcactgccggtgtggcggtgtcccctgttcggatcgtggccgatgcatatggtgcaagagatgctgtcgcgacatgacgaggcgacatccctcacagttggcagcatgtagggaattttctgggcgttggtgttggctcatgctccactggtggataggcctccccctgctatctacagtaaaaaaaactttcactaattgaataatcaaaatttcaatatttggtccaagatatagcgaaatacccatgtatcaacttatggcatatccactcgtggatctatgaggctatggaatggtgtatataagggatcctttgtgcgataacgcatgaagcgaacgcaacctagttcaatctatatgtgattattgaattatttccattgttttgtctgtcttatttcggttttatcgtttaaattggcagagttcttatcaatcatgaaaattatctttatctgttgaacgcacaaatatttttgctagtccttaaaaaggtacaagggtatcatattttctattgcctttgtacttccagatactaagtatctcaaaaaaaatatatcttgatgtaccaaaatttgtttttagtgtattccaagtttccgcatcctaaagcaaaaccatacattatacatggaactccagaaccaccactaaagtatataaaaaaagtcgcatatatatatatatatatatatatatatatatatatatatatatatatatatatatatatatgtgcaacctctttaaaccaccatgtatagagcaaaactgaaatttactaggggtcattgtacaaaagcactaacaggtgtcattgtggaacaaataataataacatgaaagaacattgcaagaggattcaccattattatgatatttccttcctcacagggaatatgggaggccatatcatcataaagggcatgattgaaaacaagatttcatccttttctgtcacctcgtaaaccttgtgaagttgcctactcttaacatccaagtagagtgcacattcatctgttttcaagaacaaaaactcagcatcgtcccctacataatccatgtaaacaacacgactatccccgcccacacaatttatgtgcaaattagcgcacatcgaccgcaaacaaatggtatcaaccagagtccatccagtgctgccatgcttaagtagccaaatacgaagctgaggctccttcagatcggcgatataaaccccagaatcatcgctcgctcgtccgaacaaaacgtcgtggcttcgatcattataccacatcatcacaggtgggaactccaccccatctggaagctggatggtgtacacgctcgaggacttcaagtccaacacaagaacgctgctcaaagtggctgccaagtaggccttgtctcggaccccgacgaacccagctgattccggtggcaagccaggtagctgtgccgtcgccttggtatggacatgccatccgccgtcccggaatgcgtagaaccacgcggaagtagctccccttggggtgaacatcaccgatacccggtatagctggctgccgccatcctctccgaagtggaacccccacacattctcgtcgtcgaagccgagatcaggctcgacgtcatcgtcatcgtcatgtgttgaagagaacgggatggcgagtaggcctctctcaggatgctgcagcggtctgtgcaccgcgtatttgagctcgcgccgatcatgcctctccttgaagaggaggatgctaccgttcctgcactggtagatactggtcgtgtaaccctcgtaagcgaggctgaagttgccaccgcgaaggacgacggggtcgagctccggtggccgtgcaggcggcggcatcgggacgaagagcgggtgagcccgcggtatcttgaggctcgtgacgtagaagcccaggaggcggggcgggtggagctcgcggaatcgccggaggaaggaggggtcggaggcgacgcggagccagcgtctgcaggcgagcgcggcgcggacgagggtggtggggaaggcgaggcggagcaggatctcgccgacgaggtcatcgttctcgagtacggcggacacggcgggtgacgccgccggtggcggtggcgacagccgatcgccgtccacctcgatggcttgattcgtctgcgtcatggccacgtcgaattgaattgaattggcgatggtggggatgatggagagataaaacagcacgatgtgatcgatcgatggagggataagttaattaatccgagattgtacaactatatatatatccatatgggactccatagtgcccgggctccaagatataaaacacataaattctctcaaatttttaaaaatttacaaattgtaagtagatatctaggtatatgaatttgattcatacaaatacctaacaacaaaacaactcaaactcaactttatttcacaattcattattacatacctaacgaattatatgtttggatgttatataactagaatcaaaatctaacaaaaaaaattcagtttaaaagaagttaattgatcatatctaaacatttaaaaaaaattcatactcattcaaattgggtagatactcaatttgaattttgaaacccatactccatgtagcaccagttaatttccctatatatatatatatatatatatatatatatatatatatatatatatatatatatatatatatatacataaaacccaatgtgaatttgagtccttttctttcttgaaacgaaagtttgagaatcgtacgtgttaatcatacagatcaccgcagattaaagtaaaagcgcgagcgaggtggcaatgcaacagatcgatcgtagagatcaccgctataattctaaaccccaagtcccaatcgatttcttcttttatttttgcgaggaaaagtccaatccttttaaatcgtgtttcccttgttgtgtgtatttttccatttcttttcttttcttgaaagttgaaacaactctatttctttttccactgttttagttggttttcacccgggtttacattaccgctagtaaccacggtaaccggtcttgccgcggggtacgatatagaaaaactgcggtaacctccttaaattcaaataaatttaaaaaataatttaaattttcgataaattttgcacggtttttcgcggttaccgcggttaccgtgcttaccgccggggcgcggtaaccccgagcccgacggtttgggaaaccctggttttcacagttcactctaccatggacgtccgactgtgttactttatcttaactaattannnnnnnnnnnnnnnnnnnnnnnnnnnnnnnnnnnnnnnnnnnnngcaagctggagtttcatagaggtcttcttcagtgctgttcatcctaggcacgg

SEQ ID NO: 14176 - DNA, 793 bp, Oryza sativa
  unsure (1)..(793): unsure at all n locations
cgccgtaatccccctccctcctcgggcaggtcaaaaaagcaaccgaggcttatgctgcgaaagcggctgacgctggacaggctgccttctaccggcaaggtgagcaagtacaatttggcgccggagccctccccgtcaagcaagtctgggaagcccctatcgcgatggacgacggatgacgagggtcaaaattcttaaggtcctcgtggcccatttcaagagcctcggaactcagcttaaagttaaggggatcatcgctgctgtcggcgatagcctcgagaggaagagcatcaagtattcgcacatgtatgaaaaggtgcggaggctcaagcagcggtacgaggccactgccaagaaagttgaacacgacggcgacctaccagctaaagagaatgacctgcggatgtatcagctatcgtcggaaatctggggaaagaacgcaaagatgctggcaattcgtcaaagaacaagaaggggcaagctaagaaagataaggtgagtggagattcaaaggaagccgccaaggaagataaggtggatgaagccgccattgctgtgaatgaaaagggtggtactctggcagagaataagaaggggaaaaccaacaagcagaaaacaggtatggaaacaaaggttggatcatctaaggaggctgctcttgctgctagtccaaccaagggtaagaagaagggaagccacaaagacaaattgnnnnnnnnnnnnnnnnnnnnnnnnnnnnnnnnnnnnnnnnnnnnnnnnnnnnnnnnnatnagagttgaattcatggggcgcg

SEQ ID NO: 14177 - DNA, 827 bp, Oryza sativa
  unsure (1)..(827): unsure at all n locations
cagatttggtccatgtaaggttgttcttcaatgtggtcaatgactagtattctcatttttccacttagatatatgatgccacatttcattccgcaacccaaccttatttaggatcaagtggtcaattgacaatctcattcggccattcctcaacccaacaagcccttaagagttttactgggtctgtgtccgagctccaacccactaaggggcatgtgttaccaagtccatgctatcagcgagtttccactttacagtaatctggtacgaaataaagttggaactaaacagcatgacaattggccgaaatttaacaatgggccgaaatttaacaacggggatgttttctgaacaagtcataaatgatgcaacagttcactccgattttcatgataactctaatatatctttaagcacacgataatggagtacagaaattggcattatccatcacaaataggtcaaaattgtcttacctcattatttccagggaactgtaaataaattattgaccatggattttcagttgggcaatcatcactttttggagtcttctattcatgttaatagttaagacttttgtcgtggacatttagccaccacaaacttagttttacttgataacctgtatgatttgctacttaatacatttgaagccaatggtggcccagttatggttgctagatcttttgcaattttaatcagattgtatgcatttggctcacttctgctgaaactagcaannnnnnnnnnnnnnnnnnnnnnnnnnnnnnnnnnnnnnnnnnnnnnnnnnnnnnnnnnnnnnnnnngctcatcctggngacagg

SEQ ID NO: 14178 - DNA, 962 bp, Oryza sativa
  unsure (1)..(962): unsure at all n locations
aggctctagtcttacaaaactggagtgtaattttccccccatgtcgattttttcccataacccatgtgtttcatgttagctttccacaacaatcaaatcagcttattttttccactcgcaccattcgttttccaatgtcaattcatttccctgttttaggtcatgaaagatggccaaattatacaagttgggaattacgctaaaatacttaattctgaagaagagttcccaaaattagtattttcccataaggatgccatttctactctagaaagtttagaacactcaagtggcaatcccaaaagtagtcttattcctggtgacagtggaagtacgcttttcagataagcaaaaggatgataatcaaggagcagaagaagggattgttcaaaatggtcagttggtacaagaagaagagagggagaaagggcgggttgggatttccgtctattgaaaatatattacaatggtatatggtggagcacttgtgccgcttattttgctcgctcagataatttttcaagttcttcaaattggaagcaatttttggatggcttgtgctgctccaatatccaaagatgtgaatcctccggtcaatagcttgaaaatggtacttgtatatgttgtgttagcttttgtgagctcgttattcatcttcataagatcccatcttcttgtcatggctggatgcaagactgcaatgatgctatttgataagatgcatcgatgcatattccgagcttcaatgtatttctttgactccactcctagcggtcgaatcttgaacagagtaagtaatttaccttcaccatctttattttaatgagaaaattgaagttatctccttggaatgccattagaatttttattcatattcaattnnnnnnnnnnnnnnnnnnnnnnnnnnnnnnnnnnnnnnnnnnnnnnnnnnnnnnnnnatgagagttgcattcaaaggacag

SEQ ID NO: 14179 - DNA, 960 bp, Oryza sativa
  unsure (1)..(960): unsure at all n locations
ataagatgggtaaggtaattacttactctgtcaagattcgaccggtagagtgggagtcaaagaaaaacaatgaaagcttgggatatgcatcgatgcatcttatcaaatagcatcatgcaagtcttacatccagccatgacaagaagatgggatcttatgaaaatgaataacgagctcacaaaagctaacgcaacatatacaagtaccattttcaagctattgactggaggattcacatctttggatattgaagcagcccaagccatccaaaaattgcttccaatttgaagaacttgaaaaattatctgagcgagcaaaataagcggcacaagtgctccaccatatgccattgtaatatatttccaatagacagaaatcccaacccgccctttctccctttcttcttcttgtaccaactgaccattttgaacaatcccttctgctccttcattttcatccttttgcttatcttgtctgaaaagcatacttccactgtcaccaggaataagactactttcgggattgccacttgagtgttctaaactttctagagtagaaatgtcatccttatgggaaaatactaattttgtgaactcttctccagaattaagtatttcagcgtaattcccaacttgtattatttgtccatctttcatgacctggaacaacgaaatgaattgacaaggtaaaacgattgttgcgagtagaataaataagtagatttgatagttgttggaagctcaccatgatagcatcggctgatggcaaaaattcgacatggtgggtaacatacactacagtttttgaagctaagagtccaagtaagcactcctgaaaaatacaaggtagtgatgaataactttcatacagtagatatactcttgaaccctaaatattgttcaagaacgggtaccgagctcgngttcaacggatagctcactggatnctctgaaccgcgcg

SEQ ID NO: 14180 - DNA, 969 bp, Oryza sativa
  unsure (1)..(969): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatagccatgggagagagatatcgatcctacaacgagagaatcgaagccgggattttctagagtttggtttggagagataaactcgaaaacgaatccaaattcgcatcgaattcaaagggataaaaccggatttttgggggaagagatagaggaggataagggggatattttgcctcaactaattttggaaatacacgagagaggaggccggagttggagggggaaggcggcggcaatggcggcatcgggctctgtctccggccggctggaggttaggggcgactactgtagcagagggaaggaaaacagactttcagctgggcttcttttactcagcccgattgaaggagggacatgaaatggacttcggagaagggatagaaccagccgaaaggaagagagaatggaccgagaactaaaagtgaacttttctagtttcggcccggaaaggaaaagggtgtttttttattactttcccaattaaattaatcactgaaatgatctctaaatgngtaaaaatacttccggtgctctaataattccaagaaaaattattaaaatacttgaacactataagtatttaaaaaaattataagaagaccatttaatgtataatttaatatgcgaataattgctgaactgctctttgtattattaaaaaatagtaattgagctctgaaaaattcgagaaaattgcagagcgtatttttatttatggagatttaataaaaataaag

SEQ ID NO: 14181 - DNA, 1456 bp, Oryza sativa
  unsure (1)..(1456): unsure at all n locations
gtgtgacnanagggtagaacgccctgctagnnnnnnnnnnnnnnnnnnnnnnnnnnnnnnnnnnnnnnnnnnnnnnnnnnnnnnnnnnnnagacgcgatgcgtgtcgtataaaataaatttacggcagtgacagtccgctcgatagaaaatgatgcactagaatatatacgtgtgcctctttaaaaaaaagagaaaagactcatatccaaagtgtttataaaagtaaataaataaataaattgaggcgcccaattaaatgggagtatatgcagtcaaaatataggacatacagaatagtcatgcatgcaaaaaaaataaaatttgaaatcaagaaagagacacgcatgtatttacaaacaactgaaatttaaagaaaaaaaatcagtcaagtccaaagggcccacacgtcagtgaaagcaaagagacaagtggtcaagcccataacctacccacgatcaccactaatcatgcatgcatgcagcaaataccagcacattcgtcccgtcaaactgaacgggcccacatatcagccaaagggatgtgcatgcagtcaagccattgcccacaaccaccccacgatctctgcgcgcgcgcgggatcctgttcaaaatcacataaagcaaattaaccccctttaatcctcctcgataaatagaggatcagggctagaggcaaaggggagttcgctggggagaggttccaagaaggttggtgtgagggctggctaaggcgaaaggctgctgtgctgaatcgctgctattacctccgtcccatattacttatctttttgagtttttgtttgtcaatgtttgatcattcgtcttattcaaaaaattttggaattattatttattttgtttgtcaatggctttattatcaaaaatactttacatatgacttatctttttttatatttgcactaatttttcaaataaaacgaatggtcaaacgttgcaaataaaaagtcaaaaacgtcacctattatgggacagagggagtagttcgctactgcaaagcaattgccgccgtgctagtttctcgctctgctgtgccggaagaataagaggtgttccaaggtgggaatcatgatcctccttcgttcttaggctcggccattgtgtacgagtcgaggaatctctcaattctccttcctctgctcgtgttaatgtatttttttgctgtctttcggttcggccaatgagtacgaactagggaattatgttcttgacatgttcctaggcttggccatcatgagtacaagccaaaggaatttttcctctttgttgtgtccttcgtctcagccaacgcgtatgagacaaggaagttcgtttcatttgatggcttttaacatgatttcannnnnnnnnnnnnnnnnnnnnnnnnnnnnnnnnnnnnnnnnnnnnnnnnnnnnnnnnnnnnnnnnnnnnnnnnatcaatgcaaatgcaagggcgcgg

SEQ ID NO: 14182 - DNA, 767 bp, Oryza sativa
  unsure (1)..(767): unsure at all n locations
cgtgcgccccnnggatgaacacctnnnnnnnnnnnnnnnnnnnnnnnnnnnnnnnnnnnnnnnnnnnnnnnnnnnnnnnnnnnnnnnnnnnnaagaaaaattgaaggggaaaaaaaagaacgcatctggcatactggatgctcaaaatcggtggaaggctgcacaacgtttgtactgcccaaattagcagcgagcagagccaatgaaaatctgtaaatcccccacagtaataaaggacatggaaatccccaaatcagctgcagcgagaggctctggcgccgtcctcgtcatcttcacactactcctcgagtagtccatctgcacatgaacagcttggtggataggcagatcggacggtcgtccacgggtgatgaacgaacagtgtaacaagtttactaatttgttgacaattagtaaaaatctattcgattttcaacttttttgggttcaaattttctgaaaacttaaaatttcaatctggcgattcttttaagactctgacatcttcatcctttctcaaagttaacaacaggcatgggattgcaacaattattaaaatagctttctttactgttcttcggaaaaaaaaagaaaatgaaaaaaaggtagtctggacgagaagagagcccaccattagttttattttattaagatagcagcgagagatgcattaagcattaatcatgaaagggtgagtagctaccagtacgtgttngtatgaaatactctcaattgggtggcacaagagataaacctgccgcatggag

SEQ ID NO: 14183 - DNA, 919 bp, Oryza sativa
  unsure (1)..(919): unsure at all n locations
cgtgtgcnccaggaatgaggcactncagtcttncacnnnnnnnnnnnnnnnnnnnnnnnnnnnnnnnnnnnnnnnnnnnnnnnnnnnnnnnnncaatcaactgaccaaaaatacgcttgaggactctaccctatccattcaatccctaaattttattactacttcagaaacaggcacatgatttatgcaatttgctacactgattgtttttgaaagatctaacctaacagaaattattaggacaagctatatgcgagatatattgatggaatgatgggtcataaaccggagaacttaattactgaactttggaagccatagtcaacgtgggcccatatttgaagtgactttaaaaaggagacaacagtgcattaccccagttaatttattttggaaaaaatacaaattaccccccgaactatcgcgcctgtccgaattacccccatgaaccacaaaaccggacattcttcacccccaactatgcaaaccggacgaattaccctcctcgaaccaattcagagcggtttcgaacaacgttgggtatatatagtactacgcttaggcttatttatattaaaaaccgtttgacccatcgtgaatacttttagtgccctcattatatttattcacctaaaaattaattgatccaatcatattcaacaagacgtaaaatgttaatgaaactgtttgatatataacacgaagtataccgagaagtttttataacagttcttcaaaaaagagtgaccaaacctcctaaaatcaacctattgaaattagaaaatgccttttcttccattaaaaatttaaaacatgccattgtgagggacttgggacgaacaaaccttacatttgttaaattccctttggaaccagtgtgtggaaatataacttgtcaaaaatgtttaattatattttn

SEQ ID NO: 14184 - DNA, 1016 bp, Oryza sativa
  unsure (1)..(1016): unsure at all n locations
ctgcgcctttggattcnnnnnnnnnnnnnnnnnnnnnnnnnnnnnnnnnnnnnnnnnnnnnnnnnnnnnnnnnnnnnnnnnnnnnnnnnnnttattccataaaaattggcatgcaggtcttttttctagtagtgtagagttgcaatcctctttcataatatactattttgtatgacttcaacataccgctgtagaaataccctcccaaaactatattttctttcttaacatggaaaacatacaacacctaatgcataattttctggtgaactgtttttttcctctaaagtgctttgtatgtgatgtaggtaaggtatgcgacacagttgccttttgttttgaaaggcctaacttgcactttacccagaggattgaggaccggtatcgtcggaagaactggcaatggcaagtcaaccttgattcaagcactattccgcatcgtcgacccatgtattgggcaagtgttgatagatggccttgacatttgcaccattggactacatgatctacggacaagattgagcatcattcctcaagatcctgtgatgtttgaggggaccctacgaaataacattgaccctttggaggagtacagcgatgagcaaatctgggaggtaattcttattttaaatttactagtacctccatccctaaataacatatggaagacaaattactatagaaaatacatgacattcataccccaaattaaatgagggatggattgaagagagagggtagttagctttagaagcatacttattttggggacaaaacttgagtgttagaaatatacttatttagtaatggaggtagtataatttgtaatgcttcgtatgtgcacctatgttttttttaaaaaaaaatatgcataactcatatctgctattcgatgggcaaaagagttcacttgtgtatatatgttatccagnnnnnnnnnnnnnnnnnnnnnnnnnnnnnnnnnnnnnnnnnnnnnnnnnnnnnnnnnnnntacagaagngttctacctnncacgc

SEQ ID NO: 14185 - DNA, 765 bp, Oryza sativa
  unsure (1)..(765): unsure at all n locations
cctgcccattgatttgctcgtacagacttgtcnnnnnnnnnnnnnnnnnnnnnnnnnnnnnnnnnnnnnnnnnnnnnnnnnnnnnnnnnncgcgtacaacctgctggactgtagcaatcctcttattttaaagaaaacaataaaaatattagttaagttcaaattagtgtggatttcacgtatgtaacgcttatagcattatcataatccccgcatgttagtaacggtttctttcttccccttatcatctattttcctccatctcagtggcaacagctaaatctcttcaactaatgttcacttgctctcgtgctaggggtggggggcagcggctgcgtgagtcgcgcaggcagtcgccatgtctgatatagccgtcaagagagaaagctcacgcgatgagctagctgcttcgctagctaaatggagataaacaaaacatttaattcatgcatgcacaaccaaattaattggcatgatcaaaactaaccaccatccctgtagctatttgtgttgcctgtgctctagcgtgttagatagggagaaaaacataaatacatgcacattggatagtggagatatgtcaggcccaacaaatatgtcaggtatcacccgtatcagctacaagcgagcggtaagagcctcctttttcacactatcgcccggcaacagatctagcggcccgtttttctctttcttcttttctccctcaaccacataggatttcgctgatgtgtaacaacgtatagcctgctgactcaaccttat

SEQ ID NO: 14186 - DNA, 1235 bp, Oryza sativa
  unsure (1)..(1235): unsure at all n locations
cgcgcctttgattgcacgtcagttnatnnacgcnnnnnnnnnnnnnnnnnnnnnnnnnnnnnnnnnnnnnnnnnnnnnnnnnnnnnnnctgttcaatatggtgttcactgtttgcacaagcagagagaattgcgttccaggatactgagtctttgttctgaatagtgataaaagatcgaaaagcagcatcaaacctgtcacactggctgtaaaagctgacaagagcattcattaatgatgtttcttgaagaagttcaggatgtcgaaaaatataaccatgaaccctgatgcccactctgagattgcctacttgggcacaagcagtaagtaggctgataagagaaacagaatcaggagccattccggcaaacaaaagcccctgaaacagtttcaatgcccttgagggataccgattcatcacatatcccgcaatgacagtgttccatgtaacgatatctcccatttttgaacttctaaatattgattctacagccctcatttcacaaaccttggaataatgtgccatcagcgcattgctaacagatatatccatttctaaaccatgtcggaccacaaaaccatgaatttctttcccatagtgccttccatactccacaagtgaacagaagggaagaacattagccaatgttgaatagtttggaaggcattcctctgagatcatctgaccaaacagtgcaagtgcttcttcaaacaacccattctcagaatatcccgcaatgattgagttccatgaaaccacatccttgcaacaaattgtagaaaatgctagatgcgcatcatccatagctatgctcccaccacattttgcgtacattgataccaaaggatttacagactgagtgtataactgcaaaccagtcttgatgacatagtcgtggatactcattccaggccttagcaccctcaactttgcgcacaccggaaggacgacagcgaccgtgactgcagttggcatgctctcatctacaccactagcaagcattgcaccgaacaaatggaacacatcgttgtaaagtccagcacgggaggaagcagtgatcaagatgttcctacataccgagttggagcagcttattttaatcaacaccgtgtgggcgttcgcgagagaaccgatccttccggacatgtccatgacccggctttggcacaccgtggccattcgggtcccgaacttgacagtagccccgtgaagggggcccacccccctttccccc

SEQ ID NO: 14187 - DNA, 780 bp, Oryza sativa
  unsure (1)..(780): unsure at all n locations
aacattcctattcataatatttctgagaaaaccagtgtgttattaaattaatttatatcgaagttatcccacaaaaattggcatgcagatttttttctagtactgtagagttgcaatcctctttcataatatactattttgtacgacttccagcataccactgtggaaataccctcacaacactatatcttctttcttaacatggaaaacatacaacacctaatgcagaaatttctggtgaagtgttattttttcctctaagtgctttgtatgtgatgcaggtaaggtatgcaacacaattgccttttgttttgaaaggccttacttgcactttacccggagggttgaagaccggcatcgttggaagaactggcagtggcaagtcaaccttgattcaagcgctattccgtattgtcgagccatctattgggcaagtgttgatagacggccttgatatctgcaccattggactacacgacctacggacaagattgagtatcattccacaagatcctgtgatgtttgaggggaccctacgaaataacattgaccctttggaggagtacagcgatgaacaaatttgggaggtcttttaattttaatttactgacattttaattcttcaatgtgcacctgtcaaactaatgcataacttatatttgttgtgttatccaggcattgaannnnnnnnnnnnnnnnnnnnnnnnnnnnnnnnnnnnnnnnnnnnnnnnnnnnnnnnnnnnnnnnnnnnnnnnnnnnnnnnnnattcaaaannnccac

SEQ ID NO: 14188 - DNA, 774 bp, Oryza sativa
  unsure (1)..(774): unsure at all n locations
cgcccagttacaccagctnnnnnnnnnnnnnnnnnnnnnnnnnnnnnnnnnnnnnnnnnnnnnnnnnnnnnnnnnnnnnntacattggaacccgaggcatgccggttgacaatttctcatgccgttctctgcaggtgcttcattgtacttttggttttcttgtattcacatttttcctgcacaacacaaacttttatttcctttctgttgtttcctgtattgctttgcctgaatatgtacataagtggataagttatggtgtgcagcaacaacaaaaacttactgttctgtttcacaatgtttgtccattaagaaaaccaagaatgtggttattacaatgttttcactcattaaatgctttgaaatgggtaaaatggttgcattttgctatgcatgtttttttctcgttaaatttttcttagattttgtacttccttggtttgagcgcatggggtgctgtggaaaaacattgttagacggagggagtatcttttagatgtttgacatgaatgcgtattttatttttgacaaactgtgcaatggaatgttgacccttctttgcttactctaaagtaataaatattgcagtgaaatgggtgcccatttttccccttggggaccaattcttgtaacatgtggtgcctgtttgctgcctcaaactgaaangccaccgttgtagccaattgcctgtgcaggatgaattcttgaggggcccgaacattaccaactcgtacccttttcctttttaccgagtatttatgaactccagttact

SEQ ID NO: 14189 - DNA, 1949 bp, Oryza sativa
  unsure (1)..(1949): unsure at all n locations
tgttagatgagtataaaactaaaggcggtcacggatgacacctatcagtgacgggcngtagttaggcccgattaagataacattccatatctcaacggggcctaaagttgcggccggtcacagatgaccatcatctgtaacgggcaccaactttagacccgtttaagataacattcaatatctcaaacgggcctcaagttgtggcccgtcacagatgaccatcatccgtgacgtgcaccaacttagggcccgtttgagataacaattaggcccgtcacagatgactcatcagtgacggccaatatacttaatctctatcgggcattaactaaatcccctcaccgatgactatttttccatttttcatatgaaatgtttatatttgtaagttgactatagcaaaataatttagtgcagtataataattcattttataagtcagaataactttacgggtagtaaatgatttcaaatgaaaaaaatgtcaacaacaaagttgtataacttatcaagatttacaacttttagtttggtcatttttcaatataacatttttttttgaatagtttgaatttgaatttaaaaatatgacaacttcaaacaacatttttcaaatactaaatgatttcaattgaaaatgtcatcaacaacaaagttgaataactcatcaagatctaaaacttttatttttgttatttcttcatccgataaaatgttagtaatattattcacaaattttacatatatgtgttatagtttataaaaccagataagagatatgtcaattttgtgaacaatgttattatcactttgtcatatgaagaaatgaccaaaataaaagttgtagatcttgatgagttatttaactttgtttttgatgactttttcagttgatatcatttagtatttgaaaatgttgtttgaagttgtcatattttcaaattcaaattcaaacggttcaaaaaatgttatatagaaaaatgaccaaaataaaagttatatattttgatgagttatacaactttgttattgatgactttttcagttgaagtcgttcgctgatctaaaattctatttgaacttttcaaactttgaatttcaaatttcaaattgtttaaatagagtcaaatggagaaatgatcaaaataaaaattttgcacctcgatgagttctacaactttggttttggtgacttttccatttgaaatcatttaataaccccaatttgacatcctggcctagggcataataggattaatagaatactcataccaacatgttacaactactttttcggaagccaatctttaaagaactttaacattaagtttgaacttctcgcgtgggtgcacacgagtgagggctagccaaaaaataaaatttatttattttttaattatactcatctgtgacgggcattaacttaggctatagttaacgcccgtcacatatgactcatctgtgacgggttaatgcccgtcacagatgactcatctgtgacgggctataggtaatgcccgtcacagatcagggtcatctgtgacaggcgctagttgtggcccgattgagatagttcatctgtgacaggctatagtttgactggtcgtctgggtcaaagctatcggtgacgggctttacttagggcccgattgagatagaatcatccgtgacggccattttcccgattgagataactcttcacatcagtgacttctagcctgtgacggccgccatgcccgattgagatggggcttaccccccaattgagatgagggtatccgttctagtggattcctccttaaaaacggaaaataaaacacaccactcctttcggcatcggtttgagtccgagatcccagggacactcctctcggtttcaatctatatcgngatatctcatatatcttggtgaaaaaaaattgatgtgccggattaaagatctgtgtgca

SEQ ID NO: 14190 - DNA, 896 bp, Oryza sativa
  unsure (1)..(896): unsure at all n locations
ctgcgcccaataggaacccttgctannnnnnnnnnnnnnnnnnnnnnnnnnnnnnnnnnnnnnnnnnnnnnnnnnnnnnnnnnnnncgaagttattccacaaaaattggcatgcagattttttttctagtactgtagagttgcaatcctctttcataatatactattttgtacgacttccagcataccactgtggaaataccctcacaacactatatcttctttcttaacatggaaaacatacaacacctaatgcagaaatttctggtgaagtgttattttttcctctaagtgctttgtatgtgatgcaggtaaggtatgcaacacaattgccttttgttttgaaaggccttacttgcactttacccggagggttgaagaccggcatcgttggaagaactggcagtggcaagtcaaccttgattcaagcgctattccgtattgtcgagccatctattgggcaagtgttgatagacggccttgatatctgcaccattggactacacgacctacggacaagattgagtatcattccacaagatcctgtgatgtttgaggggaccctacgaaataacattgaccctttggaggagtacagcgatgaacaaatttgggaggtcttttaattttaatttactgacattttaattcttcaatgtgcacctgtcaaactaatgcataacttatatttgttgtgttatccaggcattgaactcttgtcatcttggcgatgaagttagaaagaatgagctcaagcttgactctgcaggttttatatctatatcagaaagctataatgcattgctccacagtgtcaaactcataagtcataactgatattttaatatgaaatatagttacaaaaattgccaccacttgagtgcaagtcaacgcccg

SEQ ID NO: 14191 - DNA, 804 bp, Oryza sativa
  unsure (1)..(804): unsure at all n locations
ngaatacagagtgggacaatttgaacatacatatctttttggcacaaaactgcatagggaaaggtatgaaaaggtccttaaagcatcctgtcttaaaaagcacttgaaaatattaccattaggtgatcaggccattatagaagagagaggcattatcttaagtgcgggacaaagccaaaggatacaaattgcacgtgctttgtatcaagatgcagatatctttttgtttaatgatcccttcagtgctgttgatgctcatactgggttgcacttgttcaaggtatttttcaaaacaaatctttaaatcctatttctatatgtgtgtaaatcatcactgaatgcttaaactaataacttattgttggtacttaagacttctaatactacaaaatatatatttacatcatatgatttcaacgccattttctcccagtcaatttagggggtttttttttaaccttcttcagttgtcagtgctagtgccgttatcaaatccttagacgaatagaacatgtttgttttgtttgatttttcatttcccaacttccaaaataagtaatagcagtttatctctttgcatagtttattgtgtggacagaaacctaatgtcttaatcagatcttttgtatgtttcagctaaacagtttttaggtagcctgttcttgaacaatattcagggttcaagagtatatctcctgtatgaaagttnnnnnnnnnnnnnnnnnnnnnnnnnnnnnnnnnnnnnnnnnnnnnnnnnnnnnnnnnnnnnnnnnnnnnnnntcatcaggggtctacttggcacgg

SEQ ID NO: 14192 - DNA, 1283 bp, Oryza sativa
atcaattgttttccactagcactagctttagaacacaggattcagtccccggctacaggggctctgtccactgcatcctcccacagcaacagatccagagaccaggagtaccaagtgaccctgataatcatataatttgcacttaaaaataatgtaacattgatttggcctgtaatgttcaaaatttacatgattgaatattctcctctgtctaattggtttcgattgaactcactcaaatgcgattgaactataatcttcttgtttgtatctttgttgcaggttatactggcaacaaacattgcagaatcatcagtcactattccaggagttgcttatgttattgactcctgtagatcactgcaagtttattgggatccaatcaggaaaacagactcagctgagcttgtatgggtttccaaatctcaggtatatctcacaaatatactgatgtttttcgtttgcaactaaagtttgaccctaaagattgtacgttacaatttttttgtaattatttctaggctgaacagcggaaaggcaggacagggcgaacctgtgatggtcaaatttatcgcttggtaactgggccattttataacagtttaactgatcatgagtatcctgccattttaagattgtccttaagagagcaagtactcatgatttgttgtgcagagtccagagctatgaacgatcctcatggtaattcttttcatgcatatatttcattcgtgtcttttttctgacaagttcagcctttgttacatttgcataaattatgctccatgttttttaatgttttgtgatggagcaccattagcattatttatattcttgagaagctacaattgattttccttcttttatttactaaggttctgtccactcttttttacttgtcatctagaatatcgatagtcttagcacatgtttttatcattagtttaatactttttttttctaattgagtgtttataaaaaatatcgatactatagctaaatgaagtatttttcatgaaaaatctactaatatcatgtacatatttaatatatatttgttttgcatatattagtgatttaagatgaaggtttgcctgcatgcattttagaacagcatctttttgtaaatgcaggatactaagttatgataaaatcatgtcctgtagtataattaagcactgtacagttggttaactatttttcttacaataataattgtttgtatcatgcattcgatactttccagtgaaaatagttctagtgtctatgcagccagttctagg

SEQ ID NO: 14193 - DNA, 597 bp, Oryza sativa
taagcatcatgctggacatccaacccctgcctatcgtccaaccttttggtcaccaacaattggtatgtgtttttgttgcatcatgactaatgcttgcatcatcatgttgtagtagttatatgttgtacgttttgttttacagtgcaaaatgtatagaaacaattactttgaggaggagggtatcgacctgcaaactggcaagaaggaagctgcacttgttggaaatctttgtgcatttcaattctggcagcgtatgtttaaggtatatcatatctgtaataatcatgttccttgtgcatatttacaggccttatgcagttaataattgattcaacatttatgtttcaggcgcatgtcaattgccatgtattaacatcatattccttcttttagtagttaaaacagttctctattagttccttttccagtaaatatctattaattggtgcgggactcttttccagaaaacattattatataagactcagggcaattatttttgtttatctgcttttggaaatgtttattacattagtaaagtgatgtcttcatatgttgcaggacaagtatcgtctggattgtctgataaatgtggtg

SEQ ID NO: 14194 - DNA, 2514 bp, Oryza sativa
agaggaggagcgatgtcttcgcgcaatcgcgcgtggatggagagtagtcttcgcgacagtaaatcgggcggtagtgaaatcgtgtgtgcggatggacggtaggattgatccggatgatttcacacgtaggattggagacgtaggattggagggtgcaactcctcctttttatattagtatagatgattccttatgcgtgtccttcgatttcgaaattttcaccagccataagctgtaaggcatttacatttaatttaattaaacagctaattacttggtttttatatatacctaataaaaaaatacgcaaagctttatgtttattttgtctgttcggttttttatggcgccggtatttttttctatcatttttttacacgcgaaagagtttcttttgtgcgcacgctctaaagctttttattggaatttaattttattttaatgataatttttagtcattatgtgtgggttttgggggttttctgattttagatcccatccgggttgttgtaccccgcgccttccacgggccgaaccctagtgccgcaccgccgtcatgttaatcgtgcatttcctcctccaattgattataaaaatcgattccccattcgtccctcatcattttctaaatgatttcccctttcgattcagttttaattcactggatttaatcttcattttaacagtcgcgatgatgatcgatgggcgatcttcctcgatcgcttttatctcaagttttacactctgattttgggaagaacggaaagaggatatcgaagggatcaaaagccctcaaccaatttttggagatcgagaaatgttcgaccggatttgatggggaagatctgctttggcatcatacgggcatgggaccatgttcgagaggttgaagacggttgtcggctgtgcaagttggacctgcaactccacttgtgagatgggcggaagggaggcaggccgagcaaagggaggtaaaggtttggcttagggctgaaaaggaaacattgaatgggttttcggtccaaaaccaaggatgaattcttattaacttttttaattgtaatgtatagcaatcccagttttaggatttttattaaatgtttcaattctaatgtatattgatcccaatatttcaatttattgctcggcttctaatagttgttgtatcgctgaaaaaatgactttcccgttacaacgcatgggcatttttctagtttgagccaatcataaccgtcatttctttcaaatggacttgatattgccacgtcactcatcttcctcgtatcactagttgaccgctcgagcaagagcatcccaatgtccgatgcaacctgatacactttgtggtatcatcattctcgatctcatcgtgtagatcattggcaaagcacatctcatagatgcgacacatggccatagcccccgtaccagtgggttggtctaatgggcaagcccagcagcccagcccaactctctctctctctctctatctctctctctctgtctcgcaccttcctttttctctcgaccgcgagcgacaacggcggctgcaatgacaacaaccctccggcgaggtcactccacatccttcggcaagccccctcctccggtgagctccctccaatgaaaaagaaggcacacagtggagcggtgctcctctggtgatgacgatggcgaaggcctctctctaccgagctccctcttcctccctccggcgagcttcctctaatgagattgtcaagcaacaaggtcagctccttttccaccgccacccctgtaacatcctgaaaattcaaagacaataaaaatcactaaaattttgaactttttaaaacttttgcatcatgctggttgttatgattgctattgcttgccaaaccgtaaatgatcacaaagaaagtaaagtaaggatctaaaatttaagtaatagataaatttacgagaatataatattgttaaccctacaaataattacgcacaagaaaacaaagccagacaaatggaaagttaattactaatttaaattatggattaaatactaaatacgtgaaccatgtgttgcgtgtcatgacgtctaaatacacatgaaatgatgaccatttataatggaactctatctatgacatagtttcactaggagtaattaatgggatattactaaactctaatggtctatataaagctaaaccaattcacatgaaataatggtcgtataattaaattaagctttataaaattttgtgaggttttaattaaataattagattaatattgtgccgagtctcaatttactatttatagaataaatagattgaacctatccgtgtaaaatatattgctatacaactaaacttaaccaatctgctaatgtattaatcatgacaagtcgttatattaaatttaatagtaccccaaagtcttcaaaaatatataagttcaccttagggccaataactcaaattaatctaaaaagaattcatttgtgcgataaataaataaatatgggtaatatta

SEQ ID NO: 14195 - DNA, 5424 bp, Oryza sativa
ctcgcgcctcgagccgccgcgcgcagtcacgtcgccgctgtcgcgcgcgccactgccgcgccccatagcgctagtcgtgccgcgcgcggtcgccgtctccggtcgcatcgcctcgaaccccacccctccgcgcgtcacgccccatagccatcacgtcgcccatcgccgccgtgccgccatcaccgcgcgccaagccccgcgccgcgccgcgccgtcccatcgccgcgtcgccgtcccgtcgacgctccgccgtcgctgtcgcgtcgcccgtcgccatcaccgcccgccgagccccgagccgtctcgagccgcgcgcccgtcgccgtcacgcctcgcgccgcgtgcccgccgcctcgcgccccacgcgccgcgcgccgtcgcatcgccatggagccggccgcccctcccccgcggcctataaatcccctccggtcgcccttccatcccacatcacccccctccttcccctcctttctttccccctttctctccaccgcgccgccgcctacgtgccgccgcgccgtcgcctcgaagccgccgcgccgcgccgagtgccgcgccgtgcgtcgccgccttgcgccgccgtcgccgccgccgccgtcagtaagccgccgcctcctccccttgctcggtcgccgtcgccagagagccgagggagagaggagggagaagaagccgggagggagagaaagagagaaaagaagaaagagagaggaaggagaggagagattagtgggccccacgtaattggtgaatagtaaccctcttcttaatctttattagtagtgtctattacatgtgggtccgggtggttaaaaatctaattatagaagttttatggtctcgagtctatgacatgtgggccccacttgtcattagctcttcctatttccctttagaaaataattcggtaggaaaaagaaataaacccggggtcccacttgtcagttggtacaaggctgtggatatgtcttggattaaaaataaatcgtttatgaacagtagcttttcgcaatttctcggattaattcaaatttgaatctttacactagcataacttattcattttaactcggatttaagtgaaacttgaacctaaattcatctaaattcataagctttccaatgatatataattcactatttaacaaaatatatttataattataaattaattaatatcaaatgattagataatagttaacctaaatagtgtgccaatgaataaaaatggatattgtacagtagcataattatctttaacatgtcttgtcactgtagcaactaaataaattagttataatcaatccttcaaattaatgggtgtataggaaaatattagtgccatttactagtctatgtccaaatataactaaatccatgacttataaattgtttacataaagtttagcctcatattttgtaactaaaatataaacacacatagatgaatctttaacttgtttaggagagtaatcacagagctagttgtatttggaccacttaaaagtttgtcgatacaatgtcatgtgaagtagaatatatgtatatagtcggttgatatccattagttaaccaaacagagccatcttaaaatcaacatgtattgtatagcttacagtaaaaagcaactactcaaatatatgatccaataataagatattgttgcttacacatatactatacatcccattatagtggtacggtatagtattaatttgcgtgttgcatatattaaattaagagggagtgtatgacaaacatgtatattagataaatactagttataaatcttgacctcatataattataattatagttcaactgtaaattaggattattcattgtaaaattatgtgataggataatctgtaaccataatatgattaacctaaacaactctaacatacaaagcatggataattattaaccttttataatttattgtgacaagtaaaatatgttcataattaaagtaaagcttccataaataaaataaataatacaaatgattcactgtaattatttgattgatcctaaatccatctaacaacagaacctctagtaaataaccgtcctatgtagatagatgcatgcttagccataatccttccatagccatttgatagactaaaccaccgattagccaaatatatatgtatcctataaatgctatgttggttaactcctaaataggccacgttgacaatagaaagattaagaaaccttagcccctagcgtgattggaatccattagtagacatgaatagtatattttgttgtgcatatttggttgttatttgaatattggtttttcttgcgtattatagaccttgtgcatcggttagtcgtgaggcaacgtctgcaacttccaggaggtgaaggttgatcaagattatatcaataataaggattatcctgagcaaggcaagtcatcactattctttgaacatgttgatcccaattgcgaaattgttttgtttacaaataaaattgcatgcaatgataaacatcctacttgtgattatgccatgccttgattattgtttaccccttattccttcgtaaccatgcttacgtatgagtccctagtcaactatgacaattgcttagaaatgctattctagaatcatgcatactcatatttatcaaaatgctttatgcttgggcaattacctttgggaaggtaattgagatgcggcatgtggagacatgagcgccacattgccatgatattgatgacatgatttgtgaaaggagaaataaaactaaaacaactattttcgactggggctatagttggccatatggcccgaggcccgatggcccggcccacggcacgggaatttggcccggcccaagcacggcacggcccggtagcagtcgggcccgtgccggcccggcacgactattgggccgtgcctgggcctatggctgggcacggtgggccggcccggcacggcacggaccgaggtcggcacgatgggccggcccggcacggcacggcccaacggtcggcacgaccacggcccgtaccaacggtaggcacgagcacggcccagcccaacagacagccaggccgcaccgcgtgcgcccgcatatataaggcagcgaacgccgcgtcgccgcccctcccctccccagtcccctctcgcctctcgctctccgcctctccgcctaaccctaaccctagccgccaccgctcaaccgcctccgccgatccgcctccgacgctccaccgcccaccagatctcctcctccaccgtccgtcgctcactcgctcagggcctcaggcgcgcaccggtgagactcaccgagtcgcctcccttccactcttccagatccagccttcctcttcgtctccgatcgatgcctcgcctgactcgcatgaggggcgcatgaggatgggggccaccggccacgcatggtcgcctgagtcatcgtccttccactcttctagatccagccttcctcttcgtctctttcccttttgttcttcttcgccagatcccttggtcttctcgtagatccgtgagcctatcgtcttcaacggcaactccggtgctccggctgcgcaggtacaagcatggaaccattgtttttctttttttttctccatttccgaccctaaccttgagtgttgttggctgcttgcaggtcgcaagcccgttgcttagcggcagccgctgttgagggaccagagtgcctgcgatggacgacgatcctacctctgtcaactacgagttgaggactatggggatgcgcggtgatgacgatgatgatgtggaggaggatcgtgtggaggtgttcggcaatacctccgacatcccgatccatgtgaatgtcgatgacgacgacccgccggtcgacgacagtggcaatgggacgccgactggctctagtgcgacttgtaccaacaagaagaccaaaacctccaaggtatgggatgactttgaggaactttatgaaacgaccaatggtaatagggttcgagtctctgctaaatgcaattactgtcataaaactttgagtgctcgttcttctgctggcactggacatttgcttaggcatattaagtcatgcaaacctagaaagcttgggtctaatgctttgcctcagtccatgcttagatttagtgcagatggttctgttattccatgggaatatagtcctgaagatgctaggtttgaattgtgtagattgattgctagagaggatcttccaatcagttttggtcaatctcctgcttttgtgaactatattaaggctgctcataaccctagatttgttcctgtctctagacaaactactaccagagatttttataagttgtttaaggatcgtcgttctgttattattgatcgtctcaattctgctagctctattgctttgacatctgatatatggtctggtcatgctaaggaagattatttgagtgttgtagctcactttgttaattctgattggcaattagaaaagagggtcttgggtcttaggcttattgatgagtcacatactggtgctaatattgctgagcgtgtgattgctgttgctgaagaatatggtattactgataaggttttctctattacattagacaatgcttctgctaattctaaagctatgatcacccttactcctgctctgtttggttatattggtgatttatttttgcatcaacgctgtgcatgtcatatcatcaatttgattgttaaggctggacttgacaagttcaagcccatgctaaatgacattagagctgccatttcattcttgaatgcatctaatcagcgcattgctacatataaaaatgtttgcattgctgcgggttatcgtcctcgtatgtttggtttggacatggatgttagatggaattcaacttatctaatgcttaagcatctcataccacatagggaaccattcacagtatttattagtacacaacatccttttgttaatgaccatccattactcacagacttacattgggcatgtgctgaatctgttttgtgtttccttgaacaattttatgattcaactgttgttttgtctggtgtttattatccaacatctccattaatcatgcatcacattttagagattgctggacatctaaacacatatggcaatgttcaaaacattgcaaatgttgttggtcccatgaaaactaagtttatgaactattggtctaaaattccaattctttattcatttgcatttatcttggaccctagggccaagattagggggtttagtaaagtgcttcagattatggctcaactcattggtgatgattattctgcttatttaacaactgttagagcttcattgtttgatacttttgctaagtatgaaagaaagtttggttctgttagattgcatagttccactattccaggcccttccactggtaagaaaaggact

SEQ ID NO: 14196 - DNA, 593 bp, Oryza sativa
tacagtagttcatcactgcctcaccctacttttttgtcatgtccataaaccacataggcacaggcccaaccaaaacaggttgttagctagtcaagtttgtaagatcaagagtggcctccaagaggttcagtcaaaattagaaatagccagtttatccagggatgtgaatgcaattctcacctgaattaaattagacccctaatttaattctcaattaaccaggtactgtcctaataattttctcccaacatccccatcgatcctgactttgtctgatccccactgttttttcttttccttttggccactctttgatttcttttttcaattctattgcgggtggagactttttggtttggccgcaatccaccaccccattcctatccatcctccttcagcttcttctttcttctcctcctcctccttgactgtcctaacaaaaaaatcgattttttgttctcctcttgatggttgctgcgaccttcgatgtccctatgcggaatgaaatctcctgctggggcggctaaaaatcggagattttctgtctttttgatccgtctttagtggagctttttgagcctgatttatgcgat

SEQ ID NO: 14197 - DNA, 2011 bp, Oryza sativa
ggcagcagattgacagtgggtgctttttatttggcgggtactccatctaaggccatgtgtagtttctaaaacaaaaatcttcatcgtgtcacattaaatatttggacacatatataaagcatcaaatatataaaaaaccaattctacagtgcatcaagaaattgcaagacgaatcttctaagtctaatcgctccataatttgataatgtagcgctacagtaaacatttgctaatgagggagtaattaggcttaataaattcgtctcgcgggtcagaaaacggacgaaagagaagactaataaaaatcatcttaaatttttataatagataaagattttatacgagttaagtagaaggtacggtgcaataaaatataagtcaatgcacctagatttacacatttttcatccaaaaaaaattgtccaaattcatatggcaaaatttgctagggacatcgtaagaatgtgtatttgctctacggcatcacaaaaatctggtaattagctgctggacatcggcaggattattttattatttttggagaaataggagagagaaacaatcattaaagaccagtttgcccttggctcaaattaatccaatgtgggccccactgtgagcatgtcctcctcatgtcgctgtcataggtgaaccctacgtcggcgccgtcgagcgtgcaccttgctggcctccatgagaagtaggcgccaaaacggccgcaaccgcgcaccctgggcggcacgacagctgcggtggcgtcgatggcgcactcctcgatggcgtcaccggcgttgaacatgtcgatgagcccgacgggcgcgaacggaccacgaagagggaggtgacgctggcgatgcggaagcggcacatcttcccgggcaccacggtgaacaccgacggcgcgcagtccgggtgcgccatgttgcgcgacgccgccaccgtcgctggcaaggacgagcagttcatgaaccggcttgcgcccgttaatgagcagcgactgcggctcgccaacccagaccatgggcacggaggcgagccccgccgcctgctcatacgtgctccggtgccaccagtcgttgagcagcacggtgtgctgggcagcctcaacggcgatcatgcctttgagacccgccgagcgctacatccgtagtgggcgtggtacatgtacgtcccgggacggtcgacgatgaaggtgtaggtgaaggtgtcgccagggaggatggggcactgggtgacgccctgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcgaaaaaaatgaaagacaacaggagctaagccttgactagaactgcagcgggaacaccactccacaggcatcctcgacggcacggacgaagcctactcctcagagaaacctccatctgacacacactcgtactctggggttgggaaaaaaagagcaagactgagtactacccactgtacttagcaagttataccggaataggggtatgatgcagggaattatcaaaggagagctagagtggttcatttgcataaagcgagcatttataaacagaagttggaagatttaaaccgttgtaataattaatcaatattaatcatccactgtccaacgctatgccacgttgcgacaggcccaaccatccacctatactatccaaattctaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccac

SEQ ID NO: 14198 - DNA, 9207 bp, Oryza sativa
ccaccatgtgatttattttaattaaccaacaccaaagcggtggcactaatccaacaataccattagaaccaacagtctaaacattaatagaattttccccattgtgcactagttgaactaagcatggctaagcaatccctagtccaatctctagtcatgttataaccccaagctgacaaagggacatggtacaacaatagcatggctatgacaataggtaaacaccccatagtaacattataaaacaatgcaatatttgaagaaaaacaatagagcatttgcaatataggatcaacatgttcaagtgacaagcatgacttgccttgctctgctgctggaggaacctcggcgactatttcgaagtacaccggagcgtcggaggaaccggaatctagcgacatacaaggcaaacattgcaaacaggctataagactactgaaacagggaacaaaaccatttttaatagattctacacatttttcttgatttactgagacttgaatgggcttaaacggagctcggatgaattagttatgaattttagaagattcactgtgtttattactataacaaaaagtccttaaatcatttattgcgcaataaatcccagagctgacgtaatcaagggggggcgcggcgccggcaagcgggccccaccggtcagcggctcgggagagagggaaaaggggcgccggcaagcgggccccactcggcagcggcgcacgagtggtcggtctaccgtggaccgggaccacgcgggtggtccaccgccggtccacgggatcgacggcccggatcagcccggggccgatcggacggtgcggcggcggcctggctcggctcggcttggcacaaagccggccggccggccatggcaagggtggcggcacgcgcacatccaccggcgacaggaagcggcggcgcgggcggcggtagcggacggcgccccggcggtgacggcgaccgaaggcgacgacgagcgtgggtggcggcggcacacggggaatcggggaaggagaggaaaggggagggagtcctcaccggaggggacgacgacgaccggcgacgaggagcggcggagggaggtcgacaagcggcggacggggaccgggacgacctaaagaacgaaaaggaaaagattagagagggagagaggggccatagaaggcgggaacgccggccgaaggcggcggccatggcgactctcaccgtcgcacaatgggaatggcgctccggcgacgaacctcgacgaaggaggggtggacggggtggatcttggccacgcgaacccgacagcggcaacggcgcggtgcggcggcgagcctagcggcggctagcggcggccggagtgatgggaaaggcggcggcgggtggatgcacggtgcgggagtgatggagagctcgggagagttcggcgaaatggggaaaaagagagagaggatgacggcggagcttaaatagggagagagggggccggacgtggccgggagaggcgggaatcgccggccaacgtggggggagtgggagaggagagagaggcgggattcgaaaatcgaatcccggccgtctcggaagcgcgggcgagcggtagagaggggaaagtgggcgcgggaggcgtgggtgcgagggcaacgtggacggcgtggcctgggaggcacggacgcgaggcgcggcggcggttgcgggcgcggcggcgagcggctggaggttgggggaggacccgacaggtgggccccacctgtcggtgaccccgggagaggagggggcgcgggctgagctagggcgtggcctccggccggcccagcaaggcgcggggagagaggaggggaaatgggccggcggcccactaagggaaaaggagaaagaaaaggaaaaagaaagaaaggaatttccagggatttaaatattgcctgtgctcaattttaattgattaaaattatttctagggctctgaaaattccactaaaaatcctgttagtgaatttcgacatgtagaactcaagaaaaattccacatgtcagattcgattattatttgtattactttcttagggttttctcttgatttgcaccggcattttcttagggtcatttataaattaaattttaggcttgggaggagaacttcagggtgtgacacgctctccgtgccgtccgcccatggcgtgccgatctgccggatgtcttgccagtggatggcgacgttctccgtcggcaacgagttcttgacgttgacgacgatggtgtccccctggacggcgtggatggtggggcccaacgtgtggccgttgatggtgacggccagcttgcggacgtagtccaggacgtgaactggtagctgatgtcccagtcgtcgccgcggccgacgcgacactacacagcgctgcgatggcgaggaagaggctgcaaaggaggcggcggctacaccgcatcatgtcccctcttgctcgcagtcgcagctccattgtttgctttgcttttggttgctagctgctctgcctgtgcgtcgttttgagcagggccgaccctagggggggtcaggctgtgcggccgctcgagtccctcaaaatctaggggcctttatacgtacacatatagtatatatattatgtattgtataattttagttcttgggacatgggcctatattaagttagacagctaaatagcccaacacagaaaatgaattttagtccatcgccaagtttgtttcagcgaagccgaagcgatcttcatcttactcccgtcgcttcgcctcgatcacatcatgcatgctactcacgtcgctcgctgctcctgcgctctcggcgacttcttagcgtctcgcaaacgaaaacggcaagtcggcaaatcgcggctcaccagtagccatgctcgtttgtgtcgatcgtccaccgatcgccttctttgctcgctactgctcattgctcgctgcccctgccacctgctgcctggactacactcctccaattcatcagatttcaaggtcctacactcctccaagtccaattcatcttatctgatgaatttctctatctttttttctcttaataagactatataaataaataaatatatatatatatatatatatatatatatatatatatatatatatatatatatatatatatatattagtttatgtatatataggggactccatataagtttttgccctaggcccccaaaaccccaggaccagctttggttttgagctacacaggtggatttggagccccgcgacaacgggcgaagcggcggcgacgacgggcaaggttgaaggcggcggtgccgccgctgctctcggcggagatggagcggatgaggcgcctgacctcgtcctcccggaaggagcggaaggagagaacgtagtggtggttgggtgtagagagagaaaaagagaaagaatgagagagggagaaaaagataatgaagaaaaaaaaggaaaagaaaaaaatcaaagggtagaaacataattacacagttatttctctcttcaattcttcccgatataataaaataatcacacgggtatccattagctaattactatttttttggtgcctacagcaaaaacgcgttcttgcggtgtcttctaactaattacacgtttttttagatgtcctgtagcaaattttgccaatttatatagattctcccctttctttgttggaataagttcacttaggtccctctatttgtcgtccagtctgattttcgtccctgaaccgcaaaaccgggtacgacatgtcacgcccagaaatttagcccaaaatttccagactattttgtgtattaaatccctgtccaggaccagccagggtacacaaaacgacaagtaataaacagtcccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaagggaacacaaggacggtttgtggctatttgcataaaggcggttgtaaaacattttatttagcaaacagtaaaactgttgagtaatttaagtaacattaaaatctccactgatcaacgctacaccacgttgaacaggcccaaccaacccacctgtactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgatttatcacccaaggttgacaaaggacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacgggaactacacgctggcacgcaaaacgaggaaaaactctaataaaaaccaaggaaacagtacataaaaagtaaacaaacatgtagaactcaattttagatggattttgcaagttgaatggctcaatttggagttcgaatgaattagatatgagttttagaaggttttgagccattttaatgaatttctataattattatcgaattattgcgcaattaataattattttctcaaaggaaaaggactgccgctgacgtcagcaaagggccggcgccgacaggcgggccccacacgtcagcgagtcaaagggggagggcgctggtacacgggcccactcggcagcggctcaagggggggcacggctggcaagcgggccccacggctccggctccacgagccgatgtaccggccaggcccggcatcaagccggccgggcggccatggcaaggcggcggcgcgggcatgcgaccgccagcgacggcgagcgcgcgaagagggcggcggcgcacggggaaaaaaaaaagaagggaaggaaggggagggagacctcaccggaggggcggcaatggccggcggagaaaaacgagggaggcggcgaagaccggcgatgccgaggtgcggacgagcgacggcgacacctagggaaagagaggagaggaattagggcggaggaaaacccccacggcgaccatccacgccggccggagtcggaggggagagagaactcaccgacgacgcgagggaaatggggtttcggtggtattccggcgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcggaaaacgagagaggagggcatggggagcattttataggcggagggggaggcggacgtggccgggaggcgctccgatttcgccggcgacgtgggggaggagagagagaaggtgggggggagattcaaaatcgaatcccgcccctctcgtgcgctggcgcggccgggagacgcggggagagggcggcgacgtggcgtgggcgcggcgaaagcggaggaagtgggtgcggcggcggtttcggcgcggcggcgcaccgggatcggcgggaggtgggggaaggacccgacaggtggggcctcgggggaaaggagagaggaggagacggttggggggagacgatgacaggtggggcctcgggtccacctgtcggcgaggggaggagggaggaggctgggggttatgtggacttggaggagggggagccgagctgggccggcccacgcggagaaaggagggaaggagggaagggagaatgggccgagcccaaagacaaagaggggattttaatttcttttctttttattttaattgattcgatgaactttgtgccattaaaattacttcttgagctccgaaaattcacggaaaattccggagagtacattagggcacaaagaatattacaaaatattcccggccaatgatttttaagggaaaaattttaattctcccattaattcacttgattaaattgctttaacttttatttaatttctaggaaatgcattattaattgatttttaatcccgaacgaaaatcggggcgttacaaatctaccccccttacaggaatctcgtcccgagattctgggatggctagaaagaaagccggtgctgatgggcggtctgactgatctgcaccttgaactgccacattctgcttcgaactgattgattgactggttgatcaaacctgtacgattgaactggctggattcgacctttctgttcctttgctttgccaaaactggaccgactggttttgcttgaactgacccagtctaggactgcggatgctcctgaaacttacttagcttgggctgaactgttgaggttagcaattttggtaacctgagaattcaccacgctagctataagaggatgaaaatggaatctggcatttataaatcatttaccctatgtccgcttcgactggtcccaattcaaataacaagtaattccagaaaaacctgcttgacctgtctttcgtctgaactgcaaccatcctcgatgctacttctctaagctgaactgttgacctggcctcaagggtgtacattagaattgaacctgttgacttgagattgggagactctgctagtggctcgcaacggactcctttaattactaaccaaattgctgcactgggttgaacattcaagtgaaatgccgacgaggtaaaccaaaactcatctctgagacctaccccccttacagtgggtagtcttactttcgcctgactgagaacctttgaactgttgtcctcgaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaagtgactctcatttagctcatgaacacactgactcttgactgcaacacactactgctggagttctttccgctactcttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatatgttgtgagtagacttttattcttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactcttcttgatcttcacggaacgacgactctgaaccgaccttctcgctctttgctgcacgaagcttgatgcttgacttgacttccgaacagacacgaagctgacagtttatcctccacggtttaacaactataagaattggagggacagggaggagaattttgaaaaactgtttcgcaaagaaaagccgaagggcgaggggagacatttttcaaatagggttttcagaaagcttgtccttagggtttgaccatttggctcaacctacagtcgagttggctctgataccactttgtcacgcccagaaatttagcccaaaatttccagactattttgtgtattaaatccctgtccaggaccagccagggtacacaaaacgacaagtaataaacagtcccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaagggaacacaaggacggtttgtggctatttgcataaaggcggttgtaaaacattttatttagcaaacagtaaaactggtgagtaatttaagtaacattaaaatcttcactgatcaacgctacaccacgttgaacaggcccaaccaacccacctgtactacagtgcattgggtcgatttattaggtgtgagactaatcacgggaatctgggcgatcgcccataaccgcgggcacggctattcgaatagttttactctggccagaggtgcacaactg

SEQ ID NO: 14199 - DNA, 4049 bp, Oryza sativa
caaagaggggattttaatttcttttctttttattttaattgattcgatgaactttgtgccattaaaattacttcttgagctccgaaaattcacggaaaattccggagagtacattagggcacaaagaatattacaaaatattcccggccaatgatttttaagggaaaaattttaattctcccattaattcacttgattaaattgctttaacttttatttaatttctaggaaatgcattattaattgatttttaatcccgaacgaaaatcggggcgttacacgacacgtccctcaacttacaaaaaccgggcaaacgaggtccctcagcggttttgatagcggttttggctgacatggcgcatacgtggctaatttgattcggtcttatctgacatgtcgttgacgtggcgcttacgtgtcaattagatccgaaaaaataataaaacctacgggacccacatgtcagttgcacatacaaaataataaaaagggagtacctatacatctttcgaaagatttttataatcatatcacacagatttttaatctttgtattaaaatccgatagatataataaaaagcaaaaagcaattaagaaacaccataatgaacattaaattaccatatcctctagaaaaagaccaaatccaatacaaaatttaaaatttacatgtgaagattcaaaaattacagtgtaacttacaaaagttacagtgtaagtttcataaattacactgtaacttacaagaaaatgcactgtaaatttaagtgagaaaatcgagtgagagataagaaaaaatctttcgagtgagatatagcaaaagggagtaactatacatctttcgaaagatttttataatcgtatcacacagatttttaatctttagattaaaatccgatagatataataaaaagcaaaaagcaattaagaaacaccataatggacactaaattaccatatcctcaataaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtaagaaaatcgagtgagagataagaaaaaatctttcgagtgagatatagcaaaatcgatagcaaaatcgtaataaaaaatggtgtgacccacgtgggcccacacgtcatcctcactactctctatcccctctctctctctctccctcttctctttctccagccggcggagcgtggtgggcggcggccggagcggcggcagagcagagggatggaggaagagaggggcgaagcggggcgggcggcggccggaacggcggcggaacgtgggcggagcggcggccgtaccggtgcaccacgcgcatcaccccctcatagttccacatcagccctgacagtgatgccgcgccgaggtgtagcggcaggtgcctgcacaccaccgcagtttcccgccacagcaccgaccccgcagcacgccgtcgagccaccgcagctgcgcctcacagacggcaccgttgaacatcacgaaccgcctggccacgccggcaaggccgctcgggttgttcttgtccgtgttcgggttcctcttgtccaagaatctccccgctgccgcggccatcgggtggtcgcgcgaccatcccacggcgttgaagtcgtacgcgtcgaggaagcggtcaaactcggcgacgacggcctggacggccagcagcgacctgtccttggggcagaagccgtcgacgatgtcaccgaagttgacacaaaagcggacggcgccaccgccgccgtcattggatgcttgtggttgtgggcattccaggagcggacggctctctggaggacggtgaggctgtggcggtagtagcgggggacgccgaggaaggagcggccgtcggggatgtcagtgtgctgggcgtcggcgttcggcggctgaaccagcatcggtcgtcgttgccgaatgattgccaatcggccgacgaccaccacaagtttgtcttcctctccggcgagcggtgaccactggccagtgaccaagagaggggaggaggaagaggagtatccgccgcgtccaccgctcgtgtcgaggtggacgatgtcgccgaagcgtctccaagtcggcgcgctctgccccttttccccgccggccactgctcatcgtcccgccgccaggttggccgccgccgcatggatcccgccgctgggtcgccgcattgggagaaggaggagacggcaagagacagcgagattggggaggagacgtgggtcccactataaatagtttatttttagtcgaacagtcacttacacgtgggtcctagtttttttttttttgccacgtcaaacgaaaccagggactatactgccgagggaccttatttgcacgggttttataagttggggatgcgttgtatctggttttgtgctgcagggacgaaaatcggactaagagacaaataaagggacctaaagtgaacttatgccttctttgttacagtttgtcagcgctgctgctgagacggcccaggcccacggcccacattcctcctctctctttctctctcgcttctccaacgccacacagcgagaaaaaaacgcaacaacgctggcgaccttcctgacgacgccgacgagctcgacctccccgacggtgaggcgatccaggtcagctccgcgcctcctcctcctcctcctcctccacatcccctcgccccgcccctccgccgccgccgccgccggtcctctgcctcccaggccatccctctaagaccatggaatccatcccccacttcctctcccccggaaaccctaaacccaaacccccattgccgcgttcagacattcgcggattaaggttttcgggcctagtgggacgtggtgtttggagctgccactcactttctcagatagtgtttggagcttggttctgattaacattgatgcatacaggcgttttcaggatgggcagtgaggacacaaaagatatgctgaagaatgtggactggaaaacagttggtggttcggtgagcaccgacccaagccaaccagttgttaaaaagcgtctcccgaagaaaatcagacaagttcctgaatgctattttctgcctcggcgatctttgccttctgcattggcaatctatggcgctgcgtgtgctgctggagttggcgcagggatgctgcttgaggtttggataaacaaaaagatcaaaggtgcattcttgttttatttggtagcaggaggggccattcaacttaggaaaagtctatacgtactaactttttcttactaaatttttactaacactgacatgtcatgctatgagtccatctagattttttataacttccatctgcttaaatcaaacggttgatatgattgttagtacaaatttagtaagaaaaaattagtacgtgtagcagtgctcttcaacttacgttcttgcaaagtaactgttttcttgaaaacttatgatgttgtattatacaattgaaagcattactcttcttttgtcttggataatgttgggttgaacaattgaaagcatgtaacacctttttgtttgttgcctgtatatttttgtacatatacttactcttcttacttgctgatgcagaggacagtgccattgtctgggaaatgggcaaatgatttgattgctacctctgaagagttctccttgctcgtgttcagctgctaaagctgcatctcagaaataatcttagctatattggttctgattatcttttgattcccagacaaagtaaaactatcctttctaatgtatgacactgccttacatctacatttctggtttcattttgaatgctagcataacagtatggtgtaacaggaaatatcagaaataacggtgttacggaatgagccatttctgtttggcattatcagttgtacgaattaattgattgtgtggacagtggtagttacatgctctgatggaaatatcaaaaatcatttggcctacaaagttatgaagtgtgctctctgctcaaac

SEQ ID NO: 14200 - DNA, 1116 bp, Oryza sativa
cacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggaccgatagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 14201 - DNA, 5683 bp, Oryza sativa
aaaatcaacgtcaaagtttaaaagtttgacaattattaccgtcaaatgtcaaatgctttgtatctgattgagtagttaattatttcacaccagtggcggagtcaccgaccggctagcccaggagccgcctaggctcgtctgcaaaaactccattaaattttaatattgataagtaaattgatgataaaatttctatagtaaatactacttctattaaaggttggccagactcaaaaatctttctagcattcgcaactgtttcacacttcctttctcctttgaaacagatattgtttttgtgcaaaacaactaatatagttcaagccagttccttctactaatatgttaacgagcaattcttttacacgttcgaaaaaatatgtagtttaagccagcgctgtagctccacattgaaaatgattaaattcacgcaccaagtatatatgtacgtgtgttacataaatgaatatatgatgttgagttttaattgccagcgggcggccggcgtgctgctctgcttccatgcaacattgactatacttgattgattaattattggtagctctctttagctgctcttttcttattctctgctttcatttttattgcccttaagactactacaatgccttgagtacgataatctagacttgttgagccgtgttagtaggagtagtagtgtcaattgacccatcaattcgtagctcacgctttgctgtgcattgcgtgacagttactaagcaaaacctatcgatgaagataagctagctaatgttgttctcgataactgcgtggtgcgtgccattaaaagttcagtaggacgttaagtacctgtgccagccaagccctagggtttagcggctaagcttggatcatattcgatctgttctaaaatataaccatttctaaaattaaatatggatattaagataatgtgtgagaataatcaagagaagtttgtgattggtaaaaaaaagattaagtaggtgaaaaaaattaaatagagattgaaaagataggtgtagaaatagttttattctggaacatggattaaatgcatggtagaaataattttattttgggatgagagaacatgaccaaggttatcaattatgttctggtatcagctggaatggctggtacgtaccattcgaccccttaaaaacgttacgtaactagcggcggtactgttcattccggtcaaatgccaacaaatattgaatggaatagtacgaactgacatatcacttgttccggtacaatttacctacgagtgaacgttcagtcgaatttaacataattggttattaaactatatttagctacaaattatttatcaaaatggaggtctatagtgcgagacagtagaaaggatgagtgagagataaagacagagaatgttagggaagggggattattgggcccgtgggatttagataaggagaattggccggacgattcactatttattcactaactagtttagacataaattcgacgtgaatcgataaagatggactatcgaggatgattttttaaagtgatggtaattgttgtatgcaataatctgcacgtcgtttcttgtaaaaaggcgaccacaaatccaggatgcaagcaaccggtgaaatacagagcaagcttatgcattagaaagaaggagatcacacacaaagcccacgacacatgcatcatcagcaacacgaattttttttaataactcagcaacacggttggatcaatatataataagttaataactggtaattaagcgtgtgggtagccaaggctgcatcgtatctagagtttttaagtgtgtgttggcaaacagcagatatgtgcaagacaagcaaagtgccacagaacagtgggtgcgtacgtgtaccacatgcatactttaatttgatatactgttgtcaagctaattatgtaaactaaactgagcaaaattaattatattatttcctatgtgagatcattaattattttgataattgatactccctccgtttcatattataaggctttctagcattgtctatattcatagagatgttgaatattaacaatactagaaagtcttttaatatgaaaacggagaaaatagtaaccaaattaaggtcatatcaattccatcacttatcttatagtggagtactaatgtactatcgtagaattcaagtaaaccgtaggattggaggtcgtttaattagtaggtctgacagtaccggtcgataatgtaccatcacgcccaattaattaggtatagtgaacattatattgctggagtaaagccttatgaccaagttatcaacagtaccggagctagttttgtccttgaagggaaaaaaaaaagggaaaactgtagtgcaatattgaagagcatgtgcctatcatgttacacgagatgaaacctttggcatttctgtaggattatgtgacaatggtagaaattagttacaagatggattgctttgtagctaaacgatgttcttgatttgtgtatgcaccattgatcaatagttcaaaaataccataacaattgagatgatgcagtttggagagaagtgagatatataatccgaacaaagcattaaccatccatctgaacttggaaggtaagaaataattgagatgatatttctttgtgaggaaacaggccggagagaaataagagagctaattaggccatatataaattattcatcgaagggtttaaaataagcaaggtagcgtggcttcctgaaaaaatagagaaatgacattaactatatttatttggtggacagtacccgatctatattgctattttcattttaaaactatttcttgccaccatgcatacaaggcgccatatgcattgcatggaaatcaccttataaccaaccctatatattaaatttagcctttgatttcttctctacaaaataaatttccttaacacagtaggagttagtaggagacgaaaatatatagttagcacagagaaacccccatcatctgatgtcacactcccaatgagtgaagaataatactgctgctacctcgctcaatcattagtattcgcatacgaccgcaaaagatcatcgacggcaagagagagagagagagagagagagagcgacctcgatcttgatcttgatctcgatccagcccaaccaacggtcgctgttacgccacgtcacctcaccgacgccgacgcgccatcgcctcgcctctcacctactgcctcgtcctcctcccctctcccgccattgatataaacccccacctcctcctcctcacacctcacaccaatctccacctttcttcctcgtcgacgagatcatcggcatggcggcggcggcagtagcgttgctcgcgttcctcctcgccgcggcgtcagcggcgtcgtcggcgtcggcggcggcggcgacgctggtggagggcggcgtggtggggcgcgcggcggtggtgatgaggcggggagggaggacgtgccgtggcacggtgggggagtgcatggagttcctcggcgtcgacggcgagggggaggacgagctggcggcggcggcgacgggcaagcggcgggtgctgcagggcgggtcggggtacatcgggtacgacgcgctgcggcgcgacagcgtgccgtgctcgcagcgcggcgcgtcctactacaactgccagcccggcgccgaggccaacccttactcccgcggctgctccgccatcacccagtgcaggggatgatcgatcgatcgatcgaccgagctagctaattaatgaaattaaatccaatgccatgtagttcgcagcaagaacacacgcacagtgtccccttgatcatagctgagcttatatgctatagctgtcaagatctcagtgttgtccttgcatgcctctcatgcttgattgattagatgtgtaatggtcctaatggatggatggtgttgtttgctatgctgcttgggtgaaattaaagtgatcaagattatgtttttttgtatctatatgcatgcaaattaactggcgcttgcaattttgcttcagttttttgtttatctgcttatctgcatgattaatgatttttgtttgaatattccaattaggataagcagatatgtttgatagattttttagcttgggtatagtttctgtgggcggaggcagatgatcattaattttaagggaaattttttttctttgattaattaggttgtggaaaagaatttagtactagctatgatctaggccaaattcatgcatacaagctactccagcttgtaagaaaagaaacatcggcgtctatcgagttgagctgtcatttccgagttgattttattttatttcattttatttgggtcagatcaggcactatatggtggacagtttttaatcagtgttactttgaaaaaaagaacatttttgggcccaaaaataaaagattgcatatttggtgaaaatgacccatgtttgagaggatcaattcaaggtgggttaatggaagtggtctttagctacctataacaacacatgttatgtgcaattagtaaaatagtcatttggtaatgccaccaaactgtggttgggctgtcatttttcatctttgtgtgtagtcaatgtacctaggaactttatgcaccaaggaaaggggacatgattagttcccctttttaagagaggatagggaaagtctttgaagctaggaccacacactgtacaaaatggtcccttgaaaaatatgaatatgttttcttttagagtcctaactggagtactgttgttttgattttgtaattaagtcatatcaaatgttacacggtttgcagtttactacttaacttggtgtcattactttcttttcatgtgttctcacttctcatagtttagtgagtggattacacagtaaaagttacaaccgccatgcaccatatttcattatttgcacaatcaatggctagctatatgaattttggctagttcaattacttgattgtcccaacgagtgcaatgctaagattgtgctgtgcctctgtttgagttggttcacacgtatgcgccatcaagattgtgctaccttttgagttggctcacacctgatactgcattctgaatcaaagggaatttttgaatgggctttggtggtcagaatgcagtgtcaacaacccatgacatgtagtataaagtagtgtgatatcacctagacatttatttgctgatgttgaagggggaggagacgagacacaaatttttgactcctgtctttatgtgatgatcaacaaaatcttataacaaacgtcaaatatttatgatcaagagaaccaacttttataattttgataaaccgaaatgatatattttgaactatctctttgtttcaaaatataagaaccaccaacatttgtagtttgcactaaaatataaacactcctagcactataaagtataaagtactacttattttaattgtttcccattaaaatttctttccatctcttccttaaccactttcttgcccctaaccatatcttatttaagccgcattcgtttattcaactctaaaatgcaactttatcttttttaacatgtttttcaaactgttaaatgttttcttttacaaaaacttattatatagaagttatttaaaaaaatcaaataagtttaagtttaaattttacggtaattaatactcaattaattatatgat

SEQ ID NO: 14202 - DNA, 259 bp, Oryza sativa
gcgctagatccggaaacagcgatgccggcggggaagaaggagcagatcgtcgccggcgcggggagaaagccgccgtcggcggagccggagccgtcgatagtaggggggattccggggggtcaaaaccctagtcgccgccgcgggcttgttgggtggggaggcgaggcgaggggggaagagctcgcgagcaacgaagaaaaacaagagagggtcccggaccgaaagagttatgtacacgtgtcccaaataaaagttcaag

SEQ ID NO: 14203 - DNA, 1383 bp, Oryza sativa
acatatgcgtagaatgagatgtaatttagcgctaaaattagtttaaaaattaataattattaagcacatggtacggcatgactctttactgtagtacatggcccaaccaaccccaagtctcttattcgcttgtgatcaaatcaactatactcacatgtggaaagcacgcttgttttctagcacaacgaactaaggaataattatttccctacgtctcaacggcaaatctaccacgatcgattctcttccaagaaaaattaactagtctaatccactagtttagccataaactttggtcctgttattttctcataaagattaagattttacctcggtttccattactactaaacggtatatttcgtgcgaaaactttctataaaaaaagttattttaaaatatcaaatatatctatttataataattaaaacttaattaataataagttcataactttttctcgttttaactttatctttatcgtcatgagtttcgaacccaaccaaaatatcaccggcctggggaagttgtatactcgtataggccaccttcggcaaccgattttcatttcccttagaggatatttttttccaaactatgccatctgtgtcgatttattaatcaaaaagaaaaaaaatcaccggccaagattactacagctaaaatgccaataggtagcttgcactttctgtatgtcaatcaaaagcatcattctgctgcattgccctgaaagcatcacacacaaacacatatatactcctactgttcttgatactggcaaaaagtcaactaatctcatcatgccaccacaaatccaccatccatacatgcactcgctcactaggccccgttcagatctcacctcaaatttttcaccatatcacatcgaacgtataaacacctacataaaatatttaatataggctaaaaaataactaattacacagattacaagtaatttacgagacgaatcttttaagcctaattgctccataatttgataatgtgatgctaccgtaaacatgtgctaataacagattaattaggcttgataaattcgtcttgctatttactaacggaatatgtaactagttttttttttattaatggccgaacaccccatacagcatcctatataatacctgatgtgacacgctaaaattttacaccgttgcatctaaacccctcactaacccccggccagcatcacctactctactctacctcaacgcaccaaccaaccgccgaaaagaaagaaagaaaagaatccgtcaagaaaaggagcgtgacgtgagaagcaaggaagcaaacggggtatgtaccgttacgatagtttgtgtgtgtgtgtgtgtgagagagagagagagaggggggggggagagg

SEQ ID NO: 14204 - DNA, 9049 bp, Oryza sativa
gatgattgacacgtatagtaccccaagtactcctacgggggcccgtgggcggccgcatcctatgcccgaattttcatcgagccaggcgtgcgggtttgtcctcgttaactaattcattaattaattactccctcagtccccttaaaagggatacttgtactgattgatcattcgtcttatttaaaaaaaattagaattatttttttttatttgtgacttactttattatctaatgtactttaagcttaacttttcgggttttatacttacacaaatttttaaaataagataagtgatcaaacagtgcaaacaaaatgtcaaaatcccttatattaagggatagagggagtagcttattatcttatttggtttcatgggctgatccaaacaggtgggctaattcattagcccatacaagaggtactaatgggctaattttctatagggacttaaaaaaagcagttatctctctcctatctctctaatctctcgccacattttagtcctgaattagcctatggttccaaacatgtcactctaagctaatgtttagcctaccgattcaagactaaacattagctctcaaaattagtcctgggctaatcttccaaatagggccaatttggatgttgtatagaggagcgcatgtgcatgccgttggttagtcgatacgttgttgaggtggtggtagtactttctcctccgtgaagacttagagcctgtttatgagagtttcgggtagtttgcagcttctctcggaattaaaaatttctcaaacagtataactttttttttatactatgagaagttctatttgtaaaatttagaaaaataaactagaaacctgaagctgtttcttcatattctcaaaagctgagtaccaaccagctgcttctcaaaatcttaagctaataaatccttaacagtgtttgagagaaggagaaagaaaaatgttgatataatacgtaaaacgagatgggtcattagcatatcattatttaagtattagttatttaaaacttaaaaatggattaatattattttttaaaacaactttcctataatttattttggaaaagtacaaattacctcccgaactattgcggtcgaccgaattaccccctaaaacccgaaaatcagacaacgttcaccccctcgacccaatctagaacagttttgtcctacgtggcgtacccgtggcagtccagttagaattctatttgtataaaagcaggactcacctgtcatactcctcttccactcttcctctctctctcgtgggtcggcggcaggtgggggacacggagcggcggcggcaggggacacggagcggcggcggcgggggacgaggaggcggcggcggcggctgcggccacgatgagcagctgtcgccttggcgcggggacggacggaggcaggggcgggcggtgggcgggcgtggacggcggacacggaggcaacatgcacagtgcgcggagaccctcctgcgccagagggagttcgccgctccctcctctgtgtcccgcgtcaactgccgccggctcctcgtaccccgcctgccgccgacccgtgagagagagaaggaagagtgagagagagaggaagagtggaagaggagtatgacaggtgggtcccacattttttaaaaaataaaatactgactgaactgccacacgtacaccatgtaggacaaaactgttctggattggatcgaggggggtaatttgcccggtattaaaagttcagggtgaacgatgtctggttttcgggtttaggagggtaattcggtcgaccgtgatagttcgggggtaatttgtactttttctttttttagaaaaaaaggcacaccgtttaacaattcggaaacgtatgcacggagaacagcagaaatctaatatgtttagccccgtttgaacctaaataagatacgtattttactgattttttgttagaatattttttaaactactaaatgctaatcttgcttgcactactagaaaaaaacattttttaggcggccaaaagcaatttttccagacggaggagaggaccggctgcagaccaacgacacgattttcgcagccagggcaatggcccgcctgcgaaaatccaatgaaaaaacaaaaaaaatggcctcgtcgccgccgccctcccctggcctccctccggccggatctgggaggggaggagaggggagccgctgacgtcgccgtccacgcgcgcgcctcgtcgcagccgccctcccccggcctccctctggccggatctgggaggagaggggaggggagctgccaacgtcgtcgtccacgccgccgccgccctcccccggcctccctccggccggatctgggaggggaggggaggggagccgtcgccgctgcaacaggagccgccgacgtcgccgccgcaacgggagccgccgacgtcgccgccgcaacgggagccgccgacgtcgccgtccacgccgccaccgtgtctgcgccaccggtggagggatggaggggaggggaggggagggggagagagctgagaagccggtggagggagagagagagagagttgagaagattagtgttgagggaaatgagtggtggggagggggttggagtagataagtatcaaagtttttttttggtaggtaccatttttgcaggcggaccacataaggttcgcctgcgaaaataggtggtccgtttgcgaaaatgattttcgcaggtgccgcttaagtggtccgtctgcgaaaatctattttcgcaggtggatagcgaacttcaccccgatttatatttttataggcgattatttggttccaagggtcatgttcgcctgtgaaaaaaaagacccccatatcaggaaaaatgttttttctaagtgtgttggcttcgatttgatctaaagaggcatgcattggagtgttatttaggccggtgagtgatatttgtttcttttgttacggtcattgatctccggggtttcttcggacttcttttttgttcgatttagaaaaatcgaatgaatgctataacaaattatatattgggatagaactatagattgtgggaggactgtttcgagggggagagggctacatagatggaacggtcgcgtggccaacagtgaacagttaatgagacaacgggttagtggtagcaccatctaagggcaagtacaaaggtagagaccggtatggtctctacgttaattagaggctattacgttacaataattaagacaatactgtctctaacattaatgcactaaaatactttcttactagtgatctttcctttattagactcaatgcaacgaaaaatttcctaataaatactaagagtcgactctatgctgttgtcatgcgtagcaaccatctttctttttccttctccctctctcttccacgtcaccaaatatgcttgcatgataataaagagagaccgctaataaagaccattgtacatgccctaagcctgcatggaagagtatagagagtaagtttgtcttctttcgaacatttccctagctaacttctatcttccgtttttacacgtacgtttcctaaattatatttgatccatttccaaagttttttaagctaatatttaattaattatacgctaatttattgttccgttttacgtgctgaagtgagggttccaaatccgtagtagcgaatgcagcttaattaaatgggggtgtgcgattggagtgagcccttttgaattggaggaaaaatataggaattttggaggattttaatcatataggaaaattttctatgaagccctttgaaacaaaggattaagtcatatctaattctttgaaattcttatggaatggacaatcctatagaggttttagaggaaatttagcaagagcttcaacctcttggtaactttcctttgagtctatctctctcatccaattcctgtgtttttcctgcggttcaatcaaacagtcatttctgtgtttttcctgcgttttgcaattctttgttttacacttacattcctatcaaaatcctatgtttttttcaatcccgcgattcaaaggggccctaagtaagaagtggaagaattacctctccctccattttatattataagattctctttaatttatctatcataagtttaatttatccacgtttgtccaagtttttatgaaaatgtagcagcatttcaacataaaatgaatatattaaaaaatatatttagtgaaatcaattcggtgttctacgtattgcaatttttttatataaagttagttaaattcaaacaagcttgactttaaactgaaaattttttcaatgtctaagtatctggacaacataatttttttctcataatatacaggcaaaccttctagaagcgtggtagtcttcacaagttcacattggggaaaaaacgaaatatggatatatatatggtatcttttgaaatattaaactaacaaccgttattatctcgcagagtacggctaaatatggagtaccgggcgtgatggaaaacggaaaaaacatactgtattttgtcttaaagacacgacaggagtataggaccatagtttcactgaatgcttatcggttttgtaatattgatgtcaatttttgatgtgacatttatctattcatcttattaaaaatataaaatattatttacttattgttaacttattttatcatcaaagaaactataaccttaacctatatttttcatatttatactgaagttttaataagacgagtaagacgaatatttaaacaattatatgaaaaattaacggtgtcgtatataagaaaaactgcggtagtatcatttataaatgtaaatccatttctttttcccttgattgcacgctagatccggttcagacagaattgattgggcaggtggcgagaggccgtactacgccacattgtcctccccctggaaaaaaaaggcaaaaggacaagaggaccaacagaaaagggtgagagagagagagcagggcactgcacggtgcacagccacagcctgcactgcagtagtgcagtttgcagcaaaggcagcaaagggcatgtttagatccatttgaaatggcaaatggtaaatggtaaaagttttattattgtaaaagtattagttggtgtttagatgtattttaaatttttgccattctagcactaaagtgagagagagaaagagatagggagtggtcccaaagcatttttttggcacaatttgctactatggactagcaaatgccaaatgtcaaattgccaagttttaatactagtgtttagatccaaaatgacaaaatgtacttcaaaatggcaaaatttttgctattttggaggatctaaacagggctaaaggctagggtagtaccaggtactggagcactgtagtgtacttcctgtagtagcccaaaggcaaaatttgctacaggacacgcaaaaaacgtgtaattagctgggagacaccgcgaaaacgtgacacggctgatggacactacaaaatttgtgtaattggctataggacactggtcgcattattttattatttccgagtcaaaacaagtgatatatttttctgaatgtctagattgccctttctctttccttccttttctcctacgccgggaacctgcgtgatgggacgaggtcggcgaggtcaccgggaacccgcgcgatgggacgaggtcggcgcaggcgcgagcttgatggcggcagcggggcggcagacggagaggcccgcctcggcgatgcgcagcgcaacggcgaggccggcggggccgctgacgacgacggcgaggtcgacgggcctagagcaggcacccggggggaggggtcgccgaccgctgccgcgcgggtggggggaggcgtcggcgagctcggcgcgagtgggcgggcatgagctcggcggcagcggggcggcagggcgagaaggcgctcggtgttctcggcgaaggcgctgagtgtccgcggcgaagacgacgactacggcgagggcgagagcagcggcgcatcgccgccaactccctctccggtagcagctcacggcgcccacctccatctcgccggacaagaggaagaccggccagctagcagctagcagcagccaagcatgcgccggcgagctcgctccaccagcaagaagatggctagctagctccttcaattcagacttgagagcttgagcaggcagcaatggcgagctccttcagacttcaggcttgagagcttgagcaggcagccaggaggcagctgcagccggtcaggggctcgatctggtctctgatttgcaagtcggagcatgcacaggcgtcctcttgtgccgacctcgccaacctcaccccactgcgcgcgatcccggcgaaggagaaaaccaaggaaagagaaggggcaatctgggcatttagaaaaatatctcacctcttttgatccgaaaataataaaataatacgacaagtgtcctatagctaattacacaatttttgtagtgtccgttagccgtatcacgttttcgcggtgtcttccagctaattacacgttttttgcgtgtcctgtagcaaattttgcctagcccaaatgccacagttttgggcctaattggaatataatcaagctgagctgccatgggccacggccactgcacgctgaacagctcagcgctttaacgtgccaggccatctgtttacagggttgttttcttaattaagtgccacatttttttctaaacaaaggcaagagatacacatgacccaagaaaaagttctcactttaaacaccataatattacaaacactaaaaacacctcaaaatcattccccaaagctacattaaacacctaaaagaaaaccaaaaaatgccacattttacccaaacatagtcaattggtttttagtcacagactacgctcatcacatttgaccctgtttagatgggactaaaacttttaagtccctatcacatcggatgtttagacactaattataaatattaaacgtagactattaataaaaactcatacataatcttagactaattcgcgagataaatctattgagcctaattaatccatgattagcctatgtgatgctacagtaaacattctctaattatggattaattaggcttaaaaaatttgtcttgcaaattagctttcatttatgtaattagttttgtaagtagtctatatttaatactttaaattagtgtctaaatatagagactaaaattaagtccctgtatccaaacaccaccttatattttttcttcttacctagccacagactccactcgccatatttaatttttccccttaccttgcctaaggtgtgaacaatagatcttggccacaccttagcaaagggttgactaggtggtgttgcattttttttaaaacaacagatgctcatataaatgtgcacgcaatcactctatccctttgagcacctttgaagattgtataagtatatcttgagattcacgaagtcacctatccctataaaaacccgggtggatagattgcaccacgaagaaactaaccaattaagttatactcacttcacgccaatatgtgttatatctttctcttgagcaaatactgttacctttttttgtttgataattcatgtgtttccatggccaaatttagggctccttggaacgcatgaatcttataagattttgacaggaaatattttagctcctcctaagtttttccaaaaaatcatatgcttcaagggaagcctcattgatcctcagtagagtcttaaaaatcaacacaacgctatatatcggggtatttaactttttgccactttgaaatgtggcaattaaagatttaccactcgcaatctatgacatgtgtgcctagtggcaaatccttaattatcacttgtaagagcggcaaatagttaattattccctatatatataaagtttgtttggtttagtagcccaccaaaataactctagagtattataaatgaatttgttcgaattgatattaattggaagccaaaatttatataatagcaaagaaagttctagaattgtttcaaactgagcatgtgcattacccatcatttggcatcaaaccaaaccatcgtatttactgctcaaactaccaaaacaattggtatgacacgttttagcattgatccaaaatgacccattgttgcctagcagtttcatccataacctccataactaactggctgccaatcaaatttgatcaaaatttatcaaacaattgaatttacttcatccatcccataaccacacaagggattaaaccttttctttttccaaaattaaggaagtagcaaagtcgtgatacaaaagtgatagttataggaatataactacaaaagttagtagatagggaataaatagtagaaaagttagaaattgaggaataaaatatcttatattttaggataaaatagaagagtaaaatattttatctcgtagaacagagagagtatgagcttaattaattttatcaagtggtttccaggtggtcgatttataaggccgataatgttcctcgctgactatactcttcatatagccccaagctagttgcatgaatcatataatactataaagttgatatttattgactcttaaaagtttaacatgcaagtgtaccacataaacccactagcaattattatctacaatattttaaatatcatgtaaacataatatatcatttacaattttattgtatttctagaactcaatatgcaagtaatatcaaatcattatatctacatcattttcacattatttaaacatatacatatctcgcaacaaagtatactaattcgaatactttgactactaatacatactgatggcatccgtggattacaccgttggtttgtcaaggaaaatacttctaatcttctatacaacattttcactcttttactattaatcttgaagtccataaatgttgcttcgagagaaaaaaataaccctgatgtccaaattaaaacaaatcagctcaccttatatctccagactcgatcacaaaactctgatggacgacgcgac

SEQ ID NO: 14205 - DNA, 580 bp, Oryza sativa
tgctgagtagcagtctaatccagtgatttctcccttttttttcttcttccccagggtttccttcaccgttcggctgcgcattgccttcccatcggagctacttgcctcaacagtttggtcggccgcatgtgctcggtcgggaggccctagggcctccactttatctgcgaaggtgatccaatgaaagccttctagattacctccgatcccatcgctccaatccctatttccatccgacctctctcatctagccttcgcctcctccaaaatccacaatatggtgtgccgctgatatgattttcccctccctcctcactagaaatcctttcttccattggtgaccatggtaatcctcacctcctccacccttaggtaccttcctggacgctatcctcgcatctttgaccaatagccacgaccagggtctgcatcacggcacggggacctagcctcacaatctgaggtgaagcaacagccatggctgctattatgcgagaggaccataggtcagtacgagtggggcttctctcccttctgcttgtgccatgctgattaggtctttgttctgttttggtcgtat

SEQ ID NO: 14206 - DNA, 504 bp, Oryza sativa
gatattgataaaagaaactgttcctttggtcaaaattgatgggaatgcttagactattgatgttaacagaaagtattgttatgctatataccctttgtataaatttctaatttggttccagcatttgctgcatcgcaggttgttgcagttaaacagcttgatctaaatgggcttcagggaaacagagaattccttgtggaggttctcatgctcagtctcttgcatcatcctaatttagtcaagttgtttggttactgtgtggatggagatcagcgcctgcttatttatgaatatatgccattgggatcactagaagaccgccttcacggttagtattttattggaaattgtataatatcctctgttagctcctagaaaaacctgaaagttccctaagaatctgtagttgtgttagaaaacattttatatttttcattgttacatcatcgtgatttaaagcacatctaaccacttgaacatggtgaaaagaactgtcttctaggt

SEQ ID NO: 14207 - DNA, 686 bp, Oryza sativa
tttattgttatgtattttcttcgtaaccataaaaggttaatttgcacgtcataaatagatatatgttatgttgagttttggttatctcgttgccgcatggaccccgcattcctatggtaacctttaatagccgtcatcggaactacgacacggttgatcacatccttgtgctagtcatgacgttactagcctacacgtggacaaaaggatatattaacagggacgacacgactaccgtgtactccatacatctctaattcgatttatatagtttatactacataactacccgcgtgttgttgtgagagtttagtataatagcaataaatacaaataatatgtgagaactagatgacataagtttatataagtcgatgtaatttacaataatttaaaaagtatatagaatggtgttcaaatgtaaaagtaaagtgacgtggctttacgagaaaaaaaaaagagaacggttgtttggactatagattaatcatctaagagctaaaaataattgtgatgatatggttttatgagatgagaaaatgatgaagataatttagaccacagattaattatttaagggctaaaacaattgagatgatatgtcttaataggagatcaaaaaagagagataatttgggccatagattaatcatctaagggctaaaactaattaatatgatatggtt

SEQ ID NO: 14208 - DNA, 479 bp, Oryza sativa
gcacgagcaccaacgaagatgatgaaggctcgtgtgcagatcatccatgctcttgttctcactccaactgctgcgctcgggggtctttcatgggtgccttgtcactagtccttccttccttgctttggcttatgctaaccctttttccctccaaggagcattaaacccttgggggggcccccttttggcggtcaaactctcccagaaatgctatgaccaagccagcaggcccgggtgccggtgcaaaaacacaaacagtgtcatgtgcaaagcgccagatgccgtcaacagaccagagaagccattctgattggccgaccataaggttgcgaactgtgttacaaggatgcatccaacactctgcaggaaattcatgcaaaaaataaaataaatgactgtaggcggataccatcacctaaggctttaatatagcattccttacttaattagggggatccagcaagacctggtgtcacact

SEQ ID NO: 14209 - DNA, 282 bp, Oryza sativa
cactttcaaaggagtttgtgcgaaaaggaaaaaaagaaaacccattcccttctcacgcaagaaatagctacagtaccatcaccactaggctgctactgctagtgctagccagcgtcgtcctcctactactcgtgaggcgagagggcacgtgacgcggtggggcccacctgccagccaacccagcagcagcagcagcagcagcagcagatggcagcgaccgtcacgacgaccgcgcattgaatgcgggagggagacgcgtctactctttccgtttcgccccct

SEQ ID NO: 14210 - DNA, 17646 bp, Oryza sativa
agttttagtctttgccgactatctagatggcctcaacttctcaaggcttgtgtgatatgaaataccacagtgtaactagtccggtctgttatggattagtttggttcctgttggttaatctataagaaaaagaaaaggtggggtctcagtttctatggctcatgatccgaggggttagcctccaaagcttgtattattctctggaattcattgaccttatggcttatgcttgcttggtaatgaaaagccaagatgaaaaacactataatggaattgaattcactttttatcctattcctttggttggtttatgggagatgtgatcatgggagttggctgacttctcagcatgattgggaaaacctaagtacctaactgctgaaattgtagaacacttaacttaaaactgagctatttttccattcttcctatttctattatgtcattgtattataagccgtcttcagtaggtttgtggtgcattcaggtatttaatgttgctatggtgtgtcgatttctgaaatggttggcaaatataaatctgtactcaactactttatctgatctcctggtttctctgttctctctaagatgctcttgtatgcaaccaattccaaaaggacaaaatatccttgatctgaaacagctccatttcgctggttacataatctacttcacaactttagtaatgaatttatgcccttgtttccatttgatgcgtattgaatgttatgccctgcaatttcacccaagcctttttgcctggtgcagggtcctacgtaacacacgagacgaactactttgtgtatttttacatcgattctaaagccgtcttgctattcaaatctgggtgattggcgtagctaatatcccctgcgcttgttgtcttgtatgcctctttcctccgcgttgtctgcaaccaaagctggaagcctggaattctgagagcctgcatgttgttgatgtatcagccgcggatcttttccatattccagcaaatgtgagattagattgtgtgtctattttacgtctgatacatctaggtggtgtcctgacattgccttattgtaatctgattgccggaaagtcagacagaggttgtcatcaacaaggtaaaacttgtgctgatctgcttatattatgcattctctggccaccgggttgcagaaattgcaatgatttcaatgaatgataccctacatgaactgcctatatatgatatgccaatgtggattaagttacaaaaagggaaaatactttttgcattgttgcatcatgtgaaattctactagaccataacatggccattttttgctgagcaatccctgtgaaaatcgtactaaattattattgatggatgcctatgataaatccatggtatcacttaaatttctggttaagcttaattgtatgtgtgattatggatagtaggaattgaatttggtgggtgcactatactgatctgcttaaattatgactgtctggaaagaggttttcattctctggcatggtttccatgaatgacatgaactgcctacatatgatttgtctcgtgggttaggttccacagaggaaaaaaaaaatactacgtatccttttggttgcatcatttgaaattgctacaataaatctatgatgtcagtattttctgcaatttatgggtatcaggaattgacctatacaatcacgactctaccgctacactgtactgtttgtgttaaagtcaagttgtactgttcattcgtgtacaaccagaaacatagcgcattctcagaatttttattatttttaaaacctttttaatttcacaaaataaatcatcttaaacttatttctgaaatctaaactttttagccatgccccgcatgatgtggtaaaataatatagctatgtcaaccatgctggcatggcaaaataacactgttacgttagtctatgtcagcattgtttcgccacataaatttggctggtgtggttgaaaggttcatatttgaatataaaaaatttaaaagttttagaaaacttaaaaaagatcgcattctcatccttgcaaaagccaaagtttgcgactttgcgttcgtcttacgacaaagaatacggaattccctagtactttccacgattccatcctccatcaattttgtagagcaagtatcatgtgcgcatatataaacaacctgtccctggattctttgcctacaatcatatcgtactgactcctctagggaattgagccctccccctaccctaaaattattcatgacctacccacacaaaagatggccgtccccatcacccgcgcggatgacgatggccttgtaaagagaagaaaaaaaaaacgaagcgaaggtgataaggctcgttcatggacggcgacagcttgacctaacttcgcgccgtgatgcgcccacatgctggagccctccgccgtccacgtgtccagatcactagcaacgtggcaccaggatcacgcgcgagggtgcactggtttactagtggttactagtggccccggcggcccagctgagccgagagagaagaaaacgagttcaagtttgcagctcgaaatgaaatctcctcgtgccaaagctcaagatggcgattgcgaaatgttacatcgacaccgcaaaatgtccagattcaggcatcgtttgatatatgcacagtaatgtccgtaatgtttaaaatgattcaacacaaatttgacgtgaagcagatgaaattgaaaggaaattaaactgatttattacttgttccattaaaaccatcacactcgggtacgtggtgaaaccgtgaaagttaaaaaacaaaaacagtagtagtagagtgaggccctgctcgctgttacatgagaggtgcacgaagaaccagcacacgagcagagcatccagcccacacgcagcaaggaaacggtagggatgccgccgccgccgccggccgatccgccgcccggcgatgatgcgtcgtcgtcgtcgttcaggtgcacgcggaggcggagcggcgtgcggcgcggcgcggtcgagaggtgatgagtagttgacgcggagcagatatatatggatggatggcgtcgtcgtcggtcggacgacggcgaggtcgcgcgcatcacgcgcgggcgtagctgcgggcgaggtgggcggcgcggaggtcggcggcgtcggcgccgccggcgaagttggagggccggtagtggcccgtcacggggtcgggcacccacgacacctccctcgccgccgacgacgacgacccgtccttcgcctgcgtcatccccgcagcgcccttcccttccaccgccgccgccgcccgcctcatcgccgacgacgccgccgacgcggcgtaacccctcgtcgtcgtcaccctcgccgcgagcgcccgcgccgcggcggcagcggcagcagcagcagaggtggagagagcgagagccatcggatcactcgatcggacggctgatggcgctccgctcctctccttctctactctgcttcggtgcgacgcgacttgggcttgtgagctctgtgtggggaggagggaggcggaggcggacgcgcatttaaagaggcgagaccgggggggagggggctcgattttattattttttataaaatattttttggtggggtgccacgtggcgtgggaaagcacgtgacgggtcgagggaaacgtcgccgcgggttcgggctgtcggcgacgcgacgcgccgcggagacggtggacgggtcgagtcgtggtctggctatgcagcggtttgcgggtcggtggacgtggtccaccacgccaacgtgagtaaaccgatgatgatgagcgtctctggtttgtctttgtccactgtgaggaagtgagggcatcacattgtgatccataggtaaattataatattttattcacgttgtgtaattagttcctataaaaaacaaccaaagatacctatatacatatattgaataaaaaaaatagtagtattatctatgtctacttctctcttcagataatattacttcgtgtctatatacaatgttgggattgctatagttaaaatctatttacatagattctgtctatattgatcacatttgccatataaattggtgatgccttattattggtggctttttatataagctaaccgatgagtacatttacgttttttaagctgctaaacgatactcccttcatcccaatatataagagattttagatggatgtgatatatcctagtaccatattcagattcgtattactagtgtgttttacatccacctaaaatctcttatattgttggacggaaagaatatattgcaacgtgaaaattttctgtgtagaagttcttttaaaatatcaaatagttttatttaagtttgtaataattaaaattagattaatcatgtgttaatgattttttttcatcgctttatcttccctagaaaaacgaagaccacgtagcatttctctttattctctccatttcaaattacttgtttaaaatactagttattattataattttaaatttctaagcactttttactaaaatgtttcctgtttgctcctcataaatgcattaacacctgtgaccgtaatgtacaggggttgtttcttttgttgcttgatttagatcggcgcaaagtttggcttttggttgaaattagatataatgtgactgaaaagttaggtgtgtatgataggttgatgtgatagaaaatgactgaagtttggatccaaactttggatctaaacacagccttgctatatctctgtgttgtatctaaaagttgatcgaatggtagtacgcaggagtaactaaattgaaacggagggagtttatggtggtgagtcgcgtttgcgttgaaggggggaagttgagttggtgctcttgttcggttttgataggtgatgggggtgtttaattagtctatgtaaggtagagattgagttgacttgcggcatgaataaaaattcaatcttatctcccttgttgtttgcgtattttagccgaaacagctccttcacgataacattaactatacttcagatgaatacaatttggccaccccataacacttaaatatcgaaaattatcaacactaaatgagcactttttattatgcattgtgaccatcaccaccgcccgcgtaaaataaccaggagaaagggcttgtttgtttcgttgctagaatcagccttatcaatttttttttatatatagatgaatgtgcatttagtttaatatccttttaaactttactagtagtgtctttatgagagaatctatggaaccactaaattttgataacgcatcattggcaaaccttacctaaaataggtgggttaaaaagtgacaataaaatggacatgtggatgtggtagggttaaaagtggtaataatgtgaacatatccaaagtagcaataatgttatgataatggaagttcaaccagtgactgggcaagctcccggcaggtcgggcagccactcgggctccattatcgccatctccattgctgaatgccatcaatgtttgtaaaaatcggtcaatcgcggtaaaaagtattagtcacttatagctcggtaacgccatctctttctcaaccatctccatcatctcagcaagacagaagttgatttgcagcattcaagtgctccatcgttgaaggttggctactcttcggattcacccttcctattgttctctaacagaagaaaccatgctggatttatcattcgggttgagctcggaccacctgcacaatttcggttgacagggttgatgttagagctcctcagattcaatgatgagcctcgtggggatccttcgctaagtccggtgacgcacacaccaaaatctacagctcaacaacaaacctcagtcttgtgccgtttccgtggaggcagccgatggggatcaacggtttgtcaagcggagtgcacatcttttgaggcccagggtagcggtcgtcgcggcttcgtcgcagatccctgccgacttgctcatttttctaatgttaggttatttcaggaagattgtttccgtagttcagttaaccctcccttctcaggggtggctcttttgctttcagtttttatccttggttatgtattggggtttatcctctaattctgctcttgcttaataaagttgatgtgtttttttaaaaaaaaaaacctcaacctgtgcagctggccatgttaagattaaggctgtgtttttttttcaagttttcaactcatttcctctttttcgcacgtccattgctgagtgccatcgatgtttaaatcggtcaatcgcggtaaaaagtattagtcactcaggctcggtaatgccgctagcttcgtcactgagtccaacctcaacctgtgcagctggccatattaagggcaagtacaacgggtcggcgagacctataggtgtccaaacgggcggcacggcccggcccggcacgggcacggttccggcacgggcacggttccggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgtttttttttaaaaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaagggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttaaatattacttacatctttccaactgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgttgcgtgccgcgggccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctagcgagacccgtcgacatgcactgcttttttgcaaaaaacaccccccacggtgctagcttcgacccatccgtcgtctcgttcgtcgacgatgccagcgcgtgctcccaggcgacgcgacggcgatgaagcccgttgtacgacgcgatgcggggaggcgacggaagtgcgggatcagctgcgtgggatcagctctctcgcgcgcggaatatttaaatgtactatgcattgtcttatgtatgcaacaaaataactacaaagatcaattatacactagatcatcatgatttgtgtgtcaaaggatgaattaaacactctacggacagccaaaccaacaacccattatataagccgtctgtttaagctgtctatctgtgtaaaaagacagcaagctgtctacacggttgtacttgccctaaggctgtgtttttcttttccaagttctcaactcatttactcgtttttcgtacgtactttttccaaactgctaaacgctgtgtttttttttaaaaaaagaatttttgcggaaagtgctttaaaaaatcatattaatttatccttttaaaaaataactcttaattagttaagtgctaataagtcgttctattttatgtgtgagagattattttccaaccgcatggattgagaacatagcctaaaggaatgtagcagactagcagcagtggaagtaagatcaggtacaataacaggctataagccaactataaacataatttaaagatataaaggaagagaaataagatcagcgggctacagatctgtagccagctgcagcacggactccaaagcgtactatgtgtatgacaggtaggaccaggtattaataggatagtaagcaactattatatgaattggctattatattggttatagatgatttggagttagtagttggctacgctattaaacttgctctaaggccatctgaagattaaggaatgtagcagcagcggaagtaaaggccgtggatgttaggaatgtagcaggctagcagcacagcgttccgcaggaaaatccacggcgctaattggtgacgcgccgagggaatggaaatcacggcggacggcgatcgaatcgaatcgaatcgacgcgacgcgggcgtttttgtcgggtcgccatcgacgggaggacaggacacagccgcgggcccgcgccggcgaagacgctgctgcatctgcatctggacaggccgcaaccggccgccccctcgcccgccgacggccatcggaaaaaggaaaatgctgaagcgaatcaagtagggccgccgcgcggcgcgtctagtgcaggaaatcgggacgacgacgtgcgtgcgatgcgaccgcgatacctcgcttggttgttgttttcggccattcaaaaaccttttacagaagatgggagaagatgccaagcagcgacgcatgccaaactaaacgtggccatgaattgtactaatactatttctcatgtatttgcttgcaacatcgtccaactaaacgtgcccattggttataatgcttcttctattcgctcgcaacatcattggaataataattcattccaatcatgtccatgcggaaaaccagcaaacgtgtccttgccaactaaatgttcacgctctccgccgcagcagcaacaacaacaaaaacgttcaaccagaagcaggctcagctttgcttctcagatgagaacatcaccatcttgtgccaatggttcagtgaccgcttcctaccaatgcacatcatcacatgaattcgaacatatcagaattaagatacaaaagtctccggtatcaacatccataacactatttgatgataacattgaaattgaatcgcaagctccttcgtaacactaaatgatgagttgctcctacatatctttcatgatccgtgctcactaaattgtaagtacaactttgccaataattacgaaaactctttcaagggagcatatgagtaaagttaccgatgataaaataacttttttttgtcccagtagtcaatagtacaaaatcctttattcaccaggaacatctccacataggccatctagccctcaataccgaaatgaaaatttcctgtctgatccgacatctttcagattttgcctgagattcagaggaacaagcttgcagaaattttaataaaagattctactgttttagagactacaacagcttgactccagcttctctaacagagtcaatgacagccctgaccttcccatggtacttctgctctctcttcatgtggatgcacacagcgggtatgcccttctgcagcagccgctcgccgagcagcttaccgatcttggcagcggcagcgacatcgcgagtggactccatgttcggcctcagcagcttctcctgcgagctcgcggaacaggcgaccgtcgccgttggggtgtgaaccacctgagcggatacatacttgttcgagaaatgcatcctcagaaggtagggcttcagaaagcgcgtgatcctagccgccctttccggtggagggatcaccatagttgctaggatctctctctgcagcaaaataacaagcgagacaggggacaatttcagttggcgaaaaatgcatacaggtattcacattaagacaacacaagtgaataatggtttaccactgatttgtaaacaatttgaattgtaagctgaaattcaaaaccaggagacaaacaaacagtacatatgaaaaggaacagtgtttagtccggccatgctgatcgacgataaacagttaagtattccaaaaaggttctacttcaatcagcactgcaattgcatatttgaatggccatatagcatcagcagcagcagcagcaacttatgcttactaaagctcacaaaaaaatgcatcaattccaccatggcgttattatccaagattattacaacaaattcaggcctgaaccagcgcatcaaaaacagattcgggcatgtccaccagacgcaggtgaaagctcacctcgagactcagaggctaacttaacgtgcgggcatggccatggcggatcagccaaactaatcccccacccgaaaagaacctccttggaaacaaacagctaatagtagtagttgggttaggcaaagatttagcttttccagatatagaagagaagctagggatggcaacacgttcccgcccctgcgaaatgcaacggggcatagttttctcccatcgccccccatggattctccatccccgctgtcaggaacaacaaactcaataggtacatttcacatctcaaataataacaatattcagtcaagagatattattgccatccaaaagaaaaaaaaaacaaaaactgctagtattttcagccggagcatgaccatcagtccaaaatcaacaatactaataatcaacatgaagtaagttcacatctcacatctagatgagtaagttcacatctcacatgcaagcaagcagcgggatcaaatctagacaggcgtacacacacggtaggagcgaccagccgacgacggagaggggggcgagcatgcgaggagaaagggagcgaggcgaggcgatgcctgacgactgccgcccgcgccgccctgctcgccgcgtcggcccctccctcggccgctcggcgggttaacgcgaggagaaaaaggggtatgggaggagaggcatgaggaggagtatgtgcgtacgtgcgtgtgcccaccggcggctgggtgtggggagcaggacgacgccggcgccgcttgcccgccggggtgggtggggatcggcgctgctcggcggcggcggcggcggcgcgaggagacgggaggggagtcggaggccgaagggatacacgggggagatcgagatcgactaatgctgggctgtttgaggtccagcgatatgggctttttctatggccggcctgggcctggctgaaaaacaatggtgaagaaagcccttcatcttttgatctatctatatgagggaataagtttacataaagtcctcacttacctctcccgattgaataaactgagccccatcgtttggcctaaacagtcaaagaataaggagtaaattccttgtgtgcccctgaaaagttacccaatcccttacatgcccctgaaacttactcgattccttctatacccctgaattttcgattggatcccctacatacccctaccgtttgggttccgtcagatgtttgtgttcatgtgtgtgttagcttgtcagtattttcataaaatgcgaaaatgcccctgtcaaccctaggtaacacagggccacatccgatccccaaatcctccaaaatagttcccacacgcacggtgccgcacatcgccagctttcagccatcgttgcacgcgcatcgccgcccttctcccacatcccggcggcggcagcggctctgcatcccgccgcggtctcggctctgcttgcggtcggcggcggcggctgggtccgcatcccatcggtggcgtggcggggtccgtatctggtgggcggcggcggctttgcatcctgccgcggcgacgagtccgcatcccgccgcggcctcgactctgcttgcggtcatggcgacgccgtctcctccctgcctcctccgcgccctccctcttgtcacctcaccctcttctcgggggctccgacgccggcctattacctccttgctccgctgctcctcgccgtcggtaagatacacccttgcgttgattagcaaaatgcgaatagctgctgctgctagtgtttcttcattaatttgtttgactttatgcaggcagatgccttgaactgttatgggcttgtgccattatgctcatgatgtaaaaagtaatatatttgtgtactgctgatggtgtatgaatgcttttagatgtattttcattttcttcctattaaatggtgctaccgatgctcttgatatgctgatgaattgcaatggtgtttgagtaaacgggtaggggtactgtcttttacccccaggctgtatcggttagtggtcatgaaagatccaatgtcatgttatatttttttataaaatactgaatgctataacaaaagaaaatgaaattaattttatgcactatttttttagtctcacggaatacatactgtgcagtcatgaatgtttcaaacccagctgccaaacatgttcttagttttcagctcctccaacctcaagggtattatagacattttcaaccaaactaaccagggaatgctgctaaatctaacggtaggggtatgtaggggatccaatcaaaaattcaagggtatagaaggaatcgagtaagtttcaggggcatgtaagagattgaataacttttcaggggcactcaaggaatttactcaagaataagccaaaatttgaatttttgaacttgattttgaagtgattttgaaatgcttttaacgtaatttttgttaatgttggcttttaagtcgctacgaacaaatctataaaagttttacttataaattaattttaattttctaataagccaaataagccattttggccaaatgggcaaccgatgggagcctgagtataacatattttccctttttttgaaaagaggagcaaattgactggtttcgaaagctgtttatgatgacgtgccaagtttaacatggttgatttgttgagtcaacaggttggacccacgtatgagtcacctctcttcccgtctttccatccctcccggtgatatccaggatggccaccgggggaagaggagcaggcatggaagcatcagccacagtttcaatggccaccaccatagcctgatgctacaactcgcccgactattcgccatcactgcgcgtcctctgcaccacataaaactaggggtgctagtgggcaaggttacccacttatttgtactataggtggtttcgtgtacctgcccgtttttacccctacatacaatataaacacgctggacccggcggcgcaccccggagttggtgttcgtcgccttgccgtcctacaccatcgaagtgtccgggtgcgcccccgacgcgctcgcggagtcggagccagcagcgttggtcggcggcatgcatggtcatcctcagtgcgcacaaggctgagctttgcctcggcctggggttggaaatttcggaccgaaatttccgaaatttcggaaattccggtcatttcggtcacctccgatacgatattattttggccgaaaattttcatttttttcatgaatttggataatatttgttcaaattcaactaaagtttactcaaaatttcggatatttcagaccgaaattttagaatttcggtgaccccctatacaaacgcctctaccgatagagtaaaccctggctgcacgtacgatatggctcagcgatacagatgccaccactgtccactgtgagtatcaggcgtacatgttcaacccagccaattaagtacgctccacttcatcaacgagtaaaatggccaacaaaagtgtactggctctctcagtagaaacctaaacaaactcctctggcacagtggtcaacacgttcgatgctcgctagcagcagcaacagccgccgtctggccctttctccgtcgcccatcggtaagagcgatggatggaaaaaaaaaagaaaagaaaggaaaatagagaggaaggggagggaagtggatcctacagatttttttttttcgttgagaggcttacacgcgagtctttgatgtgtgggtccagcttgctgatttaacgaatcaattgtgattaacttaccacgtcagtagaaaccgctttaaaaataactgaaggagtttaatttgcactggtttttaaaaatgggcgagaagttatacccagttttatggttgagagaggcgattcgatcgggagcagtagctaagggaagcaaaattgacttatttcatctatgtgaagccatagaaaaaatgaacaaagtaactaaaaataatttaatttagagcacatttcatagcatacacaaagtaactaaaaataatttaatttcatagcatacacatttcatagcatataaccaaccccagatattatgtttttaaagttttacaaaatctcacccttgagtatgaatttacttaaaattttaaaacataaagcgtatatagtttcactctgcactacttttaaaaagtattgtttcaaatatgctgaaattaattgagatttgaataaagatagttttatgtataataaagttatataatgaagtctgatcgtaatcattagactaagttgtggggccctgtccgcaccttcagtatcatcagactgtccttcaattttgttttaatccctggctgacatattatcagacgaaacttttctcattagaatatgaccatgaggtcaataaaccaaatccatgaggtcaaagaaacatatccacatcagtgccacgtttgatgatacagttgaggatgaaaaaaagttaagttactgatgttacggaatgataagggattgcacattaacataacaagctttcagttcaggaaatttggcatcaatttaagttcggaaccaacatttaaaacagcatcccttcagttaaagttccctagtgaattctaattcagatagcactcaagtaagccttacacttctgtaaaagctgaactgaccaaaaaattacagttcgcaaaatggcttgaccaaagctattcacatgtggaaataa

SEQ ID NO: 14211 - DNA, 6018 bp, Oryza sativa
cattttctaggcggttggtaaatcctttatgagtttatttactcggattttacaccacatatgccatatatttccaggtatggtgaaaccatgtgtcttctagggacttaagcacatgtgttaaagcagtgtgcgcatggcgtatgcccaatactttggaaatttctttattcacaatatacaagcttctttatagctattttgctatatcactcatcatattttacaaagcagttggtatatcactcggatcatgttatttggaggcttcacaccgcatatgctatatattgatatcaagtcacttggttgattacgattatcaaaaccactcggttgggtggattatttattccttgactatatgcctggtttgctcaattaaccacattgtcgggggctacacctattaggtgcatctagtcggtgcacctgactttattttccagccctccacagtcttcagatttggtaaaaggtctcgggagaccatgacaaagatgattgaagcactctgctttggagtgatctggttcgagagaagactatcttttcgactgcaaggtctcaggggctatctgggatattatgggtaccccatacccatatggcatggttatccgactagtcataggggataacttatatctatggaatatgtaataaatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacatcaggtgactgaaaatattaaaaacaccggtcgaatatactcaccatcgaaccatgcacaagattcatgctcttgtcgccctccatagttctggcgtctctccgactacacaccgcagtgaagcagagatcacctcaaccatgagggaggagggtgttggactggtgatcgtagcaagcttgatgatagaagccgctagagaatggggagatgcgggatagggagaatcgtgctagagtggaaaatgagggcaggacaagagatagggaggcgggaaggaggagacgaaacatatggcaacggtgtgcattagcatggtgggaagagaggagggaagcagatcgggcatagggaagtgaggaggttagaaaggggtagcgatgaattaggcaaagaggtacaaagatgggagagaggccggcggtggcggtgacggatcaagcaaagggagtggccaactgataaaggagggattaggttaggtttatagtatgggtgcacccttagtttataagagtttcccaaaattttaaagaatttctaaccattcaaatttcaaaaagtaatttttttaaacaaaatcaaatggctagatagacaatccactcataattgatgcaatcggggccacagaccacgtgtttccatcagccgagagtaatactataggtgcggatctcctagagttggtaacttcacaatgtggatttgagccaatatcaaccattgtcttttatctacggtctagatataatcaaacatcactatctttgctatatctgttttcatcccatcaatagctccatggaaaaagttatcctctactagtgggggtcaacaatgacctagatgaccaatcatcatagccgtcggcgtagcacacagagtcacagacaacttgccaagaaaaaaaaacactggccaagcttgaagcatgaaggaacgtatcgggtagcgcatcactgcttttcttatttgaagcctccatcatcatttgaattcatattcattatttagaaattaggcacaaccgattgatcgattagctagtgaccactgggtagcagcaaatactctcactttgcctcttacttctgccttctactgaattgttggcatgtggaaacactagttcgcaaacactcgcgagatgtccatctcacaaacgcgtcccatccacataacgacaagccccaacttaagattagcgttagaactttggtggtggagtgagtggaactagggaggggaaagtgggggatcagacttagagggattggctaggggcagcggactgacaatgggtggtgaacaagggtggagggcgaggcggcgacgacgccacgaggtcggtagcaggcggtgggccgacgttggtggcgggggcatagctgtcacaccctaaaaatcctaaatatataaattgttgtttaaatggaattattagaatttatttttaaaagtctagaagagaagatctaattttaattaataaattccaatataaaatggggtcagataaaatttcattaaatactttgcttaattctataattcctagatttttctgggatttatttgagctaaggaagtatttttaataaatggaattgcatttcatgaataatttaaattaaaaaaggtttttaaaagtctcttttggctttgggccgaaagtcggcccaaaaccttctctctctctccccggcccaagtcggcctagtccgcagccgcagccgcccgcgcgagctcgctgccgctgacaggtgggtcccgcctgtcggagtcgtcgtcttcctccggccgaaaccctagcgccgcgccgccgccgccgcttcccaaattcggccgcccctttccttctccggtgaaatcaatagaggggaaatgatcttcgggatctcctctaccttttctcttttggaatcatcgtctaaatcgctttggaaattcgtggattcgaggtcgaatcggatcggtctctttcctccgaaccccaatgtttccttcgcgtcgccggtcgccgtgggccttcgccgccgcctccttgcccctataaaaggatccccaagctcgccgctacccgccgccaccctcgcctttgtctctcgtcgtcggaagagccctagcgccgtggatctcgtgccgcagtcgtcgccgccgctccagccgtgcgccgccgccgttccggtcgtcgtcgtcgctcggggaggtcgccatcgtggtcgccaagtcgccgccgtcctcgtccgccccttcgccgtcgctgtagatcgccggagcaccgccgtcgtcgtcaagccgaaggtctccgccgcttcgacctcgtcgccgacgtcgtccgttgcccctccgccgttgctttgatcaccggtgagttcgccgcgatgcccgcatcgtcctagtgccctccgttcgtgccgaagcgccgtcgttcgccggcgagcttgcgcgtccgagccgccgagccgccgccggagatgacgtcaccgctgacgtcatcagggtccgtctgccgtgagccgccgtagacccgatcgatctcggccgtccgttttggatggatcgatctcggccgttcgttcccgtgagccgctgccgtgcgcccggtccaccgcaaaccctagccgctgacgcaataaaccccttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgtttggtgattttgctcttttctgtttagattccgacgtttccggagtgtccgttttcgcaggagaagaatttgaagagttctaaggccagcaagacaagtcacacagatcccaaacaaccctttgagcatgttgatcccatttaaagctattgtttctattcaaatattgcatttattttcgaatgtcattgggtggaattaacctattgtttgttatagcccttttgttcttgattactttattccttgataccttgggtgattataacttgactagttgggctatatatattggttcagctagatattagatgtgattgcttagccatgcttagaaacattagcacactattgggataacttatgattcactagtatttaatgatggcttaatgatagatcacgattgtcaatcgtgattggttaattaattatttgccaactaaaacttgataatggtgggttgtgagcacatggttttgagagtcgtgctcatggcaattaaggaccggttcacgagtttcggttgtgaaacattaaccgtgccaaccacaagccagcgtgggcaacgactttaccttttgtatagcatggttcattgcggagcaccagactgagaagtggtggagataagcccacaggggtcgctggggagtccatgccttgtttataagggggtgattatgaaccaggaaaggtgcgctgtagtggattgtgttgtgcaaggggtattgtcacagctcctttccgaggtaccgtggtggtattgaggcacatagtgacatgatgtggggctgtgtcttgtgggtacagtggtacacctctgatcagagtaaaactattcgaatagccgtgcccgcggttatgggcgggcctaacaatgtctttcgtgattagtctcacacttctcaccataataaaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagccgtctgcgtcgtttatcttttttccgctgcttagatctttattgattgagaggaactatctacctctgtaatgacattttattcgcttattaattagagtaataattgtactctattatcaatttgttattgtgtgcctcggctgattcctggatgagggttcacacacatgtaagcgtttggaatttcggatagaaattccgggcgtgacaatagcgaggcgatgaggagagcaaggaggctggccaagtggggccgctctggtaagttgcctttcaggactgatgaggtcgaagggcgacacggtagggggttgttgacccccgattttggaaatcggaaatcttctgtgtttatccgtaccaatccctggatcagtagttggtacacacatacatagttggatcacaacatatcacgaatgaatttaggctaaaagagttaaatacttacattagggccaggtaggccaacaactatcagagaacaacagcggaagacaaaataatataagagcccggttaacatgccacaggcagtcgactgggaaacgagacctagaacaagaccgcactccgatcatcttgttggatacacaagcgtaccgacaagggcttctcttcaacactctcctaaaagatatatgaatagcaagggtgagtaccaaccatactcagcaagccaccacaacaacaatgcatatgatagagggtatttcaaggaatggcttcaggttcttttgcataaagctaattttacaattcttttcacaagcctgaaacctagcatagactgatcaaattttagtaccagtgttcacttcaaacaacgacggttctgt

SEQ ID NO: 14212 - DNA, 1116 bp, Oryza sativa
gtacgggggtcgtttcatgcttaacttcatggctcggtccttaattgaccagggacggcactagccttttccggataccacccaaatcctccgtccgccccagttatagttggccatatgggccgcccggcacggcacggcccaggcacgaccgggcctgggccgaggtcagtcgggccggcacggcccgacgaacaagccgtgccgtgccgtgccagcccacgggctacaaccacggcccaggcacggcccaagtagcctcgggccgtgccgggctggcccgacggcccggcaagcccatcgtgcccgtgccggcccaggcacgccctggcaaaaaaccccttcaaaggttcaattcaacacaacaaattgacataacacatcaaattcatgaaattcacatgtaattcatcaaataagtcaaagaatcacaaacaattcatcaagtcaccagtttatcaaatcatgcatacatcaagtcacagatttacaaacaaatgaacaattcttcaagtcaccaattcatcaagtcacagtctcatagatttacaatcagttcaaatcaattcatcaaatgcatacatcaagtcatctactataatccatcaagtccatctcagaatcacaaaccttagaaagttagaatataaaaggggtttatataagctgtgattgtgcaatggctgcctcattaaaaacctttctaggtaaaaactcacacctcgtgagaaaaccctagaaaggaaaagagtacagcccatagctaaaatgttcatatcaattacaatcatccagttcaagggtttacatcaatttcatcatcaagatacatattctcataagcattttgaagctccacattctcagtagtatgctgactttttgcatctgctagctcccagtccttgatcattgccagaatttccaccagcctagggtttagacgccgccgacggtcctcgatgatcctgccagttaagctaaaagtagactcggacgatatagtagaaacaggaacagtcataacatctttagctaagattgaaagaacaggataagttagtttgtgctgttgccaccaactaaggatattgaagtcatcatcatattggttga

SEQ ID NO: 14213 - DNA, 4686 bp, Oryza sativa
ggctcgattacgtgtcttggagatcatcttgccgcgattttatctccttaccttgtttgtttttaggcttgttgctttgcttgcttgatggatttccgtcttatgtggttcatattatccaatacatgtttgatgttaggatatggggcttgaaggaactcatgttgttcatattatccaaaacttgtttgatgttaggatatgatgggactgtcagtgtgcttggcagctggacattagtaatcactgaattattgccattttgccaacttgctgcgtcatattactggagtcccacactgtaagttgcagaatcctttcagtttccacaaactagcatgccaaagatagtaatccgctcaaggtcgacgcttgtaaactcttatcgtttggagcagggaaattttcctatttcttgcaagaaatgaattacttcacaccatttgtagcagtgattcttttccctacttcttgtaaactctttagtttggagcagggaaattttcctatttcttgcaagaaatgaattacttcacaccatttgtagcagtgattcttttccctacttcttgcaagaaatgaacgacttcgtgtgaagttcatgtgaaattcgccaggcaagtttttagaggggagaccaaagacgtgaaggcaccaatgttttgtgacacaagagatatgtgtagattgcaaatcaataggcaaacttagctcctttataaaattcccaacaaacataaggttagggatctaccagaaagcaaaatctgccgacgtagaccctaaacacaaccgtggagtaattactcgtgcaattaacttagcttaatctccctctaggctctagtagtttcagtttcagtagtactgtagttttttcaccagctgaatctgacccacagcagcaacgaaccagagcgcaagaacacaacgcatttctgcgttttttttttggctggaaatggatatattccccaagcgtgacaacaacttttgagtgccagtgtgtgtgtgttcccctcccctccctgcttaattacatcatctctaacgtaaatgattcgtgatcttcaacgggaggaaaatgacgctctcttcgacctccagagcggttttcctcccgagacaaaaagcacaaatccaaagctccccaaaaggctgtacaaaatggcaaaaagaagaaaaaaaaaagggagatcgaatgatcccacatcggaatccgacctcgaggcgacggtgtatatgagcgtctgaccgtgctagctccggagcgcgaccgcggcctcgtgcacgagcgagccggtggcctgcgcgacgccgtgcgcggcgctctcggtggcctcccgcggcgagccagactcggacatgcggcggacgaaggcgacgaaccggcgccagttgtccgggtggaagaggtcgggccccatccggaggtaggtgaaggcgaccatccggtcctccgccgcgcggtcggcggcggcggcgaccacctggtcgtgcgccgtgccgtcgtaccgcggcagcgcgttctccccggtgagcccgacgcccgccgcgcgcgccgcggtggacacctgcctgacgagcgcctcgggcatgcactgcgcctcctgcggctgctcgtggtcgcgcatctccacgcaggtgaagttgagcacggcgccgtggcgcgccagcatgcgcgcgatcgggaggtagccgtcgcggtgccgcgtgttgtagtaccccgccgtgagctccggcgcgtgcgaccgcgtgccgtagtgccagtggatgccggccaccttgaccgagatcttggcgccggcgccgttgccgaacacggacgtcgcgcccgacagcacgcgctcgccgtgctccagcagcatctgcgaataccacgacaggaagaactcgccgtactcggtgctccacccgccgcagtcgccgcggaagaacaccgtgtcttccggccagttgttgtagccgccggcgtccgtcggcccgccgtggccccactccggcttgcccctcgcctccgccgccgccttcaggctgctacgcatgtactgcaccacaggacgtcaaaatttatccagataagagtttttctcgaatccatgacgacccaaatggagtttttgctcgtcggagattagttaccctgtcgttgcattggaaggcgccgatgccggggaacctccaggtgccgttgctctccgggtaggacgggtaccgaagctcgccggcggggcccatgccgacttggatttcctgcacaaggagacgcacggatgatcagcgtcgtcgtcgccgccggcgaaacggcaacgatatcaaaagagtccttcctcctacttacgacgatggtgtcgccgaggaaggaggcgaagtggtcgcggaaggcgcgcatgaagtcggtgtagcactcgacgggcgtgcggcccttgaagacgggcatggcgtcgcagccgagggagatgtactcgaagttgcggcgtccccattggtcggtgtaggcgaggtcgttgtccttctccatctgcttcaccacccacctcgggagcgggatgctgcacgccacaccaacaacaagaagaggttagaggagaaggatgagatagatgatcgaggaaggagacgagagatgcgtacttgacggagtcgccgacgttgccgccgcactggtggaaggacatgacggcctggaccttgaggccggtcttgcgggccatctgcatgagctccacgtagccgtcgaagttgtaccgggcggagccctcgatcttcacgatgccccaccacacgtgcaccatgatctccttcacgccggcgctcttcagcgccgacaggctcgccaccaccgccttacttcggttcagcgcgctcccgcacttgctcaccgtgtccagcggcatcatcacgaacaccggcacgctcgatcttctgctgatcgccgacgccgactgcacgtgcctggacaccgcccggaacgccaccaggtagcacgcctgctgcctcttaattctcaggctcgtcgtggccgacgacgacgacgacgggatggcgaccaccgaagcagctcgccgttcatcaccggcggtcgcgaagcacgctgccggcgcggcgctctgagccaagttcaagggcatcgtgtagaaaatcttaacccgaaaatcgaatccccaacaaaacgcgggaaacaaagaagtgatcaacagatgaaccaccccaaaaggaaattgttttttttttcttttttgggatcgacacagccttgatccgaacagaactgggagagatcggattattgggaggttggggattgggaatatatctaaagcccaaaaaaaaaaactaaaattattaaaaataattattcaatgtggggtggaggtcgatgaggaggaggagccgagcgcgaacaagtttatataggcgggcgggagctctcgagagagtgccacgtggctggtgtgaagggaggaaacgagtggtcgagatgaggccggggccgcggcgatggacgggcgggattgtcggagcacgtggcggttgtggattgggctacgtggactggcgagagctagtctcgcggcggagacgcggagtggccgtttttaaccgtttcctcctatgtgggattttagctcgttttttcctactctcccggtgattcgaagaacctaattaccgtggtttcatcggttatttctttttttcgcgaagaatatgttgatttcttctgaattatctagctctcacttgctgaagatttgattcgagtagcaggatgattaagctcaatctagaccactcgaagggaacggaatgattgatcagcgaatctacgagtgtctaaaattctcagatcagggacagattgctgctgctacagcacgtactccggattgagaacaagattcagaaaatctgaacaacacgttgcattcattggagccatggaaacgatgaaccaatcaatcagagtaaggttctgggaggagctgcagattgggagcctgaaactcagccgcgtggaagcccgcccgggaggagagggagaggaccagattgttcagatacatcgccatcgtcgtcgtcgcatgttcagactgttctagaatctgaatctgaactccatttcatacttgcccctgctctccccccatgcggtcctgatggaaagatcgaaggctatagtttgggcaagacgacgagatcttgcagaaggccaatttatgggtttttttttttactttattcacccagcaggttcagtgatatcacgaaccacaaagccatttacaaattctgggagagggtctattttggtttgatgccaaaatgtggtctactaaatcgggagaatatagactatttaccattaaattcgcgtgccttaactttttttaccacccaatccgcatacccctttataatatatcattaggactgctaattagtctatttggtaccactttcaggttttttactgtgtttctcatttcttaattccatttgcatattttttcaagatttgtggacgtttttgcccctaggcccacccgtcagaaccaaagagagatatttctctctagatcgatcgatccctccagtcttgtcaccgtgagcaccaacctcgccgccgggcacggcaaaccccgccgccgagcacccccactccgccgcccaatagccgccgca

SEQ ID NO: 14214 - DNA, 436 bp, Oryza sativa
  unsure (1)..(436): unsure at all n locations
tttataagggattttgccgatttcggaaccaccatcacacaggattttcgcctgctggggcaaaccagcgtggaccgcttcctgcaactctctcagggccagacggtgaagggcaatcagctgttggccgtctcactggtaaaaaaaaaaaccaccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14215 - DNA, 1496 bp, Oryza sativa
aaaaaacatgaaagtggtaccaaatggactaattaacagtcctaatgacatattatagcgggtatgccgattgggtggtaaaaaagttgaggcacgtgaatttgatggtgaatagtctaaattctcactaaatcgttggtattttgaatagtagtttggctagtgtttagtttgctatcaaaatataccaataagacacataaattgctaaaatatttggcactatcaaatttacctatggtttggcattattaatattttggcatggtagcaaacaaaacaagtcctatgtctttggctgattgattagccgtgtatggctgactgattgattactagggtgtcctcgatgatcaccgtgcttaagctgctgtagcctgtagcagagggcgatcattgtcgctagtcagttcgtcatcagaaacgcggaggggagaatggacggacagcgttggatgcctcccctgggaggcaattaggcaaaagcttggcgtctcacgcgatgtttccgcgcacgctagcgtcttccggattggagtttgggctctcctgatttgttgttcttgttgtttttctttgatcaggtgtatttgagacgcctggtttacggcagagaggattgcttcaggaagcaaacccgggctgctgcctcacgccattgctttgcttcaagagggcgtatggtatctacgtagataaatcataaatggttgtatttatctcgtcgtaattaatgggtgaaattggaatctctacttgtttaggtacttcagctaaaagatggaaaaaattctttcgtaaaaaaaaatgatttacagaaatgcacagtacagcgtgtgttctagctacctgctttgagcctgaggcccccgttgttcggcttattgatggaataagacaaacggcatatttataaatgaaagataatttgtgaatagaaattttacatacgtgttcttagcgatttaaaattaaagactgaaaaataaacttcgataaaaaaaactcaaaattaacatcaaatttaaagttaaaaatttaaaaattagttgataagcataagcattagcgaagaaatgaggctgttaatcttacccccgcgtgcaggggagggacgttgtatggtcttgagctaggcatgctgaaaacgccagaaatcgagcttagctcctcatgatcatctgaaattgagctcgtgcagtgagggccacccatgtgcatgagagaagggtcgcgcatcccatcacctcccttcagagttgaaaatttcggtttatttccctttaaaaaaattcggttcaaaatattacaataagcaatcaaatatttatcaaatttgaatagcttgactatattaaaaaataaagaaaatctatgtaaatttcggacgaaatagtgtcagccgagagaaactccccgaaatgttgaaattggactacactgtggtgcaattgtaagtactagttttttcttttaaggaaagagtatttgaggtg

SEQ ID NO: 14216 - DNA, 14570 bp, Oryza sativa
ttgctctgcggtgcgagagcgtctgcctcacctgcggcttatataaagctcgcaggatggctgggggtatcaccgccggcggccgggccagcgagccactcaccggccggcaggaatggtccgggctaaagtggatttcaggtatcttttattctctctctaccccattgccgctgtggtcaaggaaagagacgatggagatagccacgacgaaagaggagggggagagcatcgtccttttgctttagaggcggtagcgtgagcagtgaggtggcaatggcgaacgcggccgtcaccctcgcccaaagctaggaacaaaataaatgaaaggattggaagagatagagttggtcgatcggcctggcctcgaatcctcgatcgactatggattctctgtcataatatcacgatcattatattaattgatctatgctattttttattattttatatgttaatgtttataataatagtattactataatagagaatgtgaaacccgtatgagtctctgatgctccaagctcgctcggtgtatgtctttctgctcgatcggagtggacggcgaaagcggcgcgaccagatgccgatcgatgcgtgcgtgtgcgcgaaactcatgcagagctaattaagagctagatcgatcgatcgatcaatgtggtcatttctatgggcatgtgtgccatactgagatgttcgtatacgtcacatgaacaatgagcttaatttgtgtaggtaacgtacaaccacaattaacgtactacttaaaaaaagtgatttttctgtatgaggccccctcatttttccatgcggaccataactagtggcgtctgtaaaaatcgagagtcatttttccatacggttgcttaagtggcccgtatgaaaaaatcgattttcccatacggacctattaagagggccgcatgtaaaaatgagctcatttttgcatacggctcacataagcgccccgcatggaaaaatcgatttttccatacggaccacttaagaagccgtatgcgaaaataaaatttgaaactagtgtatctcactcatatgaactccaaattgaataatttttttctaaatgtttctaaaatcatgatagaatatcgtgttcttactggtattattttggctgttttttcttatgactttgttttatcaattaaaattttgaatttcaaaagttcaaataatattttgaagcagtaaatgatttcatcggaaaaagtcatcaataacaaagttatataactcatcaagatctataacttctatttttgacatttcttcatccgacaaagtgattttctttttcagatgaaatcattttcccaccactttaaatttttttctacctcatctcctctctgcccttttaattaatttattacactcccctctctctctctctcctctctctccctctccctctctcagagcagccgggcggcggatggcgacagcgtcgatggcgtcggcgggtggcggatctggcggcgctgccctcaggagggccggatccaccgccatagggagcggctacagcggcggcgggcggcgcgtctacggcgatggctcggcatagcagctacagcccctgctccgtacgtcgatggcatcggcgggcggcgtggctacggcggcgactcggaggcccgccacccccttctcaccgccgccgacaacgacgacgatgaggcgaccctccccccctcctcaatgccgcggcggcgggggcggctaggccgccttgggtggcgccgccgcaccgcgcggatccggcgggggcgacgacggcgggcggcggaggagacggatccgccggcagcgacaacgctgggcggctggggcgacggatccggtgccaccgccgacggatccggcgggggagacggatccatcgccggcgacgacgccgggcggctggggcaacggatccggtgcagccgacgacggatccagtggggacgacgacggcgggtggcaggggcgacggatccgccgccggcgacggcgtgcggcatggatgcgtcgctccggtggcgggctagggtttgggatttttttgatatttatttttttggggggttttttggattttattttttttgtttgctgaatttattttcgcatgcggccgatataagcgaccgtatgcgaaaatcccatcttcacatgcggatgcgccggccacatgcaaaaagagtggtttttgcagacgatttcgtccatgcggttggggcaaccgtatgcaaagatgcttcccaaccgcatggaaagagcctttgtgtagtagtgacgagctccactctaagcgcgtgttatgatctaattaacaacatgtggtcgagttagggcgtgtttaagtggaagtgaaaagagaagagatgtaagctattagcgtatatatttaattatgtattaattattttaaaatttaaaaaaggattaatatgattttaagtaaatttttgttgacgaaaaaatcgaatacaccggtctaggagatctgcttagctcctgtgcaggtccaaagattaatgagatgcaggtgtgccagtcagtttgatcctgcaactgacaagatttgcaaataatagatcaaacactcaatcggctgacaagccgatggagtagttccagccgatagccgataatagccgatgccgataccagccgatagcggtagggtttaagcaatcggctatatgtccaatgtagataatgatataaaggcaatcggctgatgataatataatatagcaatataatccagtagaaaccaatcggctaacaatatgaaacagtaaaacaaatattgatccgatggttaaagcacatatcggctggaggtccgatgtcacaagatccacaagattagattaaacagtgaaacctttgttgtcatcggctaaatcgaacttatatgtattgcaatccttatgagccgatgcaacgtccacataactcaccggcttgaaaccccgatgaaacccttattggcaatcaagaagcaggctagagattatggttctaagcacgacttagtagatcaaactcaactgatgcataactaagtatgaaaagaaacataatatttagacaatcaaaccgttgactgagttttcagggtggtagatgtctaagctaatctaatctagcaacgcgatttagccgataccggcagaaaccctaaaacaagaagcagccgatagagctaaattgatatgctaggactatattaacagagacatatgataaataggtagacaaatatatcatccaaaccagagcaatccaagtggtcgaatgtactgatgcagccttgaacgacgccgacgtagacgatacaattgcctggaccgacggaacattagacttaccccttcgccggagatcgaacaccgatgcagccccgcgtcaggtgccaagtcccgccagatgataaaataaagtagaaaaggtaaaaggtggcgatgcgccgaattgtattgatcgtagcgattgatagattacaatgaccccgggtgtacatatttatacccatagggagatactagttcttgtcggacaagaaagaaactaaaaaggaaaagataaagtccttaccggacactaaacacactttcctcaagataaaaggaaactaacaaactatacctaattaatagataactgtcatgtcgcatccttcttgaactcgaactcttctagataagcttcctttgattgatccgactccaccaagaacacgacatcgtggcgacttgactcccatcgactgattctagaactttgaagccgatactgactctaagccgatggtaactttgggcttaccaaatttcactgttaacaattttatattattttttaagaaaaatacattgtttagcaatttgagaagtatgtgaaaaactagagaaattttttctctttcaacctcactagaacatagccttaggggagatatatctgaatctgatgcatgttctgtgtgaatcagaatactctaccttcgaagtcacgtgattttatccttgacatatgaatctaatactgaactatgggggttgacaagaaaaggagtaaactgatactggttgaagcttctgccatttgctgggctttatggttgagtagaactgatttggtttttaacaaatcaccatctattttatttatgcaggtaattttcagggcaacgcactggctccggttttgggcacagctgcaaaggtgtgaggatgatgcggagttcctaaaggttgcatgccgcaagttggagtcgatggttatgcaactatttgccaattatgaatggaggttcataaatagacttcaataaatgtgttctctttattttggcttagtttcctctgtttttgtttggtgtgttctatttatctgaactacactcttggatgctactgtataataattggttgtagctcttttttagcaaaggctgggacgttaaattccattatataaaaaaatatatgaatctaataaaccttggataatccacatctgagtgataaaatgtacggtgactttaaagatagaatatctcaatccattttaagagggttttatgtctaagtgcctgatctcacgaccatccatcaccatgtaattcagcctgacatgcatggtgacgataacacacgatccacgatccttgctgcaaatgtacggcgaagaccctgaccgtccacgtacgacgatgttgcgagagaaaggttgaggtcggtgatataatgtaattaattaactaaattaaagcataagcacttgagcaatatatagatcaagattataggaagcagctacgaaatgatcgtagatggataggatgagaggaaagtgcagggagatgactgcatcgagacgctttacgcgcatgatgaccgatgggtttgtgtgccatatccattccatggatcaacctgacgtgtaacgtgtaagccgcgagttctaaatcaatttctgacgaacgcactggcgctgattagcgccgcgtggaacaaccgaatcctttgcacaaaagagaccgagaccgactggctaattactttttgcttaactgaacatctgctgatcgatctgtggctacgacggtctaccatataccaactttcagcatgatcattacgatatcaaaagaagaacaaaactagtactgtcctgtactaagctgttaggagatggagggaaggaaacacacctttttttaaaaaaaaatggaaaagcatactagtgtcattgaagacatgacccaatccatttccgctaaatgacagtccttccatttttagtatatttaaacatgacgtttgaatatttgtcttatctttaataggaagattaatataagttatacttaaattatctttaatgctaaaacaattcacaataaaataaataatactgaatgagatgaatgataacatcgtgtcagaagtgataagctggcaatatcatactccttccgttcaaaaattttaacttatagagtttaaattttgtcccacaaaaactaacttctaccatcatacatatccttaacacgtaaaacgagaatctttatctcttcaatactctttatctacttatcacttttattacttttttttaatgattaaggatattttagtcattctcactctccactatttcaaacgagaagctttatcccttcaatacctttacctacctaccactcttattacttttttttaatgattaaggatattttagtcattatcgctctccactattttcattttggaatgctaggaatggttttttttttacggagggagtatatatttaaacggttgcagtactctacaacagtgcatctcgtgtgagatttcagacttggaactaaacaagtgatcctagtcaggcttcacctcagaccaaaagctctaaataatttcattcattattaattcgtcaacaagaacagaactgtcattgcagtaagatctccagaagaaatatccatcaagtttaattaaatcagtggtggtgatgctaaattaaagcacatgcatgcatgcccaaattaaagaggataaacacatatctacttagtgacatgatgtcatttatctagtaatcttatgatcttatctgcagtactcacttctaggtataaagtaacacagtaagcatcgcaggaaaacgatggaaagcaaaaaaggaaaaccactaagtgctaaagctaaatctacctacgagatcaaaggggattagctgatgagctgatgactcacccacctgatcggctgattcacagatctcacaaaaggacggccatggtgtggcatcttttaattatgattgggaaattcaaacagaaaacaacggttgtcaaattatccgagagtcaccggcgtccatggcgaaccagcttcgagcaagagatcttaatttcatcagagattcagagagacacacataccaccttaattaacacagctgcagctaagctctgttcagatttcagatatccctacatgaacccaacaacaaaattcgcctaattaagaaaacatgtgctatcaggtctcaagaaaaaaaattaatcactgaatacaataatttcttcagtagtttcatgcttttggcaaccagatatatatgtacgctcaattgttcatgtcactccaaattgacatatacatgtataatacacaaacatcttcagcttcaggcttattatggcaaccgaatatattcatgtgtcacgtacgtatatatacatcccataccatactgtccatacagtatatgtacacaatacatgaacaagagcgtgttaggatcgtagtttctccattaattttgccatcccagatgagcactatgaaaaaaaaacagtagtacaatctaacactaataccacttgcagagttgcaggtagaccagaacaataatctccggtctccagcaatggcagggcgcgcgatctcgggatcgaaccgaatgagctacctagctagagagcctagaagcggtggccggagacgacgaggccgacgccgtcgtcgaagttgcgggagtagctctgcaggtcgtacccgaacctcgccgccgccgcgccgccggcgtgcctctttgacgacgaccgcaacctcgacctcagcttccagtacagctgcctcaccggccgcggcgccgccaccgccgacgacgaccgccgcctccctgctacgccggcgcccttcgctgtcgccatcctcctccggctgccgtacagtccgtccagaaacgccatctcttctcactgacaaaattaagatcactctctcgatcgacttgctgtactcgagatcaaacacaagcctaggagtttttgcaaatcttgtttcgccgcgctgctgtgagctaagctagcgtccctcacctgcggcttatataaagctcgcaggatggctgggcatcatcgccggtggcggggcccgccggccactcaccggccggccggaatggtccgggctaaagtggatttcaggtatctttttttctctctctctctcccattgccgctgtggtcaaggacagaaacaatggatggagatagccaagaaagaggaggagagcatcgtagatataggctaagccttttgctttagaggtattcctccgtttttaatgttacaagacattttaactttgattaaaattaaactgctttaagtttgactaaatttatagaaaataataataatattttcaactcaacataaatttattatgagaatatattcaattgttgatttaatgaaactaatttgttattataaatattactatatttgtgtatagacttagttaaatttaaaggagtttaacattgatcaaagttaaaacattttataatttaaaacagagggagtagctaattaacctaggtagcgtgagcagtgaggtgggaaatggcgatcgaacgcggccgtctccatcgcagcataaattaaaggagagcaaaagctatgttgatcgatcggaataatcgatcgtttggagatagatcagtcggcgtgtcgaggcgcgatcgatcgatgctcgctgccgtcctgaaatgttgtagtggacggcgaaagcggaagcagccagatgcatgcgtggatacgtggccgagatcgcgatcgaactgctgccgaattgaaatgttgtgcgtgaaacttagggtttgaaagtccggccggaatgaaatttcggaccccatacattattatttcggccgatttttttaatttttttaatttgataatattttgttcaaatttgaccaacatttgttcaaaatttcagaaatttcggatcaaaattttagaaatttggtatatccgtgacctccgatagaatcggtcaaaccgaaaaattaaaccccgtgaaagatatctatgcagatcgatgtagtcattatattcccggccgtacgtaggcatctgagcgccactagctagcgtctgaggcatattacacatctacacgttttacaattgacacagcaaaacgtgggggaaatataatgtcacatgaacaatgagagagcttgcagctacagtgagggttgtacaatggtcgagtttaggcgagatatctggatgttgccatgctacgacagggcttaatttatgcccgtttggctgacatgacggtgtggccgtgtctcttgttcaaacgacgacaatctgtgtgttcagttcagatatcgcgtggtcggtcgttgctgcgaacgaatgcactccaaacagggccgtgcacatgggcatgcggcccatgcgaccgtatagacctccaaatttttagggcctcagaaaatcagcccaactgaataaggcccatgcatttgtgtgaggccagagcgccataaccctgttcgagtccgcgcgtgtctccgcgcggcgacttcgcgtgcgtggcgcttcgtattctcaactccgagccccgagaccccacggcgttttgtattctctttcgtttttcgtatctgtgacttattcagttcgtctcgagtctcgacgtcttgtctcctccgagcagcaagccaccagccggctcatccaatttcaaattttcattcaaccagcgaatagcaacttagcaagcaaccaacaagtaaggcactaggcagcaagccagcaacaacaacgaacattctccattttcaatttgacagtttctgattatgcaaaacaagtgataaaaaatatactattcttgatatatcgcatttgctctgcagtatatatattattttagttatagtttgaatcctcacttagtgttttgtacagggcctacaaattaaacggcccggccctgacttcaaacagctagctaggaccatggctgtccacgttgccgaacaagaaaggttttggtgatgaaactgaattagtacagtaaagcataactgcataagcactctgcactcgttggagcaatatgcatgacagacgatgatatataggcagagagctaggaaagacaatcgcgatgaggaggaaagtgtaagaaggtgactagggttcaccataccaccggtaaccgcgtggttaccgcagttaccgggtttaccgcgtttaccggggaggtatggtaatgtaaataccgcggtaaccttcttaaatttaaaaaataatttaaatttttgatgaattttacacggttttttacggttaccgcgataaccgtgcttaccgctggggcgcggtaaccctggccccggcggtttgggaaaccctaaaggtgactgcatcaaagcgctttacgcgcgtgattgaatattgatggatggttactgcttcctctggccggtgtatttgacgtttagggagaatctatctatctattatattattaaacagctttgaaaggaggcaccacgttcgctgtggaggctagaaattcccacattaatcggagaaaaagaaaaaaaagaaaaggagagtccaagtagaaatacaatttaaaaaaagctgaaattcggaattaaaagtaagcaatattgaaagaagtttctatataggaacccaatacgagattaatcaaaattcgaaataaaaataaaataaaatccgaaattagcgaaaaaaaagagtctaagtaggaatacaatttaaaaatagctgaaattcggaattaaaataaggaatattaaaagaagagtccatacaataacccaatatgagattaattaaaattcgaaataaaaaaaataaaaaaatcgaaattagaaaaaggaaaagaaaagaagagttcaagtaagaatataatttaaaaattaactaaaattcagaattaaatataagcaatattgaaataagagtacatataagaacccaatagtagattaactaaaattcagaataaaaaataaaatataatctgaaattaggcaaattaaaaagagagttaaagtagaaatacaattttaaaacaactgatattcaaaataaaaataaaaaaatctaaagaacacaatacgaaaaataaaataaattctgaaattagaaaaagaaaaataagatatcagctagaaatacaatttataaataactaaaattggtgataaaaaaataaagattactaaaagaaaagaccatctgaaacacatgacgagattaattaagtaacatgcctatataggagaagagtggtggcggttgatgggacatctaaaaactattaataaaataccaaataaaatcctaatgactactaaaaagaagtacaacgggcaggtcgtgaagcaatcggtcaaggcgtttggcgggacttctagaaagtaaaaaaaaataaacccaatgataatcatatttgatttttacgttcactgtgggggctagaaatttccacattaatcggagaaaagaaaagaagagtccaagtagaaatacaatctaaaaatagctgaaattcggaattaaaagtaagcaatattgaaagaagagtccatataggaacgcaatacaagattaatcaaaattcagaataaaaataaaataaaatccgaaattagcaaaagaaaaaagagagtctaagtaggaatatcatctaaaaatagctgaaattcggaattaaaaataaggaatattgaaagaagagtccatataggaacccaatacgagattaatcaaaattcggaataaaaataaaataaaatcggaaattagccaaaaaaaaagagtccaagtaggattacaatttaaaaatagcagaaattcggaattaaaaataagaaatattgaaagaagagtcatataagaatccaatacgagattaattaaatttcggaataaaaaataaaaaaaatcaaaattagaaaaaggaaaagaaaagaagagttcaagtaggaatataatttaaaattaactaaaattcagaattaaatataagcaatattaaaatataagcagagtagtggcagttgatgggacatctaaaaactattaataaaacaccaaatacaatcctaatgatgactaaaaagaagtacaacgggcaggtcgtgaagcaatcggtcaaggtaggtggcaggacttctagaaagtaaaaaaataaacccaatgataatcatattagatttttaaaatctcaataataataaaatgagaggcagcggccgggtcgtataggagtacaatggcaaagtcgccgatggttggtgggtcttctataaagtaaaaaaaatgaattccaatgatagttatgtttgacttttacaatcctaataaagagtatgcggcggacgggtcatagaggagtatagtggtaacgtttgatgggatttctaaaaattataaaataaaaatgaaacccaacaagataataaactccaatttttaaaggttcgggcttctaaaaagtaaaaaaaataaaccccaatgataatcctgtttgattttaaaatctcaatgacaataaagaagggcggcagcgggtgagccgtagagtagtatagtgacaaagtcgctgacgttttggagaaacttctagaaagtaaaaaaataaacctaaaggataattatgttcgatttttaaaatagcaatgacaataaagagaagatgcaatggacgaacatagatgagtataatgatagtgtttgacgggacttctagaaattataaaaaagatgcccaataggacaataaactctaaaacatataaagattctaaggagaatgaatagaaaacggtggtagatcgagcaagcaaataaagaataatatgacagaagtaaggggtagcagttgttgtgactttagaaactaaggaaattagaaacacgaggataataaggtttagtctttaaaaatcttaagacaacgagataactatttaataaatttgaagtaaaatcatattaaaaatatataattttatatgggtgctagccgcgcaattgcgcgagccacccagctagtttatttttaaacaaagaaattcagaaattattggtggccaaagttttaaaattaagtttgattaaatcctattttaaacgttaaatatttataacttttagagggagtacgtcctagcgtcctactaagctcaagctgctagctatgacgtaaaaacacttctgtttaattatagtgctatagagtgataacataaccacacatcaacggtcggatttcagacttctggcaaaggaattatacgcagctagtacaactaaacagttccaatttcaggccaattgctgctggatactgtttgaggcctagtgcctagcttttatgttttgttattcgaaacctatattgcgagcttaaatactcagactatgtatctttggggctgcgtatatcctgctgcaggatgtataggtcgggttttaatccattattaaaaaaaattagttatattcattcgtcagcaagaacaacacattcagccgttgcagagtgtacatatctgcttagtgacatgatgacatttatctagcctttccttacgatcttatctactcataattaacaaatttctaggtcgtagtagtgagcatctcaggaaagcgaaaaaaggaaaaccactaagccctaaagctaaatctagctacgagatcaaagtgacattagatgatgagctgatgactcaccgacctgatcggctgattcacagatctcacaaaaggacgacggatggccggcagctttaggattaggaaagtatagttaaaaagcacaagtcaaattatccgagtcacttggcgatcagcttcgagcatggcgatcagattcgagcatgacatctttcttaagctcatcagattcacagaagctgccaccttaacagcaacatttatatctgatcagatagcaccacatgactacaacaacaaacaatagcaatggtgctagttaatcctatgggatttgtatgggtttttttttaccaatttacttatgcattatgcaggatctgtatgcattctatgttctaaacagatcattaaagtttgctaaagcatttatctggcatgtcatatatgatttcactttttttgaatctctcattttcctctgagcctgttggacggaccgagattggtgcagtccttactataagccctatcattttgcttattcgacgatatatttacaaacaaaaaatagtttgtgaataattttttattgtatatgttcttaacaatttaaaagcaaaggctaaaaaataaactatgataaaaaatcataaaaataaactttaaatttaaggttaaaattttaaattttggttgataagcataagcataagtgaaaagatgaaaccatataactacaactttagcagttgcaccgcaactgatggatcaaaaaccaacggcttagatcataaaaaaaatattgttcatgaattactgtagcaaatctacaacggtgttgctataattatgtcaacacattttgtgagtaatcacagtcgatttcttgttcaattgatctcccttgagattcgtgctacaattgcaataccatgtgcattgaacgtctttacatatttcgtgttgcatcgtgaagccaatcaatttaaatttctcatctcgtcagcatgtgttttcatgaaaaaactactacatatataatttcaggacttagatatgtaattttagaacttacattataaatatactaaaattacatatgtaatttagagacttacatatataattttagaatttacattgtaaatacactaaaattacatatgtaatttagggacttacaatgtaaatacatgctgactattttttggtgaaaaatatggcgacataaatataaatatagttactcccaatctacaatgtaccgattactgtagcatcgatggtgcggcatgatggcagagcaaatccgagccgttggttccatcgatccaacagttattatgtgctccttgcagtcattactactacagcaccgatctcagttcctctcgacactgatggatcattcacatagccaaagccactttagggctaagtactgttcctagtaatctaggcccaattaaaactctaacattagca

SEQ ID NO: 14217 - DNA, 30563 bp, Oryza sativa
aagaaggtcatgcccgccgtcatcgtccgccagcgcaagttgtggcgccgcaaggacggcgtctacatgtacttcgaaggtacgcggaagctgcacccaatttcgcccatgccgatctgtgaaatcgtgatgctctctagtgtcttgatgattagtgttgcattatgacgtgttatgagctgcgttaagtttggtttctaagtattttagtgtgatcttttagtccacctgcataaattagtgtcaatttcattatgggttacacgatttaccatattgagaatgctgatcagttgtggctgctacgattggagcaatgctctatttttttatgcttacgtcattacgtgattaagttacacattcttatgagctacagtgagcttgttttgggggctaggctttaggttgattttacttgaactatcatcaaatctaccagaaaacaccaaatatgttagcaggttttttttagtttggtgaattatttttaagcaaaaatttatgtgtttgcttattgtgagtttgtaacatggcataaaagagggtacaaatattcttctatattttactgtcttcactaggaagatgttttagatggggccttttggttgggaacatgatctttattgcctgacatggtgctggtcctacttttaataactatggtgttctcaaaatatttttcaactggaagatggctggcattacttatctgattgcgctgtataggccaattgctgaattttgttcgttggagcttgttctgttattttatttgcactgccgtaggaaatacacagtgacgggaggactgcaaggttcttcagctttttctggagcaaacttatatacatgtttgcatattcctaagtaaacgtcacaaacaaagcattgttggatgtagaggttttcttataaagattttatcttcataagagttcctccatctggaagcggtcacatattccattgccctaggtagtggcatcgccgctatgaaactttgggactggccatgtgacatatatttttgtcttctgatgccataaatataatacattagcttttattcattctacatgttttgtgtgcttttattctttggtctcttttacattttgagcagcatttcatttgtacactattcccttggctattttgtcattggttttatcatttggagctgccatgtggtctatcgaattaataccggttatgaaatttgatgtgcagacaatgctggggtgattgtgaatcccaagggtgagatgaaaggtatggcgagaacactactatactcccatatgttatgtgttattgtattttctctcgaagcctaccaggcaataatttactcactgtgtattcttttccaggttctgctatcactggacccattggtaaggagtgcgccgacctctggccaaggattgctagcgcagcaaatgccattgtctagagcttgtttggagtagtagttttcagttctgtgccggatgtgataatgtgctccagttcttttttgtttccaaccaagtttaacctgaacttgaagcaaaccttcagttaaattttcagtgcggattgtgtccttgatgaatggaaaatggcatgtttgcttgtttaccttgctccttttaatcagttcacagtcagcaaccagatcgtattctggagaaactagctgaatgaacatcaatctcacctttctgccacctgaagctgcctgaagatttaggctttgttctatgcttccctacctaatctctactcgctcattttcaatgtgccgctgcacaacctctgcgatcagcgacggcccatttgactcctttctatgtacgttctgacgttatgtgatgttctaggatgatttcctctggggttaattggattcatgccactacaaatatgctaaattagaaaaatagcactactatttgtgatatcggttgggtgccactagaatttggagaaattagaaccgtgttactccgttggttttccatccactcctcgttaatttcccaacttcagtgcttggcctcgatgcggcagcgaaggaacttcggtgcttggcctcgatgcggtagcgaaggagctcggtggcagggaaagcgatgacagccttcaagcatgacagtgacaatgacgtttcccaactctggcggcgagcggagcttcggcgacgagcgactagagcggcggtaacttgggtacgcggggaaggcggcgctcggccttgatgtggcgaaggagctcggcggcaggaaaagcagcgacggccttctccgctctcaaggggcacgatggcgaagcacgccgagagggcgaagcggcggcgacgggccatggctgtgcgcggcaagagggcgaggtgatggcgaagggtctctaggggcacaatggcaaagcacgccaagagggcgaggcagcggcaacgggccatggctgtacgcgggcggcgagaggtcaaggtgacggcggcgggtctcaagggggatgatggcgaagcatgccgagagggcgaagcggcggcgacgggccatggttgtgcgcggccggcgagagggtgaggtgatgccggcgggttgtgactctgtgtcggaggggagaaggagaggcggcggcggactgtgtctgtgagtgggtggcgagagggcgaggtgatggcagcgggccgaggctatgtgtaggcggggagagcgtaaggctgcgccggttagtggggcgagggcaaggcggctcggttgtgcagggaaggcggtgctcggcctcgatgcgcgatggtgatggtggggagtttcgacgatggtggaggagatggcagcactcggcacaaacgaaagatggtggcgccaatggggagtagataacgcgacggagtggcatggatccaatttccccaaattttagcggtactagtcgatatcacgaatagtagcgatatttttctaatttggcatatttgtaatggtgaatagtagcgatatttttctaatttggcatatttgtaatggtatggatacaattaacccttttcctgtagcatagtaagagcatcactaacagtccttatattgttcccaaaactgatttttatgtttttaaaactgatttttatgtttttaggtgaaaaatcggatccaacataaccccacacacgttttagagttccttcaccatactgattgtaagggttttaaagtgaaaaatcggatccaacacacgtttcagagttcccttcaccgtactgattgtaagggttttaaagtgaaaaatcggatccaacagatcatctacacacggatataacagaaccctgtttcttccaaaactgattttaatggttttaggtgaaaaatcggatccaacatatccccacacacgttttagagttcctttaacttactgattttaatggtttttaagtgaaaaaatggattcagcagatcccctacacacggatctaacatatctcagtttcttcgtgatctattcttataaaatttaggttttctatgagagagatcagtttttttttctattttcagtttagaaaaccaaaaacaaaattttctattttcaatttagaaaaaaaaattgggagaagattattcgtaatgtcttgatgatgctctaagttcctcttgcgtaattttccaatattctcaatggatgtgcattgttacgacgataaatggtaataactgttaaaatttctgccaacaggattttcaaaagattcagcctttggtaaggaatttcttttttttatctgattctttttttagatagtcgtgtttttagatgccacagatttcattggtccctcacttgtatttcctaatgaagtaatgatatatctggagaacttttgggtcatttttttattttttatttgtgatctttttgggaccttaattagttgattgtttgaatcaggcattctgtgtaaacaaggtttgcataacagttttattcggtgtgcttctacttagcttaattttattcagccgcttatattttgactgaatagattaggtttcttgttcccaattacacgacatgtagaaattactttgacacgcaaaaggtttgcgcgttcgcgaaaaaagacatatagaaattacttcatccgtattcaaatatatgatgttgttaactttatttagtttgttttcagaaaagaaaaagaactttattcagtcaaacttttgaaagcttgatcattaatagctctcataatatttagtttgaaaaataccgtatgtgtagatttttctttactggagcatttacaataatacagttttgttagatagttttgttgtattctaatttaaaaaaaagtactgctcagacttgaacactagagaaggaataaagtcaatagtataatatattcatatagaggtattataccgtcaaacatttgcaaatatatccttttcctttacaccctcagattgctaaaggcctaaatctatattgattttccctgctccaattttctcaaccgtttccaggaccacctcaaaacatactaggcatttcaaaatgccttctaacatcgttaagtacacacgacatttgtatctatacaaattatgcaaattaactctatctatttcattcacctgcaagaatgacaaacaagtgaaaagcagattgatatgacaacagaccgaccctacagcaactccagctgatcaacatacatcaaatttctacaaaattattcagaggtttgaagtaaaggaccggttaaatctgcacaaaatagggtggaaaaaaaaagaaaaagcaattcgagagagtttctcagtgctgtgtcgtatgagtttatatccaggattccactgtgtgattgtacatgtatgagctcatcccgctgatatgcgctagagcgtcagaatcaagcatgtcttctcccttcacgccgccctgcaaattcaagacaaaaaaaaaaggacaaaaagtcctcaaatcattgccaaatttcacttcgtaaatataatcccaagtttcaaaccgataatatcactttgttttaaagatttttttgagggcgttcttggcatttgaatgcttacaatttgttcatactcttcgtgattctgcgagccgatcgacctggatgcctcgcagtagtcgtcgttcttggcgaacctaccacggacgcgaggccggctatccgcgagggtttttctgcaagcgtactgcagattttttttttaaaaaaaaaatctgagatgtcagtaacgtggtcggcggtgaggtgaaattcgtttgaaatatgggttgggggggggggtgatattttgaatttgaatttgaataatttggaagttcttgcctcaccttgatcttcttgctgaaattcctctcgttcctcttcttgatgtacctgtggatcttttccttcctctcctcgttggagaggcggacggtcttgaagctcgtgtcctccaagctcgtcgtctcagtcgtccccgtcgccggcagccgcgctgggctactcccgcctccgcccatctgtggcaccacgaccaccatggtgaaacggtcatggcgtcatgctgcgcgtgcgcgagaggttcttgcatgccggcaatgtcctacctgcaactctgcggcggcggcgttgccgaaggccatgtcggcgccgtcggcggcgtgggtggcgccgagaagcgcgccgccgcattccatcatccgctggtactcgccgatctcgtccattcccatcatcgacatcaccatgcttccgccgccgccgccggccgcggcgaagaaggcggcctgcgccgcgtgcgcgtccttgctgaagaacgcctcgccggcggcggcggcggcggcggggagcatcgcgccggaatgctgctgctgcgggcagagcgggtcgtccaggcccatgtaccctcccgccccagctccggctccagcggccaacgccgccgcgaagacctcgtcggtgaacccggcgtactgcatcagctcggtggcggtgctgctcagctgcgcctgcagcgccgggtgctccgccgccgcgccgcccatcaccgggagaggcatctgggtgaattgctgctgctgctgatgctccggtggtggtggtggctgcgtctcgtcgacggcggagaacgcgtagtcgtcgatggggaggaggagctcgccgtcggcgccgggcggctcgtcttgctcgaggagacccgagagcgtggagtccagcgacgtcaccgacgacgacagggtgtcgcccccgccgacgatgggcgcggtgaccgtcgacgacgacgaggcggacgcgtcctccgaggaggccgtgaacatgtccgaccctgccgccgccgccgcgttcaccgccgcgaagaggtcgccgccgttgctgtcgtcgcagaagtcatatatgtgctgcgctatcgggctcgagatgccatcctgcaaaaccaaaaccaaaattcagacaaaacccatcaaaccaccaactcgtaaccatttctttcttcagaaaaaaaaactgtattcttctacaggcctgtgcaatgcaaacattcatcgccaaaatcctgaattgacaaaacggtgatttacagatttgtattaggctatttaaacccatttctatgattcttttataatctctttttttgcaaggaatcaaatgccatactgttgtatttgcaaattatactgttctatctgaaatctgaaatctctgaagatgtcaagaacagtagaggtataggtccgtatgccgtatgctggggggaatgttactgttaggatcaggcaactaatcaaaaattccaatgcgcaatgtcataaagctcgtggagattaggaagcagaaactatcaagtcgaggcatcgattcccatctgtactgcaagaggtccaaaaagcagaaagattttcgcaggatctggtgcccctttccgctttagtatgatagccacctaacaattattgctctagcaaaatctgatcagagcattagcatttgccaattgccattgctatggaatcctaatatgcatgggcaagcagaatgcaaaataaattatcagaccatatgcatgcagaataacaacagcagaaactgctgaaaacaaccatgctgaaactgactgaagcttgcaaataactgcagaattgagcctaatttgctttcaggagatttacggcgaaaggctcgtcgtcgacgtcgtcgagcatgatggatcttgcaccaaggaatgctctaaattgatactgagaaggtagaggctcatcaacggaatgggaatttgaagaggagaaaagctcacgacccatgctaatggcagtgtgttctatttataagcccatgaacaagaagaccaagcaataatccaggctaattatagagccataagagccggagacctaacaagaactagatgcgaagtaaccgtagcacttaattaggacaaaggacaaatatatttacatgtcacatggtgaaaatgtaagtacatatgcccaaagctaaagaagaaaaaaaaaggggaaaacacctatttttgtgcatgttctatgccgtaattcggctcctaacgaacaattaaaccgccctttgtctctccaagattagtttccccttactcctagatcagtttttgaccgagacgtcgtaattttcttttgcgagaaaaaagggatattgctatctagttgattcaacacatgaacacatgatcattaagagataacagtatgtgatatatataggttttcatttttttaaaaaaaaagaatgaaagagttcatggtcgcacaagatataggattccagttcctattgtctttctttgtaattctgttcgtttgcgatgtactcaaacacctcattacgtcttaatgatgcgtattcgccaaaaaaaagaatgtaagagttttgcctgatatattgtttttttatctctgcaatactgactcgatctcagaaattgtactccctccgtcccataatataagggattttgagtttttacttgtaatgtttgaccacttgtcttattcaattttttttgaaattattatttattttatttgtgacttactttattatccacagtattttaagcacaacttttcattttttatatttgcaaaaaaaattgaataagatgagcggtcaaacgttgcaaacaaaaactcaaaatcccttatattggtacggagggagtagttgattcttgtaggtacaatgagaattgctttgaatatgttattgatgtgcttatctctaatttgatatgctgattcaatggttcaaacggtgtctatcccgggtgaaattttgacccccttttttaaaattttcttgtcaaatatgatacatattaacttatcattgcttcatgaatccggaactaaaaggcggaaagcgaaaagacacactattactttagagacctctgcatacatgcaaggttggtcacatatctaactaagctttggatgtgcgtttatagatatttcaggagaactggatgccaaacgtcatggaaaaaagcagccaagtacatgcatgcctgccagagatgtatatgctcttatgtggcaaattggggctgtaaaatgatgattgatcaataactgtttgcatgcatgaagttgttctctatctaaaagaacaacctggtcattccgtacaaaaagaacacttcatgtaactgaaaaaaaaaatggataagaatagcaagaaactcaggtctcacttgcaggaatagcacacaactcttgcatgcagacatgcagtcatccatgctgtgaagcaaagtcgccgcggcgacgccaagcagatggatgcctgacgaaagaattgaaactattctgattccagactgatcgaatgcatgtctgtcagactgtcaggcgaagatgcacctctatctaatcccacagtgcatatgcatatcgatctccatttgatcatgttcaacgtagtgatcatcggttcgtcgttatatataattgaagtagaaatactagtatccaagttaacaaacacactctgattatttatgcatgtatgcagattttattttttgtgtgtgtgtgtatgtaaaactggcatgcaaaggagttaaaagagagaagttagaagagttacaatggcagaaggcagcatgccgatgaaatcctgatcttgaaacatcatcatcatctctactgatcactgcagaaatgatcactactgtctagctgaaaattttatgtatctatagtctatgagaaatatgtatatgactgaattgggtgaaagggctgagaagaaatggtgtatggaattcaggtgtgtaggagtagtactctgagtgaagtctctgaagtctgcaagccattcagaaggaaccatttgagtatatatagatcatatgagaataaccaaagttgtgtgtgtgtgttgtgggcgtacatggctatagagatttagccctagacgccccccaggctaggtaccatctttggcatctctgaatctatctctaagctagctgcacagcttgtgaaaaaaaatgttctgtccctgacggtgaacagtacgtacacgaaaactcaactgggtttttttcacactgctgctaatggggaatagtgatagtggagatctaggaatctgtttctgctaatgaaaggatggtgtggtatgatatgaggaagcaaatgcttatctgattctgattcaggccaaccctgcacacactgagatgtgtagttgcagtactggtttttctttcttttggtgacagtttgcaactttgcatgacctgctctgtctattgtcggatccctggctgaattttggtgacagaagttaggaaggatcgagtgcggagagttgactatgtcctctagaataatatacaggaaatggattttaagccgagatcacacgctcctttttcttttggcacgcacaacacaacaaatatagtttcggaagaaattcataaaccatggtttattgtgttataatctttccacaaacatgcgtgatcaaatctgatctaaataagcaaaaacagaaatggtaaatacaagtgccaatgcaaaatgcactttttatagtcaatgttgctatttttcttcatatgcagatcgaatttgaccttgattgtacgtcgaaggatttgcaacacaatataaagtatatatttttcaatttaaaaattttaataattatttgcttcacatacaataaacttagagcatgtgcctttgagagcttaaagccaccaacgtacaacacctcggagatatgctcctgtctctgagacaccatgtaccattaagctcgaagctctttctctaagaataagttctcatatacttttttgcttgttggcttatcagccgcaactaaaatttatattttagaacttaattttagaggtaattttaggttatttttcatctattctatttttagctttaattttaaaccactaataacatagatataagttttacgcgtaactttttttccttcgttcgtttttctatggcttttaaaccaacaacttgacacaaatgtgattcttccttacttagtgatagatcactagtgtcgtcttgagcttgatgtgagaaattgttgcattccgctctacccaaactaaaatggacatggagtcaaacacaacacttcaataggttgtgagtgacatgtggggtagtctctaatctaaagaaaaagcactaatgaacccttttagtgggagatatgtctagtaccttgtaagtaacataaaaatgtcatggtcattcctattttgtagagtagaggcacatgtacactgtaaacacatctcttttttgtagtaagaacaataaaaggcgtgtttaggtgtatgcactcctattctagcgcgtatgtcttatccatgctaggcttgacctgattagatgaacgcaaccatgcaagagaggttgcttagttggttagatcaattgggctaggattaaacgagattcaatttggttggttgcatgttggatgaagccgatttcgatcgtctcggtggttgcatctactgatcatgcacgggttacctcttccaagttccaacaggtgatgaggtatcactccaataaaaaaattggtcaactaggaaaattcatcaattctaaaccccttttctcaagttcccatggaacagtgtcgatgctaaaaaaaatgaggtcttctgttaagaatatgtcaatatacaaaagtaaatttcactttaagcaatgtctattgaattattgaccaaaatagcataatagataagggctagacccatcttttcaattgacgctaggaatttcgccattcgttgggaggggactccaccgccaatgctctttgctcaattcgcatgccagtggctctctatctagagtaggagagcaagcgatcaatctaacgctcctctctctagctatgcattgatattgaatgagtagtagttgcccatggctaacaacgaccggagctataccaaggaagctcaccagtcgataacggtggtggtgctaagcccaggaagaagaattgcatgattatacagcggaaagaaaatcgtatcttcaacgtccacagcgtgcatccacattatcatagtaaaatacaactcttttatatgacaatgattatcatcaaacccttatcagagccaaggaaaataagctaagttttagctgaacaagtggagacaggagatagaaacttcgaaaaattgaaataagaaggtcctaaaatatattgtaacacattggcatggattgaaataaacattgccctaatttgttaggcatgtgccatcacccatcttgcacttatcagccatgtcgtttggcatatgttgattataagccgtaatggcttatgagtgataaaaataattcgttatatatatatatatatatatatatatatatatatatatatatatatatatatatatatatatatatatatgacactaaaagctaatgctgaaaaataaactacaattaaaaaaatcttccaaaatcaacttcaagattaaaatttaaaatttaaatttgataatggcttgtaagcggaaggacaaatgatagggcttttagtttttgtaccttactgtaatttgagaaagtcactctatccaattgctcatactatggggctgtttggatgggactaaaaattttagtccatgtcacatcggatgtttagacactaattaggagtattaaacgtagactattgacaaaacctatttcataaccctgaactaattcacgagacgaatctattgagcataattaatccatgattagcctatgtgatgctatagtaaacatgtgctaattatggattatttaggcttaaaaaattgtcacgcgaattagttctcatttatgtaattagttttgtaagtagtatatgtttaatactctaaattagtgtccaaatatccgatgtgacagggactaaagttttagtccctaaatccaaacaccacctatagttgctagcttagaggcttgtgcgttacaatggaaaacaaaatcagtttctacctcattagatcaattaattagcatttatttaccaagtaatatgatgatttttcttattaacaagtaggtgattttgaaatttgaggagatccaatagtaaaataggagatgactcataaagatggtgtaatagtacagattaggggacccacatatcaatggtagtgatgatgtgggaaaggacacccactattataacattttaagtagtaaagagtatagatatttgaaagtattttttcaaaaaattgtggaaagttgtatactacctaataccattacatatagccagttttattatagagtactagtatcataaatatcagagtactatgcattagtgttcgacacctaaggcggtgcaaaatctgccaaagaactagatcaacgtgctgattaggcaggtgtcaatccatcgagaattcgatcgatcgagagagagagagagagatcgatgcataatctaatcaccaaatggtatgtaccgagcggagccccccgattcaccaccgttttcaccatcaccggctcacgtacatatagcagagtctaaccgtgcgtgccgatcgatgagcgcgagcgatatgatccagcgcccacgacgatcgatcgacatgccgctgctccagtgggggaatccggtcggccgcccgcgtctcgtcacgtcgatcacctacgcgaatactcctacgcgataccagtagtgtagtactaggcataagccgccgcacgcgctccctactcgtacgtcgtctctcggatcggtagctaattaagctagctaagctaggtagccgcggccgggcagagtagacgatcgagtagctgagatgcgaatgcatcgttgcggcatccggccgggcgggcgtttcgtgcggtcaccgccgtgagattactggcgatctcggggagatatatttgttgggatcctgggtagaaaagcctcggcccttttgtctacctagccaagcatctccagctaaatttagccatgagtaggagagtaccatgctatatggtgtaggagacctgcactgcataatatacatgagttcaacacactaatgagttatattttcaagcaataatgagttatattacaagcatatgtgtgttagagatcataacccggatcgaaggaagcgtgaatcaactgtacgatctcaaattaagctaatccatttcttcacactaggaacaaattaaaccattaattgcaggtgtactgtacacacctgcaagtgaggaaaggattaaggatcaaaggaaccacgtacgcgcgagatggatgcgatggcggcgtgtaatgtccaagattaaaaatcaatcctgtcagcaacacaacaacaattagcacccaaaggatattacattagtccatgagatcgaacagataaagctataccttagcctaccagacagaactaatgcccatcagtcccccaaaagcagcttcctccccctcttgtcacccccatgagggcttatcttccagcttagcttagcttagctttgccatagctagccatgcattgcacggcccgtgcacaacacacatccatcaatcgtgattcttcacaacgttcttcacaacgccatgcacgctagctagtacccttttgcaagtagctaggtagatacatatatacctctgataggaatcttgtatccgttcgtcaataggccaaatcgccgtgggccagctgccgactacactagctttttaccattgcgtatagtagcatgtttaatgcagtaaggcatacgtcgaacctgtgtttgctgtcgcctgccgaaacgtatagaaggcgatcgaaagtatggtgtctgagatcgaaagtgcaggagtagtgttagctttaccactagctatggaatgtgcataggccaaaccgggggatctgactgtcgccgctttgccgcaacaccggcacacaccgctacgtcgatcatcctcgcgcgcgattcccggatttcttccacgtagagaggccgggtagctaaggataatttggtggagaccggatgcaagccccgtcttctacagcccagctctggattattgacgcgtggatgatgtattgatcggacggggcgctccgctcggctccaggctcacccgagcccgatctatgcgcatgcggctgatggcgcttgatccgtcccggctcgatctgagcgtgagcggctcatgagcaggaggacgccgcctgcccgttcgccgtcaatcctcgttcaacctccatattgagggagtcgttgtcgctttctgcctccaccccgggttgccaccgcctaccaggctaccaccgctgctctaccaagtagcgttagatgtgcagcttgtcaccgtcggcggcgtcgaggagaagcatgcgccggactatggcaagaatgggtcaatggacacaagaagccatgacggccgcgaaggtggacatgggaaggaggttgtctcgtattactggccaagggaaagatggagaattacagatgttttggacattttcgaagctgctgctgtcgttgattgcaggaggtgaacatcgatcgaggagcagccgctgctccggctgttcttgaattcttgatggggattggggaagatgaagatgagcctgcgcgactgctgccggccctactggggagtggggatacgtcgagctcgtcaccacattcgaagataattgatgtaaaccaaattgtggctcaaaatcataaattgattggtgtcagtgtcagatgtgcatgccgatgctatgatgtagtctgacatcgttgttttgaattttgattttcagaacaacacgacgacacaccgcacacagcacaggctagcggcgagtacggtggtacggccaccgcgtgcacatccatctacaagctcgagctcccctcgccggcccgttgtcacgatgatgccgacgccgctgtcgccgccatcgagccgcgggaggccatgaacgtggattcgaaggcgtcctacctcatccagatcaagaaccccgagcagccgccatcctccgatggtcgtggcggtgacaagatcaagccgcgcgggcccagatcaagccgggatgggacggatcgagcctcgagctccatcagccgcacgcgcatagatcgggctcgggtgagcctggagccgagcggagcgccccgtccgatagtccgatcgatacatcatccacgcgtcaataatccagagcagggctgcagaagaaggggcttgcatccggtctccaccaaaattttttccggagccgtgtgtgcgcgcgagctgttgatgcggtgtgtttttctcgcgcaaaacatggtggaatcgcgcgcgcgcacacgcgcacggccggatgggggccggggccatatatatggcacggcccgatcgtgtactcatgtcggctcaaggccgtgcgccggcccgcgcgagcgtgcgtaggcgggagcggaaaagggagtacctatgcatctttcgaaatatttttataatcgtatcacacagatttttaatctttagattaaaatctgatagatataataaaaagcaaaaagcaattaagaaacaccataatggacactaaattaccatatcctcaagaaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtgagaaaatcgagtgagagataagaaaaaatctttcgtgtgagatatagcaaaatcgagcggaaaatatgtggacctgtttggtacagcttcaactcttaaatttagctctaggagttgggtctggagtggagttgtggagctgcctaaacccagctcaacaactctagttcattttgtgagagagctccacctagggaagctgaaactgtttggctgagctccagctccacccctgctaaacaggcccatacggagcactacgggtctatttgataaagtttcaactctaaaatttagcttaaatggttgggtacagagtaaattcatagagcagcttaaatccagtttcacatctcgttttgttttattgagaatgttccatctagctccgctttatatagagctgaaactgtttggttggactttagctccaaaaggcactacatctcgtgaagcctagatatcaggatggcgatgcggttcaggtttcagctgtgagagaggggccgtgtacatgtcaacatggatgcacaggatcagttgcgactttgtgcctttaggggtgggtcatgctgtgaggtgtcgatgcacatcgacagggcgagatgcagggaggcgagatgcatggtgtcccgtttattaccatcactaggtgaaactccgtgcatttctgcgagaatttagtatgataacaataaaaaaaataacgtgtaaaatagctatataacatcagattaagtgaattaatgtggtttatgataatttaaatttaaatagtatgtagaatggtgattcaaacgtaaaaagtaaggtggtatgactttatggaagaagaaaaatatggagatagtttggacagtagattaattatctaaaggctaaaaacaattgatgtgatatgacttaattagaggaaaaaaggagaagataatttggaccatagattaatcatttaagcactaagtgaggatgaactatatacctatatcataaaacataataaatatatacattgaaacattatgtgaattatgttggatgataatttaacatttttgtatttgaaaagctcttaaattataaaaactataaagatatagcatatttgcatgatgtttaaatgtgatgattgttagtggatgatgatgtggcatcttgttaattagtagatgatgatgtggcatctttgcatgttaaggttatggagttagtgggggataactttatagtaagataggattcccttcaagcctgtacgatgatactccttgaagatttttggctgtgttcggtagtttgggatgaaaactaatccctctcatatataaaacgatgtgactcattagtacataattaactaagtattagtattttaataatttttccatagatttttttttgaaaaaacacaatctatactctctataaagttacaacccactaactctaatgcttaatatgcaaccatgccacattatcacccactagcaataattacatactcaatctcattcaagcatgcaacatcatctacaatctatttaattctacaaatcattatgtatagtataaatccaatcatcacccctcacatcatttccacaatatttttacaaacctatcaatcattcttatgatatttaacataaacttatcaattaaagtgtgagttttatttgtttgtttcatgataaaaactgataagccttggtatttcatttattttttttacccctagcttgattgtagtgaaaatatatatattaaaaattaattttcacatcaaagcgctgaaaatcaactgtctttagcaaattgagaaccgtgcgtggggtagaggaggggagaagctgagaaacggtatcgtaggtaccgcctacgtagccgtgttcggccagatatttcacaagcctacaacatctatagcccacgaagtatttttcaggacccaaaatgcggcccaccaaacttagccggcccacgcagttaaagcccaatcacccaatggaaacggttcaacttgcgcgaccgatttcaggcaccgcgagtggaccacggcggaaggaggagccgcacaagcgacgagattttcgcccccgcttcggattaaaaccctagccggctaaacctgctccgctcccccccgccgccgccggcgccgccgccaccaccactgccggagagagagagagctgcctgggaggagcagcctcggtgcgcgcgcgcgcgctaatcccctcctccactctccgtcgccgccgccgccgcagccatgatctgcgcaagtaagcttctctcactgtctctccgaaaccctagctgttctctccgtgcgtgcgctgatttgtggcctccgcctgttgtgaagtctccggcgaggtgccggatgagccggtggtgtcgaagaagtccgggcttctcttcgagcggcggctcgtcgagcgctacatcgaggtcggttagggttattatagcttccgtgggtttagatctcgcgtcgcatttgtgtgtcgtgctttgagctgatgtttcttgtggtggtcatggtcgtggccatggcgcaggaccatgggaagtgcccagtcaccaaggaggagctcaccatggacgacatcgtggcggtgaagaccaacaaggtaaggcttcgctggaatgctgagaaaattattgtggagtggcaggcttcagcagcgtgtggcgtggatttacctatgttttgtacaagtaactgatggtgctataccttttagctgaaaaacttgcataatcctcaaggcctcaatcatgttatactatttgcaggttgtgaagcccagacaattgcaggctgcaagcattcccggactcctggggatgttccaaaatgtaagtggttccactaacttcatagttatctgtgttatagacagtgaagatctgattctttttctttgataatagttctcacattgttttgtttattaaatgtatagtttgttaatttaaaactgtacctgaaagtactttttatctgatgtttgaattaaagataaacacgttgcataataattgggaatgattcagtgttaagtgtctttctccattgcacaccagccagtttgacagaacttaatgcgctgtttccaagcatagtcaggttactagagggagtaaactaatcttcataattggagcttggcaaactgcctgctcattggttatgtttaaagcagattcagagattctgtggtagagttaaatttctggtctttgtttcctaaaatttgcatcgccctcagtttaaatgatctcatgtaactattaggaagagtaatatagtacagtgccttgattttgccacaaataatcatggaactaaaaatgtcttgtgagaacccatcatgattcaccctagctctcactagaacaataccatggcttttacaggagtgggatgctatcatgctttctagttttgctttggagcagcagcttcatacagcaagacaagaacttagtcatgcgctatatcaggtatgtcttttacctatgcagaatttctattacatattgtatcatgttaagtacaaaatcttcccttttcttttgacaaactatgaatgttattatagttctacatatgctagcagctttagctgatgaaggatctgctcagaggattttgagcttttccataggtctattgttggggcatgttagattgctatggaacagtgctctcttttaggaactctggtggccattttgtatttgtgtatggttagagcagatgcagtaggatgttgaacgtccttacataataaaaattcgaatttttatttagaaatgctacttgactcttgattctagatgaatttatccctgtaatcagcactgttgattcccaatcttgagtcactcttttgactcttgataaactaccccctccatccaaaatatagcaacttcacctattccttcatctcaaccaatcacacaaccatctctcatttaatatctccacatacttcctcatatccactaattacagccatacctcattaaattccacctactttcttaatctccctcaaaagctctagaaaaccttatattttgggacggagggagtatcgtctttcttcttcttctttttttgtatttgacatttgtcttttttttatcctgctggtgcttgtgccttttcacttatagtaccgaagatggctaatgatgatttacagattatttttccttctatgcttcttgttgtgcatatgtacaaggtatagttgttggcttatttcctggcactaatcctgtggtgaagtgggcaacaatgttagccctgatctgtttacccatctaactaaagttcgctaatctgcaaatgaccactagttttgtacgggcattgttaagttgactgttaaatatctatccttgttcctgctcctgttcgagttgtactgcaatttatattttcataagctgaagaaaaaatgcttataaaatcaatcattcactgaccagtctagaaatgtgtgatgctgttctgggttcttgtgcataccatataactggtgatatttaggttgtttttttgctctaggcagtctggtttgagcttgaaaacaatagccctgtttggagaactagccaaaagttattttgagagctattttttagcacaaggaaatagccctccaataaaatagccctaagttgtttggatcaaagggttattttgagagctatttggcctttaatgtagcttcccatggagagagatagagagaagacactttttcagtgggcccccacccgaaatagccccaattagcaccccttgggtgggatagttttttttgggtgggttatttccaaatagccctcaaatagctcacccttttggatctttttgggctatttgggctattggagggagggctaaaaaatatcccttggatccaaacagggccaatgaagtattattactgcaagttgatatgttaaaaaactacttgtaagttattgaggaaaaggtctgaagtaccaagctttgttaaggcattgcttgtctttacagctacatttttttttcagcgcttgattaaacagctctattatgggttaaatgctgaataccgttttaatgaaatgctcttttagttaacacttttgcttttaagaacattcattatcctgtaatctgatctgtttagttgttttatgtcccttttccagcatgatgctgcctgccgtgttatagctagattaaagaaagaacgagatgaagccagagcacttttggctcaagctgagagacagattcctgcatcgatggcaggagctgcacctacagctgttgtctccaacgggaaaagaggtacctactttctgactgtttgaagttgttgaagtaaatttctacatataatttcagccttctcatagttctgcattgttggattcagcatttgaagatgaagttggaccagacgggaagaagattcgtcctggtatcaaccctgtgatgattgatgaactaacagagtgtaataccatgctctctgcgcatcgtaagaaacgacaggtacatatctgtattcatagttatgctacaaacaaggtctaaaacatgcattaatgtttttatccaatagttaagattatctcaagaatgctagctcatctcgccaggacattatttctcagtgtttgttgccatctttacaccttacttttgaaatgagataacagttctctacattttctcacaggttcctccaactttggcatcaattgatgcaattgagagatatacccagatctccagtcatccacttcacaagacaaacaaaccaggcatcttatctatggatattcatccttcaaaggtctgtcttttatgtttttagtgtaccttgctttgaatatcatatactctgtggtcttatccttttcagttcaattaggtgtaagatttcacattaattgaataattatatcactaatacttctatttgtacctgcaacatgatgctctcctgaaaagcttggttcacatgtagtttgttttattttgtaatctgtttgattcgtcttggatttaatgttgataatttgatggcaaacggtgatttaaacacttattattttactttgttcttattctggattaacaggacattattgcaactggtggcattgatacaaacgcagtgctttttgacaggccatccggtcaaatcttgtgcacacttactggtcactcaaagaaggttttccctcattttattttgatgatttagatgcactcaattgatttttaatctatctctaaaatttatgttaacattggaaccttcatatatatagataaccagtttgaaatttgttcctcgggatgagctctttgtaactggatcagcagataaggtatgccattctctgatagattaattagtcacataaatttgatgcaataatcaagttttgattttgctagtaaaattgattgcatcatttcctgcagtacttgattaggttgagcatgtttgcagtcactggtccgactatctgatgattaggttgtgctgtttattcttctctgagttgtttgcaaattatgcagactgttaaaatttggcaaggaagcgaggagggaaattacaattgcatccatacattgaaagatcacactgccgaggttagcaattgcgtggatattcttctgcaaaataacttcacattctttgccattttatgtttttggatattggaattacagattgctggatagctggtattcttcttgcatgcatacagtcatatttcctttctgtggcttctaaatttctgttacagtaaaattgaaaatatttatgaaatttctatctatcaaggatttgtcacaaatatgattataacacattttggcatgttgagctatgatactcaaaactcaagtcatactgcaaatgcagttctttcatcaaattttctttatcatttgtaccgtaagctactctggtccattcatgtttcacagttacaaaacatgtgaaaatgccccaccattgtccttaaaggccctcttcacagttacaaaacatgtgaacatgccccatcattgcccttaaggcccttgttctttacagattattctctgcactggattattgaaatggattatttgctatatactttggaaaatacatcttctcaaaaaaatttcttttgctgcatttcttagataacttattttaagctatttattgagtttatttttaaaaatatttaatttatatagataatccatggtaataactcagtaatataaatcaaacagggcaacttttaccatattttatattgtaatatttcaattggtaatataaaatgtttcaattcaaattctattgtttcaaacttatttgttttacaaaaatctgtcaggttgaagctgttacagtccatgcgactcagaagtactttgtgactgcttccaaggataatacttggtgcttctacgatattccatcaggatcttgcctcacacaggtttactccattatctttctcatgtaacctgctcccattcatccatgtacttatacatgctttgtctgttagctcccaagatgtttatgagttaatgaataccttttctttactcaggttggcgagtcttcaggacaagagggatatacatctgcatctttccacccagatggtcttatcctggggacagggaccactgaagctgttgtcaaaatttgggatgtgaagacgcaggtgtgatacttcggcaactcattcaagttcttttttcaggtgttcatgcatgtctgctcttgaaataccttgctaacaatcatcttttttctctagtcaaatgttgcaaagtttgaggggcatgttggaccagtgactgctatgtccttctctgaaaatggttacttccttgcggtatgaatctctccatagtgcaatctgcaaaatgttgactttcttttttattgtgatatatgtatcatcactgtacagactgctgctctcgatggagtcaagctttgggatcttcgaaaattaagaaactttaggacgatatcaccttatgactcagacacgccaacaaattctggtaaggaactttgcgcatgctccacactcacagtaaattgtgaatggtgcatgtgcttcgatgtgtgtatagatatagccaacaagcgagattatgttgatcattcaccctagatatatcttgctttctaggattttgattgtagctggaaggacatctcattccatttttgttatttgtactggagttccattaatcatatgatgcatgaatgtttttttgtttatcttacagtggaatttgactttagcggaagttatctagctgttggtggttcagatacaaggtattttctcaaaacctgcaagtctgaccttttggtgcaaatgttataccgtaaacttttatatttgatacctcctctgtttggccttcagggtttaccaagtagcaaatgttaagcttgaatggaatcttgtcaagaccttaccagatttgtcaggcacaggttcgtccctttcttatggcccacattctcggttcgtgattggcatctgtgcttgcacttaactaatttggtttctgtggcgtacacttttctcagggaaagtgacaaacgtcaagtttggcaccgatgcgaagtacattgccgtaggttctatggatcgtaacctacggatatttgggcatccgggagaagatgatcaaatggacgacgcaaagccatcggaagagtgatgaaaccaattgtacttcatttggcctgcgtaaattgctccctgtttgtgtgttttgacggtggatgagctggctgagattggaggcacataacaacgggagacgagaagttccttgcaggagcaatttggtgggctttggtcgatgtaaacaaatttgacattgttattgtatttgtaggccttactacctaatgaggatacggtttgttttggagatgaatacaatgctgaagtgctcgacttgcggacatgccaatgaaatctagaatgtgtttaaatttgtggttacgtaatgtccatgcactaacgctcgtttattcatttctcaaagttgctggcgcgatattaaggaatggtttgatggttaactaattagtcgtctaatctgagaaatctggcagcatccgaattaccttgaacagtacatcaaggcagactaagtatattgaggacctttccgtgccaccgacaagcgtggtcacataagctcactgaaatgtgggcaaggagggtaaatcctcaatttcaaacaaaagaataatgaggactctcccgtgccactaacatgtggggtcataacaagctcaatgaaatgtgggccaggaaggtaaatccttatatgtgatcaaattttaattcaaagatcaaactatggccgttggatataaatcggatggtggatgaaatatgttctggcatgggctgaaattgtcgagtggatcagtaatgggcctcgtgtgggcctcaactaaaaccctaacaaagagagaggcgcagccatcccactcacagacacacaacaagtcgattcgatccatcccggaggatcctccgccgccgccgtgccggagcgccgccgccgccgccgtcgtaccggaggtaccactccctcccctctcacatagcagccccccttcccgtcttcacctaggtcggattagctcgtggtgctctccctctctcctcgttggttctagttactctggtggtttagggcgtagagggtgtggaggggatcgggttggttgattgcgcttttttttctgtgatgtttttccttctgtgctccgtatcaaatagattgaagtgataatatgtgattcttgtggaaatgggtatggttgaaaccgctatgtccttaagagagagattggtaaggaactctgaaaccgctgtgccttaagagaattgatatgaatatataattgaagtgctaaaataaggatagtttgtagctttctttctttcaaacagctcatcattttcagggtttcggtgctgatttacctttctatagtgaagtcccttgtataatgcagcatagaggtgacaggagacgatgaaagtactcctttctgaagttttaactcctgagaggcattagaagctgtgtaaattaatgacaagttttttcattcaataatagagaagttctctaggagaatgccaacaataaactcccttgtataatagaagtctgatgttgcgttcgagttatcaacaaatatttctctgacttctctttcatgttatttcctgctggtttttgttgaacattaatggttttgatggagggtcttgtttcggttcagatcttcataagcctacggcatggcaaccactctgaaagatgcagttgcacggaagcctgtgttggcaacaatccgccttatcgttccagctggtgccgcccgccctgcgccaccagttggtccagcgctaggtttctacaggctgaacctgatggcgttctgcaaggatttcaatgccaggactcagaagtataaggcagaaactcctatgcaggttaccttaactgcctacaaggacagcacattcgagtttgtagtcaagtcaccatctgtctcatggttcctcaagaaggccgccgggattgagacagccagcggccgtccagggcacactgtagtgtcatccctttcacttcgccatgtctacgagatcgcgaaattgaagcaatctgatccctactgcaagcacatgtcactcgaggcgctgtgcaagtcaatcattggcacagccaactccatgggcattgagattgttaaagatctatgagctgcttggccccatctttgtcatgaggggagttggtgagttgcttaatgattttgtgtattactaatttttagttggggaagtaaattgtgtcctggtttattgagcagagatcttgagagttccatgcctctgaaattgccttcagcacagccttttttctctctgcaattctgatctgaaacatgtagttcccacaaatcgttctcaccgatgtcaatttgttcaatgtggtgatggtacaatgaaaataatagatttctctgatgatggactcatcaagtctgggtgaacctttgagtgaacaacctgtaatgcagcatttgctcatataagcaggatagttttccagttaatctgtgattcttccggaaatctggtcataagattcatctagcttgccttccactgcccattatgatgtgcttgcagtttcaactttaatccaaatcttcacgctgttttactacaaagaactcaatgagtaggttgtcgggtttttccaggtttttctttcttttttttttttaaaaaaaatcctccattctacaacctacattcattgttcatcttgctgtccaagtgagtttaagagaaaccgagcaaatttattttttgttcatgtgagttgaagagaaaccgagcaaaaattactttttgttcttctttgaaaagtcatcttgctgtccaagtgagttcaagagaaaccaagcaaatttaatttttgttcatatgagttgaagagaaaccgtgcaaaaattactttttgttcttttttgaaaaggaaatcgaacaaatttactttttgttcacctagtgagttgaagaccgaacaaaattactttctgttattttctaaaaaaaggaaatcgagcaaaaattacttggtagaaaacattcactgggagatcaaacgaatgtattccccagaagttcaaattcgtatacattaatctgactgccctttatctgagataaaaatgaactagaagaacagaatctattcacccagtagcggcttgttttcgggttggctctaattcataaatagacatacattcaattaaggatgcagttctcgtttacaatgaacacatttgtgccagttgaaattgatactcttcgtgcataccaaactagctggaacagtctttttttctgcttctccaaggttatgattgtacatgtttgggtactgggaccaaacagtagaaaatatgatctatccattgctgatatgttcaagcacaagatattgcagtgctattgagtacttggctgctcttccttccctggacccacaatctgaactgctaatgctcttgagtatgtaggatccatgcccatcacctaaggaagccaaattaaatcgtgcaaacataacgggaagaaacaaaaagatttagattgatagccatgaactatcatagactagaaactgacatagcacaaagaaatgaaacaaataaagtgaatcagtcatttacagttttggacaatttagttggtattcatagcagtctcatcaaacaaaactttctaagacggatacaaactaaaatgagaagtatcttgactgtcatgccatctatgtaagtgcagtgaatgaaaccaagagggtatctcatctatatattttgttactacagtgaatgaaccaagagggtacctcatcaaataagatttcaaagatggatataaaatgcaacgagtaaatgtccaaactaaaaagaattatatgcaagcacaagatgttctctgttaatgtgaaacaaagagccgatgaatagcaatagaaacaaaaggtttacttaacaaaatatgggtgaacaataaaatgacaaccggcactgtacatcagatatcttgtaagatttaccttggattgtatatattgaacttatccacctcttgtaaatgaacatggatcttggggtgtcaccttgatgaacatcagagagcaagagattacaagacccagggactccgagctttgtgctaggatagagattgagatgtttattctcaggaacataggaacatgcagaagtttaaagatctggcattgaatttatcactcactttgcatgcgcaacagcattttgacacagagctaatatgcgaaccactgctagatcccgagccctagcatttgcatatctttgctgacagctcctatagtttcagtattgtcagaactagtcataccaaaaattgggaatgcacaccatacataattcaagtcaattactatagtgtataaagttctcgctttgatgatgtagatcaaacctagttttctcagaaagatcagaaaatccctaaaataaatttgtgcagcaggtggtctaatgcatcattcagtagaacaactaatagccatatcataatggagcatacagacctaacagaagtctacaccaaacattctgcacgtaaggacttggatcatcattatcacaactacaggtgcccagaattctcagctgagattattgagaccaaaaaaaaaaaaatctagaatgatcaagcaggacgacaagacaaaattaaaaacacacctttctgagaagaaatctgcaaaatcatcaataattactgcagcagggaagctgccaagcagatgaaatgccgcgaagtactttctgatgccctcatcatcttcaatgtatctacaagcacggagtacataaattagagcataaatccccatctttttgtcatgaagtaacacaaataggcatttcaatacgatcacagaccatatgcttagctgacaatagcatgcaaatctcacaaatcatcaatagtaaataaaatgtaactagagagatctcatacttgatatggattctctgaagcacgctgtgtgatagatcaataccctgaaagaaagaaataagagtaagatttagcttcacaaatgaggagcaggtgagattttgtaacccaagattccagagcacgagtagagaacaatcgctcacctgggacaagaacggggggctattctccagtctccccttcctgcagatgaacaccacgcctcgtccactctccgtcgcgcggtttatcgcgaactggaagagaagcgacgtcttcccgctgttctagcaccaggagaggcggcgaaatcggagcaagagcggagtgagccaagccgcagcatcggggatgggacacggaacgcacgggattcgacaaacagcttcggtttgattcatggtggaaaaggagctgtgagacgagagtacgagacgcgtaccagcacgaagggcccgagacgagggtgatgtcagcgttctcgggcgccggcggccgggtggcgcccgtgcaggagaagaacctgtgcacca

SEQ ID NO: 14218 - DNA, 13946 bp, Oryza sativa
gagacggcggcgccggcgaggtgttcggcagaatgccactgcggcggccggcaccaaggcaaaggctgaggagtttttttttttcttcctcacgatttttttttaaaaaaatgcaaagaaaattggcagcggtgcttaaattttttttaaaaaaagataatccgagcatgtgtttaattgatttggcacaaactattgacttttgaaatgaacatcattattatgtgcttcctccgtcatataatataagggattttgactttttcttacactatttgaccactcgtcttattctaaaaatttgtgcaaatataaaaaagaaaaattgtgcttaaagtattttggataataaagtaagtcacaaataaaataaataataattctaaatgtttttaaataagacgaatggtcaaacaatataagcaaaaagtcaaaatcccttatattatggaacggaggaaataccaacactacatgtttgtcttattgaccaaagtctaagctgtgaattataaaccactctaataattcttttgtatatgctaaaaaatgaaaataaaactaaaaccattgaagtaaaagaatgacacgttcacttaaaagtaataaaggaataaagtaaatactttacgtattggttacttctctatagctctataacccatttgagaaaaatatattttacagatctaaaaattaagataagatacacaaatgaaagtctaaaaatttatatattatagatctaattgcgtttgatttgctcaggtcatctcgactaaaatttttactctctacgattaaatctaagagtaaaaagatttactcaagataatatggataaatcttaaacacccatttacatatctagaagtagttttcggatttacaatatatgtatatatgtatagtttgcatcatatattttcctcatttaggatgagcctcatcggccaacatattatacgttttgtgttgagttaaaaagagaccggatgcttataaaagctactaaggatgaaaaaaataactaaaaacataaaaaagcagtagagtggctgccgctacaagcctacaaccaatgatatgctactatggttgccgaatatgatcctttttactatggttggtgcccaaactatgagctcacggaattttcatcactactccttccattctaaaatatgaacacttctggcatttaaaatttacactaaaatataaatacttcaagcgctatttagagtattttctccaccgattatatccctctcaaatatgttcttatggtttcttaaaaaaatatatgttcttatgttgaatcctaatcattatgtcatttcataaatctatcaaaatattttctacttaagcataaattctactcccttcgtttttaaaatataacaacttaataacaaattcaacaatcttactactacggatgagattacaaaaaaaaatagattttagaacagatgaagtattgtattaatataaatttcttaccctcaaaaacttgtcgatccttctctattagtacaaccagcagcctacatttctagatgagtaaagtccatcaccggtccctaaacttgtaccgctgtgtcatcccggtccctaaactcgtaaaatcgaccattcagatcctcagacttgttcgactgtatcatcccagtccctaaacttacagatcactcgtttaggtcctccaacttgttcagttgtgttaccccggtccctaaacaggacggtctaaaaattttatatcaaaaaataattcataactttttcatgtgaactctaatgaagacaatctttatatcaaaattgtagctctagacgtgacctacaactttatagttgaaaagtttttgaattaaaactgtttagggtcccaaaatattggtgcatgtttatatattttgaaattttaattttaaaattacattttgggacaaaaaatgacttaaaataaaaaaaatcaactacaaagttgtagatcgcgtccaggactgtaagtttgatataaagtttatcttcattagaattcacatgaaaaagttataaattatttttaaatataaagcttttagacagttctatttgacccagatgatattcaaatacaagtttagggactggggtgacacaactgaataagttagagtatttaaacgagtgatctgcaaatttagggaccaggataatactgtcgaacaagtttgagaacctgaacagtcgatttgctagtttagggaccgagatgatacaacggtggaccggtgatggactttactctttctatattctaactgctcctaattgattatgcaactacaccatcttttatattggattctcggatgatattcatcctaatatccaatatccactcattagcagtttagcaccgagactttgagattaggccaagtcaaagcggatccatctgctcatcccggaaatgaatccaaccctctaaacccggaaaccctaaaccctctaagagcacgaatgcacgatgccatttccactcggtaaaaaaaaaagaaaaaaagaaaaaaaaaagagcaaagcaaagcaacggcttttcgcccatcggaaaaccaagcacgacgacgtataaaatccacgtttttgagcgcgagaaattaatttctctcggtattttcttctttcttctctctatactccagtactccaccctccaggagcagttagcttctccccctgctttctgctcctgacgcgagagcaagaagaagaaaaggccatggcggagaagagggcttcttcttgaggtgaggttggttgctcgcttctcttctcttctcttcctcctgctgccgattcggttggcgattttgctcgagacttttttttttcttcttctttgttgcgagtcttcgcgccgctttaatcgggagagcatttggagtctgacttggcttccactcgcgcgcggtttaatccccttttttttttctatttttttcttcacttctgatgatgatttcgtgctcttctccctcatcacgatttcttggcttgcaggcagctgcttcgctttcctcaccccccaaatcgcgccagaattcgatcttttccggcggcggctggtggagcgcaagatcgcgctgcgcgtttgatgggcaaggcgtgttcttggtggagtttcttgggagccgcctctcgtcctggatccgtggcggccggcgacatcctgggccggggagggtttctcggatccggttcttgctaatccgatcggaatccgagcggatggggtcagcgatggatgtggtggacatcagctccgacgaggagggcttcgccgcggcggcggtggcggtggcgacgacgaccaagaaggcgtccgtcgactccctcgggtggattgcggaccttcttagagaggaggatgagagggctttgtcggatgagttccatgatctggaggtgatgagtgagctgtcggcgccgccggtgatggcgcagcacaaggggggcaagcccgattgcgtcggcgaggaagacgacgatgattgcgtggtgctggatggggatcctgatgatgttgtcgctgtcgcggggtataaagggagtgagggagatggcagctcggatgaattgcagatcgtcgcagagaaaggcccggtattttggcttaattgcttattactaaaattttgatctgtatttattgcattctgtgcatgaaataggaacagctcaattgttatgtttgtaggctatgtatatagagatgaaatgttctcgtaattgggggaaactgttcgtaataagtcattttgttatgatctgaactttgaattactatattgttctgatttcatttgaaggcttatttactcattgcatagtttagtttgatctcctttgttcagtgatgtggaattcagattcaaatacattggatagcgtggaagtggtttgatttaagtgcatgtgtttctttccccatctgtacttgcctatttgtctatgaatacatgtacctctagttcatgtcacttgtaataacgaaatgataaatttcatgctagctttttaacagaaaccacagtgtggagtggacatgtagtagcattcatttcttttgttattttccttaactagtagttgtctatttatccacaggtagcatgcagggacttccctcattcccgccatttatgttctaacttgcccttcagcaccacttctcatgtgaagtattgtagcatggtaagtaagaaataattttccctccagtgaatctactagaggagcagcttatagattttgttttgacacgatttccatgttcgcttttcaaatgcagtgccactgttttgtatgtgacactccagccccatgcaattattggggtaagggcaccgagatttatgatcattgtcatgctacagataaggaaaaaaagtggaaagcaatgagacatacattcaagagcaaaggtctgccaacatctcatccagaaaagcgccagaatgtcgtatacccaacaacaacgtcatttgtacagcaagatacacagtgcgaaatttcactcatacaatcgcatatgactacttactttcccaaccaaagtcatcttgcgaatgttgtgaaccaggggttaactcaaacaagacatacatcagtaagagtctcaccgagtgtagggagaactgtcagtgcaacaagaacaactcctgcaacaagggctggaagaggtatgagcaatgctcccagcattcagattcctcaatcacgcacaagattcaaacgagtaggggctacttctccaggcatagtaactctaaatgataaccagtttggttctgctgctccgaacaatacccagttgcaccagccatcctcgccacatgcatcccagccagctcaagttgcaccaagaacattgtttggtactgttcagaaaaatccccctcagagatcgctaagtgccccaatagcgcttcaagggcaacaagatcagtcggcgtcgtcctatcaggctgcctcaaacggaacacacggtacaggaccacaattttctcggtgcatttctcttacggctcagagaacacaattactgcctgaaccagcattggatgtttacagcaaaagctggcaagacataattgatagtctggcatctgatctggaggtaccagattacaatatgggcgctgcagagtctcagcagccagacaggactatttctcaacctcttgattccattacattccagggggtaggtcttcacagtgagcctgttgtggcattggcgaacttgatgccttgtaatgggcagaatgtggccaatggcatgataggcagcaattgtcttgcacaaacaacacaaattttgcctcacctcaatcaccagcctagccttgttcccaatgaatcccatcttaataattcagtaagttccactgcggacggattactaatggaagctgctcatcagagagacacgcaaggatcggattctctagatcttctatttgactttgagtttgaggattgggattcagcagagccctgacaaacaacctccgcatttttgaaccccaaggacaataaaatctggcgtcaccgacaagctggttcgttagcttccttcctaggaagaggaagagatgttccttgtacattctgtaggttcagtggtagaaatgttttttttttccttccatgggtgcttgtttacagtagcggctatacaggccttctaggccttagattagcagttatcgctctgaagttttagggatgaagttcaattcccaaactgttgttgatcatatatctatgggccataactccataatcctatatctatggtccataactccataatccaattgccagaatgcatgtttcaggtagcatagcactgaagcaaaatcttctgagcactggtgtggattggctctagtaactgctgatccagcgaagcaatgtatagtttttgcttgataatggcaaagagtgatctgctcttgaaaagccttaagctttccttgcaatgtgaaatttgtgttacaaatagctgagttggctatgcagaataccaaggcaaggaggaagaaaccaatgcttgcgttgttctacctccattgaggtaaaaatctttccttttcctcttatcgtagagatttgtcatttatatgacatgagttactccggctataaatatttgataaaattaagtcaaaaatttgaaattgtgaccgtcaataatttttctccaatacttattagttactttgaaaagtactgccataatatcataaacttatttaaatgtaaaaccgatggccaaagttttaaaagtgtaatcgaatctcattctaaactcaaatactccatttatgaccagttaaccacagggagagtacacaattccttttgttaagagtcagtaataaaatcagcatgtagaggggataataatttctttggtggccccacttgtcaggaagggtcgaaggcgtagtgcatgtccacggcggcggcgatgtgccaggtgcaccgtgtgcccttggggaagacgacgatgtcgccggcgccgaactcgacgcgccgcccattctccggcgagccctccgccgccgacgccgccgccgtcgccgtcgccgtcaccttccctctcacgatgtagcacgtctgccgcgcgccgtagctcagcgccatcctccccggaccaccgccccacctacaacacaagtacatatatacggtacaatacgtgtattttgtacaccgtataaaatacgcgtatgatgtatcggagggagatttatacttgggccaggacctggcgccgagctctgacaggcgagactccggcgggctcctctcgacggcgatgccgccgccggcggccaccgtgcacggcggcggcggcgacgagctcgaagccatggacaatggacgatgcagtggtttggattcgccaggtctctcggagaagttgcaatctcttgccggaaacaagacatagtagcatactttccgacgacttgctgctgtcgtggaccgcacctcgacatgtcggcagcggccgccggcggcggcggtggcagaggacatgtcggccgcagcctgcaggtggcgcttggtcagccacgttgaccggctgccagctggctgatgacgtggcgacgcagcactgggcataaataaatgtgtatgatgctgatgccgttgatttttcgcatagcatttggccatttgttttatttgaaaatttagtataaatatataaaagtataagttaagattatattttatttgatgataaaatatgtgctaacaaaataaataacattcatataatttttagtaagacaaatggttaaacattacgtcaaaagtcaacaatgtcatacattaaaaaaaacgagaaaattgacattttaccatcatcaaaaaggggtttcgcccaaataccactatgcaattgggattcaccaaaataccattctcaattgaggggcttcacccatatgccattttcttccaattctctctttcctctcatcattattgaccaaaatggccctagttgaatcaatttaagtatatcaaaatacgtagattataaagtaaatacgctaaaatatttttacatgctatttttttcttacacagtatgcatcgtattatatccataacataaaaaaaaagacactatcaacggaaactctcataaaaaatacgtaattatttttttatttatgctgtggagatagtgtcttatactctgtaatttggtgtaaagaaaaaaatatattgcatgtcaagatatttggacgatatgtactttgtctgtaatctacatatttgctttacttgaattaattcaactaggggcattttggtcagcaaagatgaaaggaaagagagaattggaagaaaatggtgtttcggcgaagcccctcaattgagaatgatattttggcgaatcccaactgcatagtggtatttgggcgaaacctgttttgacgatggtattatgccaattttctcgatttttgtagttgttaacctttgctatgaaaaatctgaactttgacaacggttattcaacccattcattcaactgaaagtccttaaattcagcagggagctgaagacttttgtttctgattggttttgttaaaccaaacataatgctctagaacttcaaatgatagctccaagggaagaaatcacaagtccaatccttgacctggtagtctatgactctatgttacaaagagatcaccatgtcccaacctgtcgacttttgaacaatagctgaagcatggatcttttttttttttgaaagtagaaacatggatcatttattcaatgacaatcttttttttgtccctcgcaatttcgacaaggtctaacacaggtacttagtcaggcgtggatcggattgccatggtaggccagatcgtgcgccgattgctctacatttgatgcctgcctgaagcatgaacaggaaatatcccaatcaaggtaagaagtgaagaacaaaaaaactagtagtatttttgtttcatttctgtaaatgaaggaagttgttataccacttggcaagcaaaaggcagcatcttttctggaggcatctctgtggatagtcctaagtatattcaatagaggaaacattgaggtcacaataaataattaatgataggcgatagctaactggattttaatatttagttaaaacaaaaatacttgaatagcatcatatatataagaatcatattcttgagcaaagaagtagtaatcttaataactgtttatgtcgaattcccgtctcctcagggagacataatgaagaaagtaaatagttattctggaagaagttaatggctcaccatgaagtactgctcctatgaatgcatcaccacaaccagttgtatcaacaagctctgaagctggaatactttctgctgttcctatgagcagccttgcaaatatattcccagaccctcttgcagtaagtctcatgaactagaaagtaaaatggaaaaaggttaggtaaagcagtaaaagagatccaaagcagtcatcaaattactcacatttctgatgacataacaatgtaaacgattttgattgccagaaatatctcataccttagatgatacacaagttggcaggatatcatctttatctactttcagccttaaggactcagcgacattctctatatctactggctcagtttcataattttcacctatttaagagtggaactgcagataaataggttgaagtcacaaaggcaaaacttatacacaaactttatccagcatgtaattaaaattgtctggacaagatcaaaactaaccatctttgcccctctcaagcatcatgcatccattttctccaagggttacaactgcgaagcatgcacgaggatattgcagaaggatttctagtagtgcagagggaatagatgggactgatgtccatttctgtaggtaaagagtcactgtaaatagtgagtgggaaaaaaaactaatgcagctttactaaagcatgccttttaaaaccattcatgcctgtcaaaatgtatcacaaacctctggaaatttcccattacagactatgtaacttgctaggctgagcaaacctcccaattcttcccttgttctttctggttcggcatcaaccaaaataggaatcttcatctgatcagcctgtacatttctggttttaatcaagcaacaaatcaaaatatgatctaattctctacaggtttatgatactgttactgtaaaacaaaggtcatttacattattgaaatttacctagacagtactaactactaagatgtatgaagattggacaacctagactacatggtgaaagcattacatgatacatgaatggattaatgttgcacactccaaacgaacttacctgcttagcaactgccaaggccatctcatctgaatatccatctaagtatagtaagcttacgtcttgcagtgcagctgacaaacttgacattctcaagtcactaggtatcattggagggtaccctgatgtgattatacacgtacgagtttttctgcaaatgtaaatggcccttctatgaatatgcacagaaacttgctatgatgccagaaagtgttattgtaaaaaagcaataattgagtaagtgtggctaaataaccatattgcttagacaagcttaacagcttcaaccatataaaggatgttcagtaaccagcaaaccaaaaaagtagtgaccaaacatcaaaatggtcaagtataaagggtcagttggagggtaaaatttttatccttatttacatgtatctactaaatgcatatatgccctatttccatgcatttttttcctttatctgatctagatgcccagtcctttagaataactgagcgaacggtgtacgcgccgaaagggaagtttataatgaagtgagaaccatgatttataaaagcaccttgtttttatatataaaaaggtaagtcaggttactctaatataaataggtgtaacaaaactaaaaattggttgaacttcattcgaaatgtacctgattgagtgtgcaaggtgaccagaaaattcatttggaatatttcagaaatgcttatcattacaacctaggagcatgcctttaattgttccatttacatgtattgctacatgaagatacaaactagttctcttatcgtaatgatgcaaaagaaatattcttacgtttgcttatcaataatgacatatacaaatgttgtgtttccaccatcagaaatctgcaaagcagaatcatcaaaacaatgaggtataagataacatggaagaaagtccagtgcattgatagtaccccaatatctttcactgtgcatctttcttttgttaatccttgacattttggttaccaatttattgtaccttactaccttctcgatgtacacatgattacttgcattgcagcgcttgatgaacaaagatgcagaaattatatatttgtaaaccaagccttactataacatgagatatatcaatcccagcttccttaagctccgaaagaacggttcctccaatttcatcgtttgccacctgatgaaaaaaaaaagagaacatcagcacttcagcagggttgtacttgtaactaggcaatgctgtacaaatagatgactcaatttgacaattcagtaaatgctgcactgtaaatgctaatttcaaaatgactctaaattcaatttaccttggagatgagcctcgtgttgaggcccaggcgggcggctcctgtcagcgcgttcccggcgttgccacctccagacacctgcaacaatggcgaaacaccaagaaatcgccaggagcgaaacgtcaatcttttccccatgtttcttggtgaagaactaaagaagtggggggtttggtttggtgtggtgtgtcacctgcagctcgccgctgcggatcttgtcgtcgggccgcgggtacgcgtccaccgtggcgaggtagtccagcgtcaccagcccgcaacccagctgcaagaagaagaacacctcacgccaggagtcaggtcaggtcagaccaaccaaaggcagcgggagagcagagggcgcaaatcacagtagctcaccacgacgcggcctgcggcggcggggagcagcggccggcgccccggcggcgcagcggagaggagggagccgctgcggcggcgcgggagcagaggcggtgacgccgccggcgagcatcggaggaggagcggcatggtgagagcgagtgattaccgctcgctgctgccggtggagccgacgagagttgtttggtgggtagttggatggatcatggatggctcccgttgtcattgtcgcgtcgtcacctctgattgcgtcattccatttccatggattgctcgatcagttcagacattttcgagttgaagaaaaagtttagaaactttcacctcaaagaggggagaattccatctcaaagaaagaatttccgaaactttcagtgcctgtaatttttatttaccggcatccaaatcccaagaactgatgttcttatcagtgaagtttgcagacctatcttagacatgcatggttcttagaaaaactgaacacatatgtcgaaaattttttgggactcttgcctttttaatttcaagtaggattgagctaacaatgatgccagtacagcaacaaaaaaatgcaaatatatttctttcacaccctcaagttcactttataacttaaaaacacacaaagaaaggaaagaagagccctcacatttgcaactttattctgcagaaaagcccctcatttggatcgcacagaaagaatggctgagagccagacgaagacgaacagctcatgggccttaattcgggatgtactatagactttgtttcatggaccataaaaggcccacattgcgagcccagcccaactccgccacggcaagacgcaaacctaagcctaaaccgcaactataaaatgcagcactatctccaaaccctcgcgaaccctagcgccgcacacacgctcaccccacctcttcacccgccgccgccgccgccgccgcgcgaagggaagcaggagtaggagccgccaggatgccggcgggccacgggctgcgtgcgcggacgcgcgacctgttcgcgcggccgtcaggaagaaggggtacatcccgctcaccacctacctcggcacctacaagatcggcgagcacgtcgacgtcaaggtgatcggcgccgtgcacaaggggatgccgcacaagttctaccacggccgcaccggccgtgtctggaacgtcaccaagcgcgccatcggcgtcgagatcaacaagcaggtataacccccgatccccaaacaccccggcggcggcgccgcctctttgtcatagatctgtggttgtgtcgcttaagtgacttggtgtcatgtttttgccccaagtgactttggaatcatgtagtttagttgtgccaatatgaaatttcatttttgcagttgcaggaatgggaagccattgcatactcttgcatggttgtgtaagatctgataaatagtgtagtctagatggtttactggttatatttactggtaacatttgtgcgattttactttgtgctttagtatttggattttgttttctctttaaatgtattgagaatgttgtgtactgaagtagagctattgtgattgtggctttggttcatttcatttctaggtttccattcgtccaagtaggatagtggcaaatcaatcctcaagtttacgtcgattgtattgttatcggttatgtggaaagtttaaccgtttggttttatgatgtagttatgagaagtgcatttaaagatatacttctgattgttcatttaatcctgtgtgcatgtgtagttatatgtttcaatcatataacatgctaccgtctaaacacattctgttggtgtagataaattggatagatatgtagttagctgtcggcatgtgtaatgttcagtcatgtggatatgtagtcttcgggattatttaatttttgaaatcatgtatctgttttactgattgtttgttaatctcttggtaggttgggaaccgcattatcaggaataggatccatgtccgtgtggagcatgtgcagccatccaggtgcactgaggagttccgcctgaggaagatcaagaacgaccagctcaaggcagatgccaaggctcgtggtgaggtcatcagcacgaagaggcagccgcagggtcctaagcccggcttcatggttgagggtgcaacactggagactgtcacccccatcccgtacgatgtggtcaatgatctcaagggtggttactaggattttcaatctatctgcctgcgctaccaattctatatccctgtcactctaatgagtaaaagtttgctcgctctgagcattattagtctgcacctttgttctg

SEQ ID NO: 14219 - DNA, 6412 bp, Oryza sativa
atatgatagcgggtatttcaaggaatggcttcaggttcttttgcataaagctaattttataattcttttcacaagcctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcctctcgggatgtggctccatcagcataaaattcatcatgcaatatcccatcccccacaagttaagaatttaaagtctagccaagtgtaatacatgtcccggtgctcaataaccgcgagcacggctattcgaatagatttggtttactcacactgcagtggatgtacactttacccgtactccgcaacttgcccaacacatgagcctacgtcccaacgaatgagacttgccacggcaaagcctttcaataacctcactttggcagtatccgctccatgaacttaagccctcatgcactctaggcgtacacggtttctagcagtgagaggagttctggcgctcccgagggggaaaactcacgcaagcctaacatcgcattctgtagttgaacccaatccatgctgtccccttttgggtatctccttgtagtcttgtagtcttgccaagtcagtctctagccatccgtatcgggtatccgccatttggccatccgtatcgggtatccgccagcagactgcttgttcgtccacacacctaagtgaaaccactatgcagggatactgcctccgctcggctatctactccgctaggtctatacccattcgagaagtacggctgtactgaggtcgtttcatgtttaacttcatggctcggtccttaactgaccagggacggcactagcctttaccggacaccacccaagtccttcagccgccccagtcgaaaacatttgtttaattttatttctcctttcacaaatcatgtcatcaacatcatggcaatgtggtgctcatgtctccacatgccgcatctcaattaccttcccaaaggtaattgcccaagcatatagcatttgataaatatgagtatgcatgattctagaatagcatttctaagcaattgtcataattgactagggactcatacgtagacatggttacaaagatttaagggtaaacaataatcaaggcatggcataatcccaagtaggatattcatcattgcatgcaattttatttataaacaaaataatttcgcaattgggatcaacatgttcaaggaatagtgatgacttgccttgctcaggataatccttattattgctataatcttgatcaaccttcacctcttggaagttgcagacgttgcctcacgactaaccgatacacaaggtctataatacgcgagaaaaaccagtattcaaacaacaatcaaatatgcgcgacaaaatgtactattcgtgtttgctaatggattccaatcacgctaggggctaaggtttcttaatctttctattatcaacgtggcctatttaggagttaaccaacatagcatttatgggatacatatatatttggctaatcggtggtttagtctatcaaatggcttatggaaggattatggctaagcatgcatctatctaaataggacgtttatatactagaggttctgttgttagatggatttatgatcaatcaaataatgaatcatgtgtattattatttaattgatggaggctttactttaattatgaacatatttcacttgtcacaataaaaaggataataattatccatgctttgtatgttagagttgtttaggttaatcatattatggttacagattatcccttaataaacaatcctaatttacatttgaactataattataatcatatgaggtcaagatttatactagtatttatctaatatacatgtttgtcatacactccctctaattaatatatgtaacatgcaaattaatactataccgtacaactataatgggacgtatagtatatgtgtaagcaacaatgtcttattattggatcatatatttgagtagttgctttttactataagctatacaatacatgttgattttaagatggctctgtttgtttaaataatggatatcaactgactatatattctacttcacatgacattgtatcaactaatttttaagtggtccaaatacaactagctctgtgattactctcctaaacaagttaaagattcatctaggtgtgtttatatttttgtcacgaaatatgaggctaaacattatttatatactttggacgcatgcgtataattatatagggacatatattaataaatggcactagcatttcctatgctttaattaatttgaaacaatgcttctaattagtttacatgggttttacagtgagaaagcatgttaaagacaattatttgacatctactttacagtatattttcaattttatttattagcacatttttaagttaactattatgcatcatcttgatattaattaacttttaattataaacatattttattaaatagtgaactatataccattggaaagcttatgaatttatatgaatttaggttcaagtttcactcaaatccgagttaaaatgaataagttatgctagtgtaaatattcaaatttgaataattgcgaaacagtactgttcatagcggatttattttaatccggaacctatccacagctcagagtcactgacgggtggggtcaggggttttattatcttttctaccgaattatttttgttagagaaaaatagggagtgggcccggcttgtcagtggctcggctgctctctttctctctctcgttcttttcccatcgtcttctacctccagccatcgggaggcagcaccagggcacggctgggcgcgacgggcacgggccggggcggcacggcggcggccaggggatgtgcggaggagctcaggcggccctccaccggcggcggcggcgcaaggcggagtaggggcgagcgttgcggcacggcaacgtcatgaccgagcttggctgcaagcagctatggtgaacggaatggtttgcgaccaaattggtgagggcgtgagcatctatggcgcatgagggttccgtttttccagaaaaatcgaagggagaaccccccggatggcatgtccacggtgacctccacgggcggagcttcgtagctcgggcttgtcacaattatggccctaatcgatgaaatagttgggggaggtagttcctagaggaataggaggagtaacaggagtgaggacttaccgagggacggcggaatgacgaagttccgcggcggtggtggagccgggaagaagctgcggcacgcccacaaggtgttcgacgaaatgtgtagtagggagaagaaaaggcagagaggggcggacgagctcgtgggggctaggaggtcttttataggtgggtgaggggcttgtgctggaagctaagacggataagctcgccagctcatggccagccgggctagatgctgggctagaggcggttatggcataggcgcacatggcatggcgcggggcgcagggatgggacggcgcgcggcgacggacgtggcacggggctcggcgtggtgcgacgcgacggacgacggcgcagcagcggcacacggcttgccggcgcggggcgcgaggcgcgacgagacggcgcgcgacgcggcagcgaagctgatgcgacggcgcgcggcgcggcgatgatgtcgatgcgacggcgacgacgacggcacgcgcggaggagtggggctcgagaggatgcgaccgtcgacggcgacggcgcgcggcgggatggagacggcgcggcgacggcgacatgacgcggcagggcgacggcggtgacaagacggcgcgcggcggcgcggggcgcaaggcagcggcgcagcagagggcggcagcggcgcggcgcgcgcaggggcggcgcggggctcgagggggagcgcggcagaggagcggtggtggctagggaaccaaatcaaacacctagagggctaatgaacagtgttagccaactatttttgattttatagggtattttgcaattaggaaaaatatactattgccactaattttgtcacaatgtaaaatacaccaagcctaagttaatccatcgaaatttgtattcaaatttaatattgaacatatttttatttttattatatattttctaagtattcctatttttagggctttggtttatttataaattgagaaaagttgcaaattaaatttgtattttactcctcagcagttgagtgaccatattaagtgctcaaatgtgaatttccccaaaatttaatattgtccaatttttaaatatatatcctagatttttataatttcctatatttgggattttggtatttatctgttttcacacatattggtttatctttttggattggttttaccaccacatggatttctataatttagcatttgtgattcaattcaaattatataatatctaattattttttcccagtaaaactattctatagatagagttccatttatttgaatgattatcatttcctaagtgtttatatttcatggcacacatcacatggttcaagtatttaatatttgatccataaattaaattggtaattaaccttccctttgtctggctttgttttctcgtgcgtaaatatttatagagttcataataaatatcttatttttataattgttactcagttgtatagctttagcttaattttcagtggtgacaatttatagtttggcaagcaatagcaaccataagatccagcatgatgcaaaagttttaaaaagttcaaaattttagtgatttttttattgtcttgaattttcaggatgttacagaaggcatatatggttctttttagcataaagcaagttttatttgcataaaacactttcaaatcagatttgttttcaaataaatttcagcaagctagtacttagcatatgggcatcaaaagtaggcattaatcatccatgacagcaaggagatcattctcaaatctcatcacaatttgaaggtaaattttagcatttagaagaataaatacaagtctatactcaatatatatccacacgtcgctcatgaccgcgagcacgactaacactttacccacatgatgcgaaataataatcatgcaagagcatggcacgcgatacataagtacccgatttattactcacaacaaatcttttccaaaattcatgatttagccttacaccagcacgatacgtgtctctccatcctaagccatacacgttatataaccaagaaccgttaagtggcaggcccacgccttaaacttaacgccgtggtggcggacacaacgggaacccaccatgtggcacaatacagttgtattggacacgcttagtcacctaaactaccacatcggggtaaacaggaagctcctctgaattatacgaactcatacacaccagcctaccagaatataaggctaaaccataaataatttactaagcttgggctatcccatactagcacatgtggttgtactgtatatgtatacgaaatgaactgacattgagtgaagtccttaggtcggtttggacacactctccccctacactacaacaaaacatgtatttaaagacatctcatttgggtcctagagacgttttaaaccatccttagacgtatgtagagtcgtttcttaaaagcgtccatccttagacgtatgtagagtcgtttcttaaaagcgtcccagaagcgtctttgttgggaccgtctcagaattgtagagatgctttgtaaagcatctcaaacatatttgagacaccaaaatagcatctctacattcgttgggacgtttttatggatgtgatcaataacgtctctacagctattaaagcgtctcatgatgcgttgttaagaataattaatacgtattatatagtcgcatatctatatattgtaggatatcaggcttgagaaattcacaccatttacatccgatcaaacatcatactactataatatcgccatcaacagaacaatgccacaaaacaggaacacagtacaatccaatcgatgaaaggtaattatattaagagcaactgtgatcaacatgtcaggtaaacatacatacagaaaatgagatttgaatcatctccaaaaagaaattataactgttcataagctaatactatagctttagctcctcccatcttcatgatgtagcattcctatacaatccatttgcattgccctgcaaaatatattgtttgtgaaccaaatcagtagttattatgacccacaaaaaatgtatgaaagctagcccaaagaattagaaaacccatatatgtattgtttcatatcagatacacctgttcttgggatcgtt

SEQ ID NO: 14220 - DNA, 3238 bp, Oryza sativa
agtgaccatattaagtgctcaaatgtgaatttccccaaattttattattgtccaatttttaaatatatatcctagatttttataatttcctatatttgggattttggtatttatctgttttcacacatattggtttatctttttggattggttttaccaccacatggatttctataatttagcatttgtgattcaattcaaattatataatatctaattattttttcccagtaaaactattctatagatagagttccatttatttgaatgattatcatttcctaagtgtttatatttcatggcacacatcacatggttcaagtatttaatatttgatccataaattaaattggtaattaaccttccctttgtctggctttgttttctcgtgcgtaaatatttatagagttcataataaatatcttatttttataattgttactcagttgtatagctttagcttaattttcagtggtgacaatttatagtttggcaagcaatagcaaccataagatccagcatgatgcaaaagttttaaaaagttcaaaattttagtgatttttttattgtcttgaattttcaggatgttacaaacctaccccccttaaaggaatctcgtccccgagatttagtgggactacggtgtcattaaactagttcgactaaaatattgtttgatagacagacatgctaatcgaatgtaggaaatccagggtcttcgtggcttccggacgtcatgagttgatgagcgaagcgaagcgacactctttgtacttccgctgtcttggtcagcaacggacttagttggcagtcttgtggcacatgatccgtcttttcgcaaaggaagcacgcgatcttcgttgtagggcattctccattttgatggtcttcgtcacagtaggggcattgagtaacgcaattactaccgtagtgtcctatctctccgcaacgactatatgccttaatcttcgaaacttctttggatgggtctgaaactctatgctcttccgggctgatctgtgaaggcagtgtttcttgttcttcattggtgtcttgagtacagcctatcgcataatgtccaaattgtccacaagaaaaacaacagccatctctctttcgttgccatagttgtagctcttcaacttcttcaggcaaatcaccgatttctattcccattttactgagatcaagttcagcatatgttattagtgatgacgcttttcttttccgttttcccttccaccaatgtggtgtagttccttgtctacgaaattgctgatacataggttttggatagggtgaatgtggcatcggttttggtggtatttctgccctcattttcctttttgggtgtcagggtatattccttacttgtccatttcctagctttttcttagggcaatccaaggcacaatgtccttcctcgccacatctataacacgtgacatttatccttcgttttgctggagtcaggtggcacctttcattcgaagaatattgctttaggtgattcagattgatggtgtagtcttcaggctttagtgaggcttggactcgtcctttgttcttggaagcttggggaggatcttcaaggagtagcatgggctggtttattcccatattttgggggtcttgtagcttggaggagttcttgtttctcgatgtctattggtccatgtcttcacgtcctgtggtaggttcttcttgttagaagttagtaggttgaaagttagtaaactactatactaggcatcaatagtagcatgacaatgctgcattgttgtttttcttcatcatttgttcaatccttcgttccttaatatttattatgaatcttgccgtcgagggttgaggttacaccctttgcagttttactatccaatgatacttcaaattccttgtacaagggcgaatataccttgatatatagtattccttgtccatattttcccacaagttattgatttcctcgaggtttttccatcataggctaccccccttaaaataagaaattttgaaagcaatttaaaaggagatatgcttttgcgttcacaaagtagattttttttttatcaaaatgattttgcacaaatatcctttggaagtgatgtttgcaaaacatttgaaatttccaagagatacattttcttaccaaatataatttgaaaatagattttttttttcaggcaagattttgtataatcacacatgtgtttaacaaaaagcaacatggcaactaaaaacttttgtaatcaatttttctttgaaaacaacatttgattttatttcgcaaaagaaaactcttgcccatagggccaaaataccatatagattgtatgcatggttcaaagttgaaacaacaatacttttgaacacctcaaagaaaaactcatgaaaaaaatttttttttttactattattattattattattattattattattattattattatttttaaacaaagctttaggcaaataattattggaattcagcttggaaaaccttttgaaaggaggctttcgaagacatgcactgaaaatttggttttgaatgaagttttattttggaaaactttgcaatacattatttggaatcacaatttcacaaataattttcagagaaaattttcttttcaagctaattttgaccattcccaaaatttaatataagttcagagcggctttggggacaattttgcaattaaatagtttgaaacaaacatttcctttctttttgaagcaatctttcttcgtaagactatatttcaaagtgcaaaaattcatttgtttttcaatattttctaaagacaactcataaaacaaagttttaaggggattaaatccatataagtttgacttgtccttggaattttgaagcaaccctagaactaaaatccaataaattccactctcgttcatccttcgcccatgtactattattcaaaacatggctccttttattaaatttccatatatgcataccatcttatgttccttttcgatccataatattccgatccttatatgtttatggaaacaacttagcaatcttacatggctttctcatggataagcagtctgtttctcttctctttattgtccttcatgatactcccatgtcgcagatcgagcttctatggtcactaacggcttagtcgagacttcacttctactatacgagtgtgtgactagaggaaactagtactaacaacaatgagttatcatgattgatgag

SEQ ID NO: 14221 - DNA, 1754 bp, Oryza sativa
atgtcgccaagaagcgcaacctgcaaatggggagcaagagctcatcggacgatagggaaacagatgaagaagggagcaggagaaggctcgccggcgcgtaccggagatccgcgagacgtcgccggagatcccctttccgagtcgccgtcgccgccgccgccggcggatatgggtgctggggttttagagggggagggcaaacatgcagcgaacaccctgtgtttcgtggaaataacaagatgtttctacattctttttttttataaaattagtttttctttcgtttcaaaatatcaagataaagttttattttccagtcgacctaagctactccctcctgtgatctgtcaaaggattctatgatatttctacatttcttgtagaataccccttcgtatttgatttttttcaactcattgtttttaagttcgatcaaatttatagaaaaacataactacattttcaacacaaagaaaaatatataaaatttggtgttgtagatgttggtaatttttttaataaatctgatcaaacttaaaaagaatttgatcagaaaaaaaagtcaaaataatttatatagaaaatgaatggagtatcatgtagaggaatatgctgtgttcagcaaaacagtttgggaactaatccttgcgcatgcagagtgactcattagcacatggttataactactagcttaataaacttaaaaaatagattaatatattttttcaagcaacctttctgcgtatatatatattttttaaaaaaaacacacgtttaatagtttaggaaacgtgtgcgcagaaaatgagacgtggaagttgggaaatgggataaaaggactcgcctcaagtgaatacagttttttttttttgaaaggaaaggtggatacagtttagccgtgtattttttcaaactaagtcgttagtagcatactctttgttggttgttaattctatagcttacaaacaaagttaggtgttatattgtgattaatgtgacagtttgttaatattcacagtttgttaatattgcctctcttaacgtgcataagcgaattcatttttgagaattttgaaatttttagcttggttttccgccacatattcttagaaaaaatgttcttgatacataaatggatccattgtttgagggtttgaggctggttgggacgtactctgatttgtagattgtaccaatttgttcacacgtttttgttgatgtgttaagagcaggtacaatagcagactcaggctattagtcagctataaatatattttaatgagataaacgatgagagagaagaacatcgggctacagatctatagttagctgcagcacagactacaaaacacaatgtgtgtatgacaggtgagaccatatattaatagtatagtaagcagccattgtatgaattggctattagattggctatagatgaattggagctagtagtaggctatactattaaacttgctctaatacctgcaaattaaaatggagaaagcaatatttgagtttcaaaaaaaatgaattgatattttttgttgatgtttttttactagcaccggcaattgaccaaggttcctacaaattttcatgcaatgtatgtttccttttagcctacaacttgcatgcagactgtaattgctcaaatgacggcctggtgtataatgtctgaagtttccatcagtgattgatccagaatatcatttcagcagatgaaagcctaactagattttctcctattgagtcgg

SEQ ID NO: 14222 - DNA, 10609 bp, Oryza sativa
cataaatatatttatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagcttttgacgaaccacatcaaggtttcactgaaaggcagcaagccaaaggacctcatcatccccagaagcgttcgcaatccacattaaagaataccacctgttagagataagccgaaagaagattgataaaagagattggcaaagatgttctctagcatgaaagaagtaggccgaaaggtgattgataaacagaaacatgctctgcatcgctcacggaagacccctgattgtaattgccccgcaacagtcaccttgtcattaagtaagcgagatgacctaggtagaagtgtttctatgaagacaaggagtgaaattttcagctcggtatcggatgctacacggagtgaaaagtgcaagcaccggttaccaggtaatgccatgtcctgggaggtgatccaacgggaaagaactcatcaaggttaaaggtgtaaaggaatacgttgagtgctaactgaggacaacctgaagataataacgggaagtaaactgaatgtaaagaaagtgaatccgagctgcttgttcgtgggaactattcccagttatgaaccaagtgatatgttcgaagatagtctatagaggtcagattaaaatcacctctcacaacgaagcttcagatctggcaggatcacgatcagacaataaggagtccagcagtaaaactatttgggaagacgtcaaagtatatcaagtgggataagctggttctcttgggaagcataattcaaaggcaaagctatcgacccttgcatcaaatagcagaagtagctatcacccggagacccggaaagctaatatgaggcagttggtggcgagttagaagcaaatgacaagcatggtatcttagtaatgacgagctgatctcgacgcatgacatgaagttgataacttgtatgaggttgactccaaagatatgaactatgcgaagttctggaactgaagccccatcttcaagcgccgcaacccagtcgaagtcagctaaaggttcaaccctggttcgagtcaggtgaaaagaagattccacctgcaacaggaggtcaagccaagcagttccgagtggtgaagttttgctgaaagtttgtgaagacggagcggaagaagtcaatcaagaagagaagaccgcccaacctatcttcttgctagcctcctcgaatctcggggacgagattcttgtaaggggggtggatttgtcacgtcctgataaattcatcccgaaataaaaatcattttccaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaaaggatttataaaaagaaaaaccctaaaagaagtccttttccccccttcccttcttgggccggctcggcccaattccctccctctctctcctctccccgcggcccatcggcctcctccccgcgcgcgcgccgctgacaggcgggcccgcccgccaccctcgctgacgggtggggcccacctgtcatcccccacctcgcgccgcgcccgccgcccgcccgtgccctagcgccgccgccgccgccgaatccgccgcatcccgccgtccccgcgcgcattaaagtggggggaattattccccgcgattccctctcccgtttcccccgctttcccctctctctctccctcggattcgtccgattttattcccgcaatcctcgccggcgtcattgatggagccgagatctccgcggccgattcctccccctccggccgctttctccccctcccggtgctatataattgttccccgtgcctctctcctccgtttccgccgctcgccgctcgctctccccgtcggattcgtgctcgcgccgtcgtcctctctctccaccgtcgccgccgagcttcggttcgccgtcgtcgtcgcctcggacttcctcccgtctcggcgtcacctccttcggcttcgccgcgtcgtcgtcgacctcgtccgctcctccgtttcgcccgccgaccgccggagcaccgtcgtcctcgccgtcccgagccgcgccgccgtcttcctccgctccggtcgtcgtttccgccgtcctcgtcgacccggggtgagccgaggaccgctcctttcgcttcccccttccctcctctctctcgggcgccgctccgccgcgccgttggtcgccggcggcgaccatcggggcgtgggtgcgccgccttccgtcggccgtgccggcgaggccgccttcgggcgcgccccgcggctgccaggtgggcccggccgtcagccgcccgcgcccgcgggtgcggctgacgcgtgggacccacggcgccggccggcgtcagccgcgtgcacctggtccaccgtggaccgaggggctgacgcgtgggccccactcccgtggacccggtccgcgcgccctctctcccggctgacgcaataattcgtttttaaattaaaatttaaatgaagaaattcgcaaatatctatttaaagagcatataaacttcaaatggccatatcttggccatttgaactcggaattggaccgttcaagtctctaatttttccttaagaagtcaagaacccatttttgtgctttatttctgctgttttatggagtttagtagagtaaaagccttttcttttccgttggtcgtgtagacgctgcagcttcggaagattcgctcttcgtggaagtagaagccgacgtttgggaaagcgagcaaggcaagtcacatcatccttgaacatattgaatcccagtttatcaaattattttgatttaaattactgcattattgctttatttaaattcccgcgttatcactgttttatttagccatgcctatttacctttgttatgaccttattattattgttattgttattattaccttgttcaccctagaataaacaaaactccaactagtgggtactctattcgtggttccactagtataaatttaggtagatgcttcgctgattaattaggcaacattaggtgattttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtttaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgagtgtggcgcacccggtctagatcttgttgctaggggctcaaccctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcagcaactaaaatgtggaatggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtctttataaaataactttgggcaactaagtgacttttaaatgctgtttactgcaaaacctaacccctattattatccccttgtaccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgcctttcgtatcatgtttgtgtggtgtaccccggcttttcctgggacggggattaatacactagcgttcgggaaaaggaaattttcccggtcgcgacaactataaatcaggacagttgtgctaagttcttatattttgggacggagaaagtaaaaaataatttgtaagtaaaacctttatatgcatgcctttaacaattgaaaaatcaaatgctataaaataaactgcaatgagcaaaccacaaaatcaacttcaaaactaagttttaaaatttaaattttggtttatgagtataagtaaaacgatgatgctcctaatacgacgagagaagcataggacctttttttttaattaaaactgatgcagaggacttccatgcaccttgttgctagtcagccagccaggtgtttcttcatcagttccttctgaatgcagcaaacaactgccattgctctgtttgaagctcaagttcaggctgatgttgttgcaagcagtttctatggtattcacatgaaactttttcagatttcttctatttaacgactcaagcatttcacaagatgaacatgtaaagtatgttgccacttcctccaaatgctttggtacggaaacgcacgcactttccacttgattttgccaaatgccaagcatcacatcttaatgttgtcagaactgacacaacaaactcaaactcttaagaaacaaaataaacggctgttttcacatcctcaaactttcagatacctacacataaaggcattcagaggtagtgtgacacaatgtttttttcttggcaccggccatcaggcagagagcagagtttggaagataatgcacgagacaatatgttgggggaacactactagcaccacaaagtaaactgatatgcgtataaatcaaatactcctacaaggtaagccgcgcagcaggcaaaattgcttgcaaaatcaaagaattttttatgatgtaatggtctcagccaaaccattcacttcccccttaattccattctccggtttccgaagagtatatctccaccccaacaacataatcacaatcatccatcacaaactcaaagacatggaaatgcgaggggaacaccactattagcaagaagatagaggggaactgtttcaaaggtgcttactcaaagtgacaaattttaagttccaaagtggcaaagtctcgatccatgtcaactactccaaaaaaaatggtcttacttcactatagtatatcatgtacttccatgtcattgtttcatgtgcatcaaatttactaattactagtattgtcaaaagctcgcagaagtagaaatatgatgaggaaagcaaaaaaatataggcattcattgaaatgtaggtgctgtttggattgagaaatgagataagtgtcacgactggaaataacccaacgggcgttccttacgtgcgtgcattattccttgtcccaggaggcaaggtacaccaaaagttgatacaatttagagtttaacaagcggaagcgtaattaatttattacatgggcggcgaagacccagcacacaagaagacaaacgaaaaacagcggaagactagggcgacgactacaggcgcttgacggcaggcacgagctagacaccaaagccttcatcatccaggggctcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagtcacttagttgctcaaagctactttgtaaacacggtcctagagctatacaatattattaaccaaggccgtgaacccacacgaacctgccttaacccaaggcctacgatgattcagaccgaactggcaatccgaccctgggtcccagctcgtcccaagccaaccgaggccaaccattccacattttagctgttaggcaggttttaagagttaaaacactaacttgggtatattgctcggcttgcccataaccgagggcgcgactatttaaaaagggtttattgcgtcagccgaggggagggggcgcgcggaccgggtccatgggagtggggcccacgcggcagcctcacggtccacggtggaccgggcgcacccgggctcgcaccggtcggcgcccggggccccacgttgtagccgcacccgagggcgcgggcggctgactggcgggccccacgcggcggttactctgggcgcccgaatgcgggcacttcgcgtggcccgcgggaggcggcgcccgcgcccctatggtcgccagcggcggccataggcacggtggagcggcggtcgagagaggggaagggaaggggtaaaagaagcggcggtccacggctcaccctaggtcgacgtcgacgacgaaaaagacggccggagcggaggaagctggcggcgcggctcgggtcgactgggtcgacggcgttccgacggtcggcgagccaaacatagggttgcacgaggtcgcctcagtatgcgacgaagcctaaggaggcggctccgaggtgtagtgtggtccggggctatgacggcggcggaccggagctcgacggcgacggtggagagagagagcgacggcgcgagctcgattccgtcgaggaggaaggacgccgagagacggaaacggacggaggaggtgcggtgagggtttaaatagggccgagggcgagagagggtggccagggaaggaaggaaactggcgcgggaggtccggccgccatcaatggcgccggcgagatttgcgggggcaaatccgcccgtttgaacgcgagagagagagggaaaaatggggggaaagggagaggggatcacggggagtgattcccccctctttattgcacgcgggaacggcgggaggcggcgggattcgcggcggcggcggcgctagggcgcgggggaggcggcgggagcggcgggaggaaggggatgacgggtgggccccacccgtcagcgagggtggcgggcgggcccgcccatcagcgacgcgcgcggggagaggccgagtgggccgcggggagaggagagagagggggggaggagagatgggccgggtcggcctaagggagggaagggggacttttagggtttttctttttataaaatcatattaactttgtttatttcttaataattattatttgtgctctgaaaattcaactaaaatttatttacgcattttaggcttttaggaaatatacaaaaatcctccaagccttatttgacttttactttgcacattttaattgttggaggctttcacacggattttaattattctaggcataatttagaggatgtattttagagtcgttttgggacgtgacaacaatcctcacccctaagggatggtttggcgaatcgggttcatcatcactactgatatcataaacaaccctcaaagatgatggaggacaaacacaagctaaactataacggcgacgggcgatcgcctcttggcgaaccgatcttctaaaatttcgccagaagctcgaactatctttgcgacgtgatacacgatagcgatcgtagtcctctaaagttcggcctggatgcacgcgcatccattcagcaacacttacaaccttatagctgttgccattaatcaacatctcgcggtaaataggccaaaaagggcacttaatcttcagcatgctttttatcgccacgaacttctcgttcttgttccgccatttctcaacgggaggtcgaacgcatatctttcggccacaagcctgctagcaaagcacaaaaggaaaaagtgcaaaaaaggagggaaatatagacgaagatcggttccactttcaaacgagaacaattagataagcgaaaggataatacttcatcaatagaacagagttcatattgattacaaggcgaaagcggcttaaagccgaacatgcaaaaagcctatatacaaaacctaggctaccagaaagcccgaaaggaccaaaggaagaaaaaaaataaagcacacgagggcgaagggcctcacacctcagggtggtcttggcctccatcgccttcgccctcgtgcccggtggcccgttccgatggcccgggatccctttcggtgttggcagcggcggcttcctcgtccctcgcgatcctttcaaggttctcgcggagtcgagtcttcgcacaatctcgaccaccatcctcccaaaaccctcttcgaaaggcccttaaggtagccccagaacactgcgtgttgctaggccattcttctttcacgaaataggggaaaactcccgatgtggtcgctgccgtgcgcgtgcaaaaggctaaggacgaatcccgtcgaaacacgagcgcagcagtccccgtaggcgcctgccacttcgatgaccgagccggccgcttcctgcgtccattcggaaaagtcgaacgcggttccaccttcgcccggagcaccttccgcccgcgccccaaggtcattaagggtcagccggagagtgtaacaggcctgcttggcagactctgtggccggtaccagtgtcgcggcggcagcttcggccgacacaaggcgagcttcgagggatttaatcttctcctcggccgaagcaagttgtcggtctcgttcggcatcccgcttgttcgccgcttcaaggtcagcatggagagacttgttgtcccccgaaagagccttgttttcagcattcgccttctttagagtctccgccacaatgcgtctttcgtcttccttgtggcgaaggtcttcttcggacttccgaaggcggaggcggtacccatctagcctctctaaggcagatttcttcatgcttaagtgcgcggcaaggccctagacaaggagaaacaaaaaacattacgaaaggacaaaattcggcgcgcagaaaactcatacccgcacaaataggctttccacggccgcgcagctttcgccgaactcgtttagctcggtgaagagcccaaggccgtcggtcggtgcaatgacctggcacacaccgtccacaaacggagtgatctctggccgcgtggcgaaattagtggggacgaagtgtgggcggtgagcgtcatgtccgaagcggtcggttcgactgccggagcttttccctctcgttgacggacaggcgaaggaaccgcctcaacccgttcgtcctcggaaacaatcgccttagcggccggcgccgaagcactcccacccgtcgccgcttcagcatcgctagcaggtggcggagacatgcgcctgctacgagaaggtgcgcgccgcaaaaccggcgaagtaggagtcccgtcggactcttcgcttttcgaaaagccgcgggcgacttgcacaaccttctctttctttttcttcctcctggcggtcatctccggtttcactgctgtgttggatatcgccaggagggtgttcgccacaacgacatcttgcggccgcataggcgaaacatgagaacctaccccagatttcgcaggggtaggactgggagtacagctatgggacccatcatcctcagaaccagcctccccatcttcttcttcctcctcctccccatcactttcgaccgcccccttcgcgctgcggcg

SEQ ID NO: 14223 - DNA, 499 bp, Oryza sativa
gtgtaggcatgtaaaaattcaggatgtaaaacagtggttctgtttcgtggaatttgagttgtatcagttatgatgacattacttgcttgtccttttgtgcagtatcaggtctgttgcttgctaaaatcatatgaccaaaatatgcaagttttcatatcaaagaattcagagcttagagagtaattgcaactgcatgacattcagaaggaacagagatgacttggctgcagtcaaactctcttctcaggtatgtagcaggggactccgaacctgctgatgtcaagggatattgttccagttttcttgctgagctgaagaatgagtaggcaggtagtgaatttcgtgtccgtcagtctgtgttggtactacttggtagtaggtgttccatttacacttttttggcttaaactgaatccaatttttctggcttaaatttgatgttgagatctgaaatcttgatgcacaacatgcactctgcgattttatgttactggtattc

SEQ ID NO: 14224 - DNA, 5669 bp, Oryza sativa
tgcactacaactcttagaatgtgaacagagtgatccaagtggtagaaatattttcaaaaggccaattttgaccaaaagtcaattttatgagaaaaactataattctggaaaactactacttgaaaaatgtttcaaaaggactccaatatgttttccaaactttagtttgcaagaaaaactatttgtaaagtggaaatgcattttttggccaaaattctagcttctaggatcttgttttggagcaaaactatttttctctctacaagcatttctaaagggaatgtgaaaatgagcccaaaacaagttagatagagttggtcatttcaaatgtttttggtttttgaaccttatccaaaaggccaacctattaaaagaaatttgatgccaaaactcaccaaaaatcttaactaggccatatatggtcactttctagcacttgggtgagtttatttcttaaacctgaataattgcatctttttggctcaaaatcatatttgaacattatgcatattagtttctctcaaataccatctcatgtgcttcttttcgcttttttttaaaggtatttgagaagagagcttttgtagcctttgcaaaaaaaaaaggcctttactatcaaatcatgaatcaatggagcaaaaaagagagatgcataaggggggtgggcaatctgaatcaaatccatattactcttgctctcaaatttgaattttccaaaaagttgcatctatagcctttcaaaagaacctttttggtcaaaagtcaaaaaacttatttaaatggcccaaatttgtgaaaatcctttcaaaagtatcccaatatgtattttaaatcttttgcaaggattttggagtaaaaatttccatttgtgaaacaaaatagcaaaattggtctcaataatatcttttaggatcttgtttttgcggaaaatgttatatttccctaaatcaaaatctattgagtttttgaaaaagttgtatataaaaattttttagagttgatcatttcaaacatttgtgtagttcaaagtttttccaaaacaccaaccattcaaactctacaaccatttgagtttcagccaaaatcttgacttgaccatttttagcctaaacttgcatatggtgggttaacccttttgagccaaagctctttgtgaatattggcttagaagtgtatctataaccctcctaaggctttacaaatgtcaaactccatggatttaaaatttgaatgtgatttgagctctcaactcaaatttactcaacctgaaggcctacaatgctcctttttatcttttcttttgataaaaaatgatttttatgaaattctttttggaaaagttactcacaagtataaagatcatatctgcaagggttcatctcatttggatttgatttgcaattattttgactctttctcattttgctcagcttgctggaattttcagaacaagcatggttttaggctgatttgtgatttttatatctcaacatgcattgcaaattggaaggagcttccagtatgacttttgatcccctatagttgaaacttacttgtaaatttttgtttgaattgtttcagctcttttggactctgtttgaatgctttttaaagcccttcttgagttgtgaaaaatttggaatttcagcttgctgacatcttgtgatttttgttttgtctatatgcttgagatattgtcacgtcccaaaacgactctaaaatacatcctctaaattatgcctagaataattaaaatccatgtgaaagcctccaacaattaaaatgtgcaaatctaaaagccaaataaggcttagaggatttttgtaaatttcctaaaagcctaaaatgcgtaaataaattttagtggaattttcagagcaaaaataataattattaagaaataaacaaagttaaaaaggttttataaaaagaaaaaccctaaaagtcccccttccctcccttgggccggcccggcccatctctcatcccccctctctctctcctctccccgcggcccactcggcccctccccgcgcgcgcgccgctgacgggcgggcccgcccgccaccctcgctgacgggtggggcgcacccatcatccccttcctcctgccgctcccaccgctcccgccgctccgcttgcgccaagcgccgccgccgccaaatccgccgcatcccgccgtccacgcgtgcaataaagtagggggaatcactccccgtgatcccctctccctttccccttttttcccctctctctctcgcgttcaaacgggcggatttgcccccgcaaatctcgccggcgccattgatggcggccggacctcccgcgccgatttccttcccctccggccgctctctcccctttcaaccctatttaaacctttcccgcgcctccctcgcccgtttccgccccttgccgcaccgtctcccaccggaatcgagctcgcgccgtcgccctctctctcctccgtcgccgacgacctccggccggccttctccgctcgccgggaccgtctcccgccccggcgttgccttctccggcttcgccgcaccgccgtcgaccccgtccacccccttgtttcgctcgccgaccaccggaacgccgtcgaccccgtcgaccctagccgcgccgccgccttcctccgctccggccgcctttttggtcgtcgccgtcgacctagggtgagccgtggaccgccgcctcttttcccccttcccttcccctctctcggccgccgctccgccgtgcctatggccaccgctggcgaccataggggcgcgggcgccgcctcccgccggccgcgccgagtggccgccttcgggcgcgccgagtggccgccgcgtggggcccggccgtcagccgcccgcgcccttaggtgcggctgacgcgtggggcccacggcgccgaccggtgtgagcccgggtgcacccggtccaccatggaccgtgaggctgccgcgtgggccccactcccgtggacccggtccgcgcgccccctcccctcggctgacgcaataaaccctttttaaattaaaaatttaaatgaagaaattcgcaaatattcatttaaagagcatataaacttcaaatggccataacttggccatttgaactcggaattggaccgttcaagtctctaatttttcttaagtcaatatcccatttttgtgctttgttcctgcttgttatatggagtttattagagtaaaagccttttcttttccgttggtcgtgtagacgctccagcttcggaagatccgctcttcgtggaggttgaagccgacgtttgggaaagcgagcaaggcaagtcacatcatccttgaacatattgaatcccagtttataaaattattttggtttaaattattgcattatcgctttatttaaattcccgcgttatcactgttttatctagccatgcctatttacctttgttatgaccttattattgttattgttattatttccttgttctccgtagaataaacaaaaccccaactagtggacactctactcatggtaccactagtatgattttaggtagatgcttcgctggttaattaggcaacattaggtggttttacaactctagactttgggaatattcatatcacctggacactatggaatggtttgattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggattagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtttatggctaggatgggttggaaactatgtcatgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtagaccttgggttaaggcaggttcgtgtgggttcacggccttgattaataatattgtatagctctggaatcgtgtttacaaaatagctttgagcaactaagtgtcttttaatgctgtttactgcaaaccctaaccctttatattataacccccttatactcccttgcatttatcctgcacttgtgggtgtgtcttgttgagtacggtggttgtactcagtcttgctcaatttttcccaaacccagaagaggagcccctggaagatgaaggctttggtgtctagctcgtgcctaccgtcaagcgcctgtggtcgtcgccctagtcttccgctgtttcctgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcctgttgggttaatttcggtcgtgacacttgtataggattagttcctaatgtttcattcttttttgtacatactcttgattcacacaaacattttgtatgcatacatttaggggtagcaaatcctatactttagttatgcatgtaattgatccaagtttttcattttcatttaattgggatctctgcatttgagtatacattcgagtatatgacacttgtggtgttgattagtactcatcatttattcatatcctttttcatacgcgatcggttggtcagcatgtggaggttgaccaccggatcattgagactaataattttattgagatgaatgagagaaataggtcccaaggattgcaaaggtgttgatgctcaagtgatatcattacacctaacgataccaagaatgacaaattgaaaatgttgaagatgtgggatacgaagtggctactatggcaagacggtgaagggcaagcggtgctcggtcatgatagaccatgcggcagtgatgggcaagcaagatgctttgcgccaaagaaccaaatccggtggtgaagggcgagtgacagctttgtcatgatggaccgtgcgaggccatttgaagctacaagtaaccgcatcaatcatttgaagaatatatgtgaaacggtttcggcatttgtgtactattaagagggaaagatggaaagaaggcattcctattggtataattctcttcctatttacatttgagtttaggaatgccgtactattaagagggatgtaacgtcgaggtgtttgtgtatgtctcggtgctaaagtgacctatcatagtgctaccttgagagaaacccaagctttaacctatcctttgagtagt

SEQ ID NO: 14225 - DNA, 4860 bp, Oryza sativa
tattggtataattctcttcctatttacatttgagtttaggaatgccgtactattaagagggatgtaacgtcgaggtgtttgtgtatgtctcggtgctcaaagtgacctatcatagtgctaccttgagagaaacccaagctttaacctatcctttgagtagttttagaccttgtttttggttgagttgggtagttctctgaatgagctttccatagattccaatttcatcaaaaacggactcccgagcgaaaagttatagtcgttttactctgtgcttttcggaaattgcgaaaaattatcggaaactccgaaaatttttcggaaaactccgaaaatttcggaaattccgaaaatggctgtgaatttgagaatggctcctgtaaattttcggacatatccgaaaatgctttttgaaacttctgaaaattacagtattagcctccaacggctagtttttgaggggctctggtatataaactcctccaccggcctcctttgagttgctgttgttcttgggcaacattagacacatccaaacccaaatagccatccccatttcccatcctttgtggtgcctctttgtgagggggatttgagaagggaagagagttggattgagagattgagaagttgagagctagtgagcttcactccatactttgagtactcgagttcatagcaagcaaatatattcgattgtgtttgttactcttggggactaaggtctcatagacggctaggcgtcgccggtgagcatccaaggttgtgttgagccacgaaaagtttgtgaaagcttcgattttgcctccgcaagggaagaaatcaagagtgaaaccgaggagtgtatttgtgtagcctcgtgaggaaagggttgaaatagacccggccttgtggcccctcaatagagatgttggatccgtggattcgaactttgggaaacaaatcaacgtgtcccctctcttggtttgctcgttcttgcgatctctcatatcgtgcttgagcttgtttttacctgatctacttgcatgcttgattaatattgttggtgaccctatatcttgtttagacaccttttttgtcaccttttgattcatatacattttagttgttcaagctacaagttcatagctagtgtttattccgttattcgctgaactttttggttgagaccggaacttccaatcccataccggaagtttgatttgaatcaaaaattctcatcactctaatatgctatgaagttgtgataattttttggaacgcctattcaccttctctctaggcaacatcaaggtcctttcaataaagatttaattgcaacgaacacaattatgtaatcggattgtagatcggataagtaatttttttagataatggaatataatatcccagcctttgctcaaaaagaactacagccaattattacaaagatctactccagaagagagtgtagttcaagacaagttgaacacaccaaacaagagaagagaggacccaaactaagaaaagaaaaacaaaatatggagctagaaggcctcgtccaggcctaggactgaagttcgccaatgcatagaccaatgacaatatccttgcacgaagaggtttctccaaaacagtgcccccaaggaggatgcgacgtggatcgccgccaccgctcgttcggaaccgaagcaaggctttcacccggagaatatggtagggaaaggaaaggggtatgctaaaacaacacctccaaggaggggaacgacaccaaaaggcgtcgccgttgtcagctggccaaatggctctgcaaggctttcgcccacgattcccagtccaaacccacaccaccaattcgcacaagaaggatcgtcgtcgatcaacaacattgtcccttcagcgatttggccaaggccaccacccacaattgttcccgccgtcaacggcacgcccgcacccggactcctccttccccgccgctagacccctttcccgcctccacataccgccgccgatgacgacgcaccatcagccggatgatggccttcaaccatcgccgccataggtaccatcgtcgacagccgccaccgccactgtcacagccaccaccatcgccagccgccacctttagccaccatcgccaccggcaccgccaccggcacagacacccccgtccagccaccaccgtccagccgccaccgtcagccgccaccgtcgctagccagcgccgccatacgccagccgtccagatccggccggattggcgtggatcggaggtgcagcgcgaagcgtgggtcgccggcatcatggaggaaggcgacacgggcacggcgttcacagccggagcattgacgagggcgccgcgcctccctcgcggcggcgaggttcttgacgagggccggcgtcgcggcacgcgccgcagtccgccgccgtcgtcgccaacttcgtcgccgccacatctgccaccatcatcgccgctagccaccccccttgccaggtccgcggagcggcgccggcgtcgaccgagcccgtcgccgatcaccccggccaagcggggagaccagatctggcagcgccgtcgcccgtcgctggagccgcggagagccgacaccgtggagcgccccaccgccgcgcccaacgccacgccgtcgccgtgccgtccccgtcgccacgacctcgccgtcccgccgccctcgtcgctaggcccgcgccggggcgaggtaatatgagagaaaattttataaggaaaaaaagtaatgtataacataatagttaagaatacatgcatgtatgtgggcatgtagtagttcttctcagttctcacgtcactagttaagacaaaatcgatccccgcaaaaaaaaaagttaagacaaaattgagattactctcatgttgacgagagaaacacacactggcctaggagatctgcttagctccagtgcaggtctaaaaggttgatgagatgcggacgtgccagtcagtttgatcctgcaactgacaagatatgcaaacagcagataaaatccacatgagcccttctgcactataaattaatatatgaattaacaaagatggaggagagaaataatcctgaaaataattggaaaaccattttcactcatgtttccacccacctattttaccctagcctagtttgccacgacctgggcccacctggcagcctccctggcttgcccacgccctgtccatcttctcctccaccgctctacccgaccagcattcaagaaaaacagccgaaagagagaggggaaccgagagaacgacctgctcgacgcgtggactcggcgtggcatcgccaagctcgccttcaacctctcccagacgcgtcgcccatctccacttcacacccagagccgaccagaccaagagaggagagccctcagcctctccgtcaccctcatccttgtcaccgaccgtggagaagacgaaggctgccgtcgtcgtcaagccgcgcacgccgtcatctctttttcgttccatacttctctctccatgccgagcaaatcctcttttgactccactttgtttcgtccgctgcagcgacgggaacgccgccgtgcccacgggtgttgcagtgcgtgcaccgagcgccgccgcaacgacatcgtcgccgttgccgtcgatttaggccaagccggagcgagctaccacgccaccagcttcgcgtagtcctcctctccatttcccctcaaaaatcccaaagaatggcgcatcgaggaaggagatcggcgtcatcctcctcaactcgggtcaccgttgccatttgccgaatccatcttctccggtgagtcccaatccgattccatgcatcagtagcatccctgtgacctcaataaccccatgaaaacacatgcatgtcaatttgatgagtggatcgagtcgttgccgtcttcccggagctctgcaccgtcgccggaccatcttcttcaccgctgctgttgtccagactttcccgcgcctcgttcaagcttcggtgagcatcgttgagcccataggatttcattcatgcatttcattcacttagaatcgagcaccaactcaacatgcagtagcagcctaagcacagccgccgctcggactcgccgccagctactccgatgttccctaaccaagaaaagtagaggaatggaatcaggagagcgttctcttcattttgtcttttgacctcaaccccaaacgagccaccaatcaccgccggcgagcttgacaatctcacagccgcctcccctgtccatggcagtgctggaggttgaagacgaggacgtcatcctgtaaataatcaaaactaaaagggtcaatatgtaactttcttacccaatgacatatgggcctaggactgcgggtttattcttagaaaactcagatctttttgcatattgatctctcactgctatgtggaccccctggagagaaaatctgagaatatacaagagagatacctagaaattgtaaaatccatataaaatcaaatatgactcattttgagatgatttaaatttctctgaaatcaccaaatcattaactttaactttatggcataaaaacttgcactcacagtacaaatttagcctctaaaattcatctaatataaatcatacataaagcatatacaaacttataaaatgcatataaaattcatctcaactcattttggaacaaactcaaatcctacagactcaccaacatgcactcattggtaaagagaaataaaataatatacttattttataccaaaagccactgaaacgattatctttaaaaatagtaaattctagataagctgaaatttagaggtttatataaaattcatcttagatcctttttgagtaaacctaagttctgtagaattaccaaaacat

SEQ ID NO: 14226 - DNA, 9228 bp, Oryza sativa
  unsure (1)..(9228): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggttttgttgatggtcgttatcgatcagtttcgaccgtcaatattaccaaaatagaggagaactagtgatgcttgcaatgcataaatatgttagaataataatattccactagtattaggtatactaaccttttgcagagattgacaataaagtgaaggagaatcgacatcaacagaaacgataaatcaatcggacgatgtcgagaaccagacttatgtatgaataggccaagaactaaaaattgatacgatgaattgggccaaaattcacaagtctgcggagaagaacaacagaggaggccaccagccaaaattgggctggattgggccagccccaggttcggcaccttccctagcgccgttggatccaggttttggctggacggcgtggatcactcgccaatgacggttggagggcaattccgaccattccaaccgccacaaccgtcattggcagcctatttaaggacttcaccttctcacttcactcacacacctcaagcaatagctctctcatttctctcaagtttagtttagtagtatctagctggtggaataggaataaagtagaaatcaggagtccggaagccttcggaagagttcgggtatggctctagcagcttttctcttctcttttgtaagctttgtacttttattagaatactcttctaaatacatttatgaatgcctattttacattatgttcatgttatactgaatatacggctagcttatctgggagatgctttggtgcgggtataatgtttgcttatgcaattactctatgtcatgacgatgatattagagtagtatctggtagtttaggcgtggtgtctagattacgggatatcattatttggggttatatattgcggatgagaggtgggccgctgatggtgacagctcagtacgggtattcctccacgccggtatataattctaagttaatttcctgaggagggtattcctccgtatttagccccggttgtatggtcatgacgggctgccgtaaggaactcggcagttaggggtggcttttcgaagtaccaggagggcattggatagagggtattagctagtatatcgagtaactagatactatgtatattagaagtataggaatagattatctttctcttttctttccacttagcttagataatatattatgagaatgagtagtttatgcttgtgtgtcactctacccttggattatcttaacccctacttagaatatgattatcacaagcaatatataaattattagtccagttctctttatatgatcttcccatgggataaaataaatacgatacccttggaatactctcgggtgaaatgctacaatggtatatccgtgcgcttgcggatgaactctataaccataatataccagaagtatttctgcgccattgctgggaattatatttctagtagtatcgttaagaaataccaacacccggagacaaccccgcctgcgcctcagcctcctccgccgacactgcgcccgccactgccggccccgccacggtctcctggctgatctggctgcgggggtgccagatccgcccacgacggcgccggatctgccccctccggccgccggcgtcgacggcgagtaagagaggcggcggcgagagggagagagagagcagcgcggcaagagggagacgcgaggggcggcggcgagagggagagagagcggtctggcggcgagagggagacgcgaaggacggcggagagagggagagagagcggcgcgacggtgagagggagaagcgcgcggtggcggagagagaggcgaagaaaaagagaagagggagtggcggcaaaaaaaatcgagagagggataggtaagtaaaaatatgagtggggcttcgtgggctaagacacccattgtgtataggagtatctctaccgggttgctttagatcttgaggagcccatccagggatatcctcaattacgagcttaagtttctctatgagtgtcctcggttagtgagaacactttaggagtggctcacgttatgatgcgctcaggatgttctccaagagtcctttaccctgcgccacctcctggctcaccggggaatccgtagttcgatctcaacttcgctgttgtgcttgtcgggtttgtgttcgaagccttcaccagcccatccgtaggcccctgcttctctggcatgtgaaaaaaaaaactgcatttttgttttcaggttctacgagcatgcaaaatctgcaggtctggagtagcagcaaatttatttatttgctcaatgttgagttggcttgacatgtattgtgctttagaaaatgtgtgtttttgacagaggccgtgtttagttaccttcaaacttctaaaaattctgtcacatcaaatatttcaacacatgcatagaacattaaatgatttgataatatggtgctaaagtaaatatttggtaatgatagattaattaggcttaatagattcgtctacgtttaatactttaaatgtgtgatttgttttgttattagtctacgtttaatactttaaatgtgtgtccgtatacttaaaaaaaatttgaccaaagaactaaacacggccagagttgttagttatactagaagtttaagcgcggtgccacgctgcgcacgctaacatatgcataagattaataagagcatctccaacagcctctccatcacactctccaaaccaaaatttagccattttaaacaaaaatcatactcgaacagcctctccatcccagaatagccaaactccttccctcgctagccaaatttggccagcctactccacgtgccattcacttgccatccgtggatcccatcacctcccattcacttttcgcgcaacgtggcgagggcatcggtggcgagggcgcggcaacggcgtggtgaccgagggcgcggcgacggcgccggtggccgccggcgagccccatgaccccttccctcctcgccttctcctcctcctccgccgcgagaagaccggcgcctcccccttcggcgcaacgacgaggagcagccgcgcctccgcgagccccccgtcgcctccccctccggcgcaacgacgaggagcaaccgcgcctccacgagccccacctcgcctccccctcctgcgcaacgacgaggagcagccacgccgccgcgagctcgcccccgccgcgcggtcgttttaccgcttccggaccgacgacgacgacgtggtggacgtggccgtctccggggaggatggggacggcggcggcggaggcggaggcgggagggtacgcggtgtccgtcgaggtccctggcgctcgcgggcgggagggcgggctagtgcttcgcgcctcggggtttggagagggcgtcccgctggcaccggccgccggcggtggctccctcgcggccgagctctccttcgacgcgccccgcgtgcccgtcggcgtcgggccgggaagcccagcgccgctcggcatgtccatctcaggcgatggcgccgtcaattttgcggcatggaaaggggaaaaagaaggaaagagaagagagagagaggggaagaagagtagaggctgacatgtgggtccattgttattttggagagaactaatagagagtttgttggtttgactagccaaattaaatagagagttagctatatcggtgtttaaagagcgtaatttggagaagctgttggatatgctctaagaatcatataacgaaggtatattggggtgtacggtgcagcaaaatggttgtataataaattaatagaacatgatgcggctcattttgctcacaaatgggaacagcataattttaaatttactcgttcccaagctccaccggcggtatgactttagtaagtttgctcaagataagaaaacaatctcagcgaaaaagcaagtctatccgatgatactaacagtttggcaatgtaggatagatcgcccaggatcgaaggaataggacctaccagttcgttctcactcaggtctctgagaatcaaaatttgaatataagaattcattatctaatcatacagaaactactgaacctatggattgaaatgttgtggtctactcatagaacagcaagagcccgcataaggccaatcacatctggaattttcccggtcagtctattttcttgaagtgacctatgtaacacgaatagaaagcgcacaacatagaggctataagtaagcatctataagcatgagaagatacgaacgaaaaatcacataacaagctagaagatttgcaataactaaggaatatttatagtgtggctacttgaagaaagactattttgtaaggtatttctctagcgttttggttatatgaaatgtccctacaatacatataagaagttcgcgtcatggtgtctgacactcatgaacaatgaaatatcactgaaatattagcaagaacatacaaaatctcaaagctagtgcagctccctatgctcactggaatggtccctgtgagattgtttcctcttacatcactgcagatttggaacaataaccacaaccaataaggataagttgcacaaaactgcttgtctaccatattgcctattcaattatctaccatattgcgaggataagtataacaatcataaaacaaaaatactgatttgcatttcagcaaaccagtagaaaataatcatatatgaaaaattaacaggagatgtggttgcacaccgggaggggaggagacgtcgcgccatgcttacgacttgagataaaggtaataggacaaaacagaagcatgttcaagatataattaatgtgtccaatacattgcattcgatatatgaaacggaatatttgtacatgtaagcttaataaatattgaatgggtacaggaagaaagtaccatcgacatgagctatcaaactgaatatttgccttcaatttgtcgctaacaggatgttcacatcccttcatgtatataaaacatggtcaagcacatccatataccatcttggctatgtctacgtgcaataatccgaccgtagttcgggattatatttatatagcttggaggaaaagttgctactttgaaccattacatttctccaatgaacacaatcacatttaccaggattcatccattctctttcatttgtcagctccattaggaaacattcaacatagcctataactttttgtagcttcttgataaaaaatctgcatgaccacatggtaaagtaagtaaaaaagattttctactttcagctttgatatttagttgtgcatacagctccaaattaagaaccgagatgcattgattcattctgaaggactgcaaaatagaagaaaagaaaatgaaggagaaggaagagaactcataccatttggatctgttcagtctcgccagcggctgtgtcgatccaaattcagacatccaaacatatgagtttgatcattcaaagaatgagaaacatgtcgtaaagggagaaaatgagagaaagcagctacctcaagacttgatattaaattcgtggcatgaatttcagtttggtttaatacttgtgtttaatcttgcgatgtatgtccctgctaacactgtaacacaacacaataaaaagtaaggcaccaaccatcagagtagtgccaacttaacattgtaaaaacacaaaaatacctccatcatcagtgcaacaccgatgcatccatgcaacatgttcagaaaaatcttgcatttagcgatgcatgtattcctgcaatagtcacggttttatgttccaaaactgcatgtatagctactctgtcctggtcattcatcttatcaaactcatcaatgcagacagcacaacgatcagcaagaactatggcaccagccaccaggccaccagactgtcttctttcccctgtccacaggattttgttcaggacttctataggaaccaaaagaatgtacgaaagaaagtttcaacaattaccagtctctcgatcagaagtgacagcagcaggcaaaccaacaccagacgaaacccttccagtagttgaaagggcaatggtcatgactgctctacggagctgggaattggcaattgaaggatatcactgtgacctgctcccttcgctgcccacgtcgccacgggactgcaccaagccgcctcctctcgccgcccaactcgccgttgggatggggagacccggaaccgcgaggcccacgtacggtcccgccaccagcacgttgaccacaccagcaccaccggctcactcagatttgcagcccgcgggggcggggggggaccgacgcggctcggaggcgcgtaaacgcgccagctctaacgggcggcgcgcacggccggatccgccgccgccgaaggccggtcgtgcggcgacggatccgccgggggacccccgttgccgtcactggtggtagggggccacgggccaccgaatgccgcccgcacggcgggagctccgccgaccttgctcgtctccgccgccgccaacaaagtctgcaccgtccccttgccgactcgagggcagagagctcctccgcgccgctgacctccttaacgcctccccgcggaggtccaccccccagatcagcccagcgccgcctcgttgtcggagaggtcccacgcctcgtactacctctcggcnccatcctcaccggcaacccgnccaccatcaccatcaccggaaactcctccttctcggccttcatacgaacctgcagcggtgacggcgcacaggaagggggcggcggcgcagcacaacgnaaagaaggtggaagncggcgcgcgggggnacggcgacagcacgcgagggagggggcggcagcgcagcacancgggnaggaggtggaagncggccgggaggcgacgggcgagnagatgncggcggcgcgcggggagggggccgcggcgcagcacagcgaggaggagttgggaggcggccgggcggcgacgagcgagaagggggtgncggcgcgcggggaggggccggcgaagctccacgtccttcgatctgcgtgaggtggggaagggcggcgaactcgcggtcgaacccggcgccgccgccaagctccccgctgtggtcgccgctgtcgagttccgcaagctcctccacgctgacgatttcttgctccccggctccccaccgcctgccctgttcgccttaaggattttagccttctaaaatttaccagtgagactgcgaatttctttattttgtgccactttcttctcttttcctcgttttttttcttttcctcgcgttttcttttctcccgagagttgtaggacggcattgtccctggcttctgcgtacagatcgattggatcaaaccgattcatccttctgctcgctgttctatttcgcatcgcccaggggagaggcggaagctacggcggcgcacggcaccgcccatcaccgcgtgccctcgttcccttgttgcgccaccaccattgctcctctctctccccctcctccgaagaaagggaaaaaattgagtgtttttggataacacttcatacttagtactctctccatattttaatatatgacgccgttaactttttaacaaatgtttgacatttcgtcttactcaaaaaaattatatgattataatttttttattgtgacttgatttatcagcaaatgttctttaagcatgacataagtatttttatatttgcataaaaattttgaataagacgagtgatcaaacgttggttaaaaaatcaacggcgtcatatattaaaatatggagggagtaccttgtatgaacagctactggatgcttttgtaatctgaactagaggatgctgcaattggttgcttttaatttgtaatctgaaattgattgcctaggatatgtaatctggatggtattctcagatttggcaatttaaacttgttagacttgttcatctatggtcaaccattatgagtatatgttgtcgaaaattctggtcacatgctgtcaaattttcggggtacatatgctgtcaattttttttttctgtactatcttttcgtgttttggttacatgctgtcaaaaaaaatacagtagcattgctgtcaaaatttccagcaattagctgtgaaaatttccaacaaaattacagcatattggattcgagaaacgcccagggctcttccggctagctccataaggtggtgggctagacgatctgggttcgaagtctcaccccttctaattatttgatattaggtcattccttaatattcgcgttttttacagcatattggattcaccaatttctcaacttgaacacacatgacatttctcggaaacatatccttcaaaaaaaaatatgtacaacgtacaacacaattgatcatttttttggttgtaacttataattacaactatgtatactctttcctcacaacactagttcaaaacagaatggagcgaaaatacataggactagcacaaattgattcctttacaacaagtgttctccaaaacttgttttttcccctgtaacaagtcttttcccagaatccaattaggagatgggactgggtgctgggtgcttctcttttgcagtgctgctgccagcggtgggcgatgggactgggtgcttcttttttgcagtgctgctgccagcgatgggcaccggcatcagcggcgggatggtggtggtgtggaggcgctcggggttgtctattggcggcggcggaaggggatgtgtggcggtggcgtcgcttgttcgtcggtgtctgctcccgaatcccaatcgatctgtacgcagaagccagggacaatgccgtcctacaactctcgagagaacagaaaacggaggaaaagaaaacgaaacgaggaaaagaggagaaagtgttacaaaatagagaaattcgcagtctcggtggtaaattttaaaaggctaacggattaaatatcaaatcctagcgaattggatggtaaatccttaaatttctcgggtggcaaatccttaaggtagtgtttggttgctgggatgagatgggatgggatgggacgaacccacttttaggggtgtttggttgaggggtgggtgggatg

SEQ ID NO: 14227 - DNA, 3000 bp, Oryza sativa
gccgccgcctccaggaccagcagccgcttcgtccgcgaccgcctccgtctccgcgaccagccgccgctttgtctgcaaccgcctccgcctccacgaccaactaccaccgctcgtccgcgcctctcctcgcctccgcctccgtgcgcggcatccgcctcatccgcgaccgccgccgcctccgcgtccgaccaccgcttcgtccgcgaccgcctccgcctccgcgacagactgccgccgcttgtccgcgcctctcctcgcctccgcctccgtgcgcggccgccgccgcctccacgtcagacgccgcctcgtccgcaaccgccttcgcctctgcggctgactgccgccgctcgtccgcgcctctcctcgcctccgcctccgtgcgcggctgccgcctcgtccgcgaccgccgccacctccgcgtccggccgccgcctcgtcctcaaccgcctccgcctccgcctccgcgaccgaccgccgccgctcgtccgggcctcgcctcgcctccgcgaccgcctccgcgtccgtgcgcagccgccgcctcgtccgcgaccgccgccgcgcgcgcctccgcgtccggccaccgcctcgtctgcaacctcctccgcctccgtgaacgaccgctgccgctcgtctgcgagctagccgctgggagccagacggccctaacggtccgtgaaagttctccatcccatcccacctcaatcccttctatcaaacaaaaaactataaccatcccataccacaaaccaaacagacaactggaaccatcatatcctaaaaaactgggataggtctaacccatcccactttgtctccaaaccaaacacacgctaaatttcttggggggaggggatagatgtgatgtttttttcggaaaaaccctcgagtttttcatgtttacagcgttaccctctaggagtagaactttatcttcttcgtgttgtatttctataaaacccgagggttgtttcgtataaaatgaacatgatgttagtcggtggaagaacgtgcgcgctattccgttcaaacacgagaagttttttttgtaaaactaccagcacgcgtcattgagaccggtagaaccggtaaaaaaaaaggaacggctccattgcacacccaatcgaggagcttctacacctgcaaaggctgtttagttcgcgaaaaaaaaatttttgggtgtcacatcagacgtttgaccgaatgtcgaaagggattttcgaacataaataaaaaaaaactaatttcataactcgcttggaaaccgcgagacgaatcttttgagcctaattaagtcgtcattagcacatgtgagttactgtagcacttatggctaatcatgcactaattagcctcaacatattcgtctcacgatttcaatgcaaacgtgcaactagtttttgtttttatctatatttaatgctccatacatgtgtccgaagattcgatatgatgtttttggggaaaaaaaattgagaactaaactgggccaaagtacatggcacagctgacgaggagccaaaataaatttaaaaaaaaagagaaaaagggtagcactagggcttttattaattgatgatttgtcgaatccaatccactcgcggatggcaatctccaaaaaaaaccactctatataaatttactgcacaaggctaacagtagatgcatgtttttctatagaaatttcatttgtttgtcaaatccaatccactcacgaagaagaatgatagaaggcattgagtgtgtttagttcacgccaaaattagaagtttgattgaaattggaacgatgtgactgaaaagttggaagtttgtgtgtgtaggaaagttttaatatgatggaaaagttggaaggttgatattattaaatcttcatttcttcatttcttcttgtactagagtagaaaaggttgatattattaaatcttcagatgaagtttcagctttgttgattcttgtggttatcagggtactgaaatatataaatgtattgaacggcaataactattaagatgttaatgcaatggttgtaatatgtgaaccattacaaccattataatggcaattacagtgaagcttgattctttgttattatgtaaatgcaaatggattgccttgtttatagagtctacaaaatgtagcttgaatcaagatatatggtgggaaacatgcatttgcatgtggctatataattagcaatatattaaaccattcattttatttttgcctgaatcatatgtttgatttgtactattatagttgtagcatttgcccatgtatttgatttgtactattatagttgtagcgttagcatgggcaagttacaaaaattgcctgttgatgatatgaagaaatatattgccatgcttgaaaaccctttatctgccttgccttgcatatgctttatcattcacaaccagggaagatgctttatcattcacaaccagggaagatgctgccaggtagtcctttcttgatccatagtagagcttatacaaaatcatatatgcgaatattgcagtgagtatccgtaaaattttgtggaatttacgtcaactaattaagttttgagattatgttgttaatattggcttgaagataatatggatatgggcgcaggctggtaacatgcttgagagaggataaaagattttctcaaattttcaaggtggtggatctggtggtcagttgatagaagatagtgtgaatttggtgcagaatttattgtaatttgagacttttgagtattgcggatgtacggtgacgaatgacgaaagctttacaactaataagtgtttactactatctttagttttatggtttgtttgattttataaaaaacatattctaactattgtactgttatcttgtccggatataatgataggaattcgatagtgttcctagcagcttgacaaatgatatgcggtatccagcattagtgatgttagtcagcaatgctcacatcacacctcgacctaccttaacctaacaatagtgtcct

SEQ ID NO: 14228 - DNA, 489 bp, Oryza sativa
cgatgatggagacggcggaacgctcaaaaaggagccaattcaccttgacatcctcggcagggtaggggttggcgatgtagaaccatttctgcatccagttcctgtcccacttggccattgacgcgggtactggccaagcgtctgagcgctctggccgcaacatgaagttcacacagccgaagacggttttccttggaccggccggcgtctgcacgtccttggtcgaggcgcatgctgtaaaaagagtggggaatagctcggcggtaggggcgaacccacaggttcgacacatccaagcgaaaaccgccagctttgggaatgctgatgggctaaactggggaagcctgacctcatacgtcgcgagcacggacgacaggaagtcgtcacatgggaggcgaagcccagcggcaaagtaggcagcgaagacaactgttcgaccatcactaggcgaagggacaacggcttcacccccacatgatccttggccct

SEQ ID NO: 14229 - DNA, 830 bp, Oryza sativa
aacattatgcttcttcatcctctgtttatgggatcatcaagagcatgttgagttaggaagtcactgctccccatcttagctctagcagagaagtgctcaacattgtggtgcgctatcataacgattgtagtttattatatagggacaacagaggcacgccctaagtggaaaaataagtgaaactagcggataagatcacttgattatttgtgtgatcgattagggataaaagttacaaaaccagaaggttaatttggtgcaattttcgtatcttaacaacttaatttgcttgatggcccgcttaagcgggccaccagtgataatggaacttcgcaggtggacgcccatcggaccatcggacccccaaccataactatgcagctgggtcatcgcggccaaaaataatacgatttgcctgtgaaatttatggtctcgtagtgaaaaatcgtttttaagtacatagcgaatgccatgaaccattacatctactgttcaattttcatttacacccttggaaatggcctaagccctaaggtgagtcaaccaaggtttagttgggcacgtgcgtattgttcttcgtgatgataagctcgtaggcatacagctaggcatggtgacgtgcgtccatgctgtcacatatgtaggcagatcggacgagcgtcttgtagctgtaccccaccgagattaagcgagatgcacgctaaaactatcgatcataaatgatactcatccgtccctcattgactttttttaaatagtttgaccgtacatcttattcaaaaaatttaaataattattaatttttttctattatttgattcattattaaa

SEQ ID NO: 14230 - DNA, 657 bp, Oryza sativa
accacgcgctacacacacaagcgaggaaacacacgacttatgactctaccctagagggtggcttaggttctgcgacgggttctccaagatcttcactcctgcttcacagctggcttcactgcttcctccacttcactagcagatcctgcagtcttctggagcttcggcaaacaactgacgatgtcttcttcttcactgacctgaccatctagtactagttgaaatccgaacaaggaagaagggagtaaaccttttgcaaatagcattaggggaaggagaaaggaactttcgcaaatagttttatttataaaatatgtccttaggttttatccacttggcttatcctacagtcgagatggctctgataccagcttgtcgcgaccgggaaaatttccttttcccgaacgctagtgtattaatccccggcccaggaaaagccggggtacaccacacaaacatgatacgaaaggcacatctttattatatcgataatatttacattattacaaaggcacttaaggcctgacaatcaaaaataacagcagcggactagcgggcctacggctccatctttacaggcgctcaactggtgtataagccaggactccacctaagacatctttttcaaagcttctcttacttgagaggggaaggatt

SEQ ID NO: 14231 - DNA, 348 bp, Oryza sativa
agtttatcttctcatacagcagttcgttagtcacactatgcttcaatgtccactcatccttcgagtagacctcaagaagccatattgacaggcttatggggacagcgttgtattgactgaggtagtacaatttcccttcggattgacagatggaacctggcaaccaatcacgcacttcttccaccccttccattttcggcactttcgttgtacgccatgtcctcccttccacatctaccgacactattgaacgctgataggaaaccaaatgcagcatgccattgcagaaggcacttctacaaatatcagatatgcccggatcagagcaccattcactttacctgtaat

SEQ ID NO: 14232 - DNA, 5850 bp, Oryza sativa
tcagtttgtgacggatgcgaggctgtggttggtgttaaggtctactcttcggaagtcggagaatggaattacagtgagtggaattacggaaccagatcctctgacgtgaactgctccctgacatggtcactaacaggtggcctgagagcggtggggcccacatatcagtcgtcacgtccctctgacttcacctcagaggatcccaatcctgaaattacagggaaagcgaatggccccacagtaatatagtatatgataatcaaagtgtctttctcaatggcattgctgcatttagtcattcgtcagcctcttgtggagttgtggtagtggcagtggatgtgaagggggagatatggaggatcttgcctgtgccggagatggactatgcggaagaaacatatggttgtgttgtaatcagttctatcggtcaatccaaagggaaattgtaccacctcagtaaacacaataacaatgtcgttttaaacttgtcaatataggttcttgaggactattctaaggatgaatggacactgaagcataaggtgactattgaactgctgtctgggaagataagttgcaagtaccaaaccatgttctaccgtggggttgcagttcatctagactgcaacttagtttactacattgctgattacatactgatgtcgtatgacatggatcgtaaggaaccacgtgttattcaagatcttgggtcagattgtatgatggagtatcttccctatgttccactctacgcaaaaacattgtctagcggccgctaggtctatttctttgtcatgttgcttggcatttgatcccatgaaatgatagttagaccttctaagtatctaggccttttgtgaggatcagcatgagtgcttttctagttgtcatttgtaacatgttggtctgccacttattatatcgaatgattaatgtttatgtttattagcttatgactgtaggaatgtaacaattcaggatgtaaaaacattgttattctttcttagtgtttgagttgtgtcagttctggaaaagaattagttcgcttgtgctgttgtacaatatcaggtctagggatggcaattgtgcccgtttacccgcgggtaaaaaccctattagggttgggtttgttctctattttatacccatgggtatcttattgagtcaaaagctatgcccgatgggtaaatgggcatgggtataggtaatcactacccatgcccgctttgcccgtttacccgcgaaatctaacttacatgtagactaggagcaaaatccactagaatacataagccacgttctttgttttctacggtttcccttttatttcccttattatttctctcctcttactctatcgccgccagaggagagacacgacaccgaggcggagaatatttgatgttttaagttcgattcgaacttagtagcttgtagactttttgttccactgcttttgttgtggcgggtaaacgagcacgcccgcgggcataaggcgcctgcgggcaatgggcatgggcaaccatccttacccgtcatgtagtaatgggtatacccacgggcacaaataatctcatgggcatgggtattggtaggcactacccgtgcccgtcgcgcccgattgccatccctaatcaggtctgatgcttgccaaaatcaggtcaatatcggagaaaaataggtgagttctcatatcaaagaattcagtaagtggcagtatgcttaggtgatcatctgatgaaaatgcttgagttcttatattgaagaagtttaagaaaattccatgtgaatacctttaggttatctcctggttgtccaggaagcataaacgtggtgggctggtagctctatcatcttgtgaggccagagtaagtatatcgcatcagcagctgtactttgagaaatgccaatgtctctcctgtcttcttgttgagctgaagaatgcgatggcaaggattgcatctcgttgatagtaggtggtcaactgacatttgtctaaaaattgaatctatttcttggcttaaatttgtggttaggttgtctaatgaataaccgaacagagtagtttgatgctaaaccctgttttcaccaaatacgttattactagttttcattacatatacccgtccctgagtacaacaaacttcaactttctcatttacaaaattttctatatagaagttatttaaagaattaaaataaatctatttttaagttttataattattaatactaaattaatcatgtgctaatgagttttctcgttttgcattcactaaaaatccctcttccaaagaggagatctaatgcagccttagagcatccccaggagctcatccatatttaatcctccatatacccatatgaatggccatccaaaaacgattcatcattcatatccctcctcactataatagatcatccatatcccaccctcccatattttactaatatcttccaactaacatagctgtgcatggatttacctagcaagaaaaatcacatcaacataaataaaatggacataaaagctcatttctactccattcctcattttctacagcaaaaatatagcaacataaatctactaagtttctactctactcctcattttctacattcttttctctgctcttctctacttttctccactcttttgctataggggctggggtggcaggcagcgcacggatctgcctaggcagccagcgggtgcggaggctcggcgacggccggtgggcgaggagcagcggcgggcgggcggatgaggggcggcgatgggcgggcaaggggcgtggataggcggagttgccatacggcgggcaagcgcagggcgacggtggtgggcgcagacgtgcggaggtcgcatggctatcgctgccggcgctctccttctatatctggtatgcctctccccctccaggctcactccacagctacaccctctctctctccaccctccgtttcaaaaaaataaaaaataaaaaagggcatggcgtactctccttcgccagccgacgacgacgacgatggaggggaggtcgtggaacttcagatggaggtgggagctcgatccacatgatccttgtgacatggcttaaggagagagacatactatatttgtctttcctctctccgtgtgtggcacatccgctactttaggatgaccggatggggcatccgttgaaggtgggtttttgtgctgttaaattccggatggagtatcggtagcatatttcctgaagatgatcttagtagaaatggactttatagatatatataaattagaaaatattgaataatgaacttttttttaaggatatagcaatagcatagcattgttcagtcgattccgtatcaatcttctcccaatcctctaaaccctcttccaaaaaaaaaaagaaaagaaaaaagaaatctctaaaccctactacctcgtggaagaacgaatcccccacgctcgccgcgatgcgaacgccgccgcctcttcccccgtcgccggcgccgcctcccttcctccaagccctagatccgcggcagcaggtacaccccattcactcctctcgccgccgccgccgctagtgtggaggaagaagtgcatgcggcggagaacatttacggttctctgccttctctccctgcaagatccgccgccacttccttctccgtccggccacctcgtgtcttccggatccaggtacatatacttttcgactgagatttcttgtctagtttcatggatgtacatggatatatcttttcacctcctgctgttacaacttacttgtgtggttaagtttgctgcattttgattttcttgattctttcgtttttcagagcgtagcgttttttagttcatctgttgctaagttaagacctttcaagtctggtcaaaggaaaaagctcagaaaatggtagatatcatagaactccaagttgttagttcgttgtttcactttcaatgagaatgtcattgttcatgtaaaattattcatatcttttgaatatggcttcctgatggcaagcagtgcatgtaattcagaaggtgaaatttcgtccccagtgttgctgtttggatcgtagaatagttctctccttccaaagctttgctccagtttgttcggaattatcgtactttgcaagagactgttcttttactcaatgtccacatcactctgctcagaccatgtttcaggctatggctgcagatgtagaatgaaacattttgtactagtaggtatattagctgtccaaaaattcctcgaaatttgcacatagttttgcagaaaatctaacgagttaaagctctgaatcctaaaatatcccccaaaaaacatcctctgaattctgaagagtgaaatatctgaatctgtagatgtaaagtcatatatgtagcagttatgcacgcagactagcagtctaccagttttaggtttagttgccaataaaacaaattttttgatgtactgattggtgcacttatctcctgatattttaagttttaccttttttcggcatctttgcaaggatcactcttttcctcactatatattgatgttatcattccattaatcatgttgcctttcataaatatcaatataactcttcatgtacaatctggtttttaatgtttggaggcatttactctgtgaaacagattccctgtttagattactcttttcccattatatattgatgttgccttctatctgaatgatccctgttatgcactacctagtttttttttttttttttagtttggttgatcaatcaatgcaataatattctgtagtgtaaagcacatgttcaagggaaaagggatactcgaatcaagaagcgggaagaagatgatgacaatattatgatattatgattcgtttcctttttcccgctttgcatcttttgggtactggtggtgggggacagaggaaacatgaatctatagctcaagttagaaggctatgtgacaaatttagtgcctctgttcaaaattgtgttattggtataatttggatttcactagtttattttgaagattgtgctttacttaatgttctttctactgtgagttatttctacttttgaaaattatctggaaacctgacctttcttgtttgttgttttgattagatctgaggactgaagactactgccagtttcagggaggatttctactcagtggaagcttgtgttgtagctggtcttttgatgaatctattggtctcaaatacattgtagaatagtatttgttggttcgttgaactcaatgggttctttgccgtccaaagccactggtgaggatgccctagttctatgcaaggagcgaatgcgccatatcaagcgagctattgattcaagagatgcactgtcggcatcccacctatcatatactcagtccctccgtagtgtgggtactgcattgcggcgttatgcggagtctgagatctcaacagaatcatcactgtccatttcagaagcagataagtcaccatcacattcctctatggcttctccatcgccttctcaagcattagagagcactggttccccagtacatcgaggtagtcagctgactcctccctcaacaaagatccattacatgaaagcagcaggaacaaaacctttaacaatcactattgatccatctgctgctgactttgtggggcaagaatccccagtctctacctttgtgccgccaccaccaccattgccccctgaattatgtacctcatgggatttcttcgattccaattatgcttctggtagtgccacctcaaataatgagaatggagtgacattaaattttagtagattgaagggtctgagagattcaagggaatctgaagcagt

SEQ ID NO: 14233 - DNA, 448 bp, Oryza sativa
catcggcgatccaacaacacttttgcagcaccagccagaggaaaaaccagcacttcgcaagcgcttgcgcatgctagagggggtcggtacacgcgaacaagtgttgccccgtgaagaaagctttataagccgacgaggtagatcgagaaggcggtattgttcgaccaccgccagataaggttgtcctccatccgaggttgcagctggataggctgtaccatgtcccagagcaggaggaactggctaaggattaatccttacacggagagaggatatactccctccctccagttccatattagctgacgttttagacaaggttgaggtcaaacttttataactttgaccatcaataactttaaaaatatttagtttaaagaaattagaacaacatatatagatttgtctttcaaagcactataataaaagtaacatacatttatttatt

SEQ ID NO: 14234 - DNA, 9378 bp, Oryza sativa
gttatagaaataaagagatcgatcgatgcaaagggatgaagaggaggagtagtaggatggacgtgataaagcggtaaaggtaaaggggatcagattcagagagggtttagtgatccaagaaaggctctggatttgagcccggataaaagcagtatatccccagctacatatgggcatgatacgtacattccctttgggcatttgcgtttgcatgtatatgcgccccatgcgaatgatgcgagatgcgtttctcgacgcatcttgcgcgtaggatgagatgaaacaagcgcagcgcggcgctctgtcgcttcagtagctagcttaggtgcagtaccacgtttccttcagataaaacacacgtcgcgtgcaattcagggtttacagtctcgtcgagccttcgaaatgcgagccctagaaagataattcctctttttttaattcattttggtattgacttcgaaaaagctataaccaattattatagagtttgcagaactaataattgcgaattacagaattatagctttgattaaataatcataaagaagagatcataaacaaaacaagaaaaattactaagaaaatcctagaagaataacatctttcgtacgcgaatctggatatttgtgtagtcttttttaagagatcatttcaatccggttcgggaggctcgaatttaaaaaattatagtgaaattcgtcgaagctgtgagccttggtgatattcagagtggtgttttggtatccctttcttctttacagagcatgtaccatcgtgggctttagtctcgtgcaagagataagggcttgcgctcttgggccggaaaacattgggccggttgatgacgccgtccatgttccccgtaagacatttcttgatttctgatggctctctgcatctctgatcactgtaattgagcattagtgcacgatgttatctgaatttggttcaagtctctggacaatgtacttgagcatgatgttttctgaatttcatgcaagtttttcggataaaaaaactccaaatcctagcatatgtaatccacacgtactacatattgtaacatcctgtttgttcttgcttcgacaactttctgaattctgatacaacgaaactgaccactctagcttgcatatgaaacatctctaagaacaattagttaagaacctagaagagttaaaacacgtagtagtacatgtaatcgatcacctctcacactacaggagggatcgatcacagaatctgaccaattaaacacgacatctacaaaaacaatcacctagaattgtactccgtactacacaacaaaaattaattaacaatcataattaattcctaaaaataattaagcttcgaaaccctactactaccaatcgagcgattaactgacggcgattacagcgaagcgctcgatcggatcggagtccggtcagtacccgccggcgccgccgctccatccgcctcggccggcggcgcccatctggttgccgccgatcgccaccgacggccgctggttggcgttggtcaaatactgccggacggggtcatccgtcggcggcccggcgagcgccaccggcggcggcagcggcgccgtgatgacgtactgctgcatgaccagcacggacgccatcttggagaactcggaggagacgaggaggtcgccgatggggccgagctccggcgactccatccactcggcgagcgccgacgtcagcggcgagctcgcctcgccggggtggcggccgacgatgtacagctcgtgcgcgttgtccagctggctgcggatggcggcgaccgtctcctcgctgttggccaccacctgctcgacgtagaggatggcgtcgttgccgaggttgcgcgaccggaactcgttgaggtactcctcgtccatctgccgctcgctcttggcgacctcggggacgacgttgatggcgcgggagtgggcggcgggcatcggcggctgcggcggcgagatcgccggcgccgtgtaccccggcgggattaagcggacgatggtgaggcacacgcccgggttttcgaccatccgccacgcgtacgcgagcccctcccggtcgtcgggcccgccgaagaagaggagcgcgacgtggtgcacggccgccatcctcgccgcggcggcgctgaggccgcggtcgacgaggatgccgacggagcacggcgccgacgcgaggatgctctcgttgaagccccggagcgacgcgttgatgggctccatgccgccgtccaccgtctgctgcttgtggaacgggagcacgatgagcgagacgtgcttgtcctccgccagcacgcacacgtcctcgtgcatcgtctggtacggcgacaccgccgtgagcgcctgcaccgacacgccgccgaccatctcctcgtagctctcgaacgcgttgaagatgtggtcgctggcgccgcccgggttcgacgccgagtggtgcgcggcgagcatgttggaggcgcggccggtgagctcgacgaggtggagcgcgtagatgaagatcggcgagcgcttcgtcgggttggagagctcgagcagcgagatgatcgacggcacgttgcgggtggtgtgcacgcacgccagcatccggagctccgcgtcgtgcttcgaccgctgcaggttccgccgcttgtacccgaccagccgccgcgccggccggtacaccgtcgtcaccaccggcgtgaccagcgccgtcatggccaccgacaccagcaccatcacggcgaacgactcgtcgtcgagcacctccttgtccctcccgatgttgaggacgatcatctcgacgaggcccctggtgttcatgaggaaccccagggcgacgccgtcgcggaacgtcatggtgtaggagacggcgatgaggatggtgcccatgatcttggcgaagctggccatgacgaacacgagcacgaggaggcccacggtgatggggtcccggaccttggtcacgttcgtgcggaggccactgatggcgaagaagagcggcaggaggaggccggtgacgaagtcctcgagcttctcgattagcacgacgccgagcgggccgctcggcatgacgaggccgtacacgaacgcgccgaacacggagtggatgccgatggcgtcggtgcagacgccggcgaccatgacgccggtgaggatgagcgtgatgtgcacgtcgccgatggcctccccctcggggacgcggcggacgatccaccacatgagcgggcggacgacgtagaagcaggcgagcacgaaggccaccccggcgatgagcacccagagggaggagaaggccgaactgttgacctctgagatggcgatggcgagcgcgaggaggatccaggcgcacatgtcgttgacgatggcggcggacatggcgatccggccgaggtcggagttgagcagcttgacctcggcgaggatgcgcgccagcaccgggaacgcggtgacggagagcgcgacgccgaggaagagcaggaaggaggcctggtgcacgttcttggacacctggtgccggaagatgaacgacgtcgccgtgccgatgcagaacggcagcgccatgccggcgacggcgatgatgagcgccttcttccccgacctcctgatggtgttcacgtccatctcgaggccgaccaggaagaggaagtagaggagccccaggtgcgccaccgtctccagcgtcagcaagctccgctccgggaacactttcaccgcccacgtcgaaacctgccccatcaccgacggccccagtatcacgccagcctgcatcaccaccacgacgacgacggcggcgacacagttaaccaatcgaccaatgagaatagaacaatggcggcggcgaaggtggcgggcgacgtacgaggatctccgcgatgacgcgaggctggcggaagggcttgaggaggatgacgaggaggcgggtggtggcgacgatgatggcgacctggaggaggaagagggggagggagaagtcaagaggggaggcgccctgccagatgccgtaggcggtgaccatcatcggggagtagcagacgaccgcgccggcgccggtgccggccttgccacgcgacatctgggacgcggaggtggcgttcttgatgagcgggaccgcgccgcccgtgccccccgccgccgccgccgccccactcatgatcggggccatctcggcgcatcggcgcgtcgacgagagagagagagagagagagagtataagctggtggcgcgcggcggtggctgtgagcttctcgttttcgtccggctccccgtggcgcgtgcgatccgatccccacactgcctaattttgacgtgccctggccgtcgcagctaaaccagttgaagtgaaagctgcatgttcactatcacaaaagtgtataggccggcccacccgtattttgcggcccaaattttcgtgggctggtttgggtctcgatccaaatacaggtgggtgggcctaaatgggccgagttcactgtactgtttacccatgatagggaaaatatgtagtactccctctgttttatatatttcgctagtaataacaggcacgacagatgtgtgtttctttatatatatatatatatatatatatatatatatatatatatatatatatatatatatatatatatatatattaatatttgtaatattgtaccaaccaaatttatacatctcgtcgagacacaaccaaaacaaacaataggaaacattaatgataatgtggagaggtggtgccatcgtaccaactcactctcagttccatcatacgtgcatgtgcggccatgccaactgcctacattcctccacatataacttgcttctttatgcccatatccatcactacaactagttaacaacttataataataatgctgatatagtctcatctctgcatatcaaccaacatacaacagaagttgcacaaatttaggggaaagaaaaaatgttaaccaattttttatcggaaaggctatatggctatcgcatgtttttgttaggctgtatcattcgttttttggtcccttggattttgtttgagattcgtgctatctagacttttgttttcttttgtatgtgggcttttgattattgtaagttcgggcttccatacgtgggctaaatgggcttctttttttttttacatttttgtgggacccactttgtgttgccgacagagagagatttttttgtgagagtgtgttaatggtgggacccacatacactattcaaattttgaaatccgcaccggagagagagattgtctgaatcagactagagagagagagtgtgtgagagattcattttgctttttgcctttttcctcatcgtctcgtccggcgatttcggcggagatttcgtcggcgacttcgggaggcgacgacgggcgtaagctacgccgcggcgtggattcgtgcaggctacgtcgctgtcacgcccgaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccagctccactcccacaggcagctcagctggggtataagccaaacgtcttctcctcctagatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagttgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggataattttaatatgtagatctttattttatacaacttttgcaacttgaaccacattaaactgagttacaatgaattagttatgaattttcaaagattaaatcggattaaaacacttatatggattttaattgaattatgacgcaataatgaattatttttgaaaaggaaaagggaattattgcgtcatcaaaggcggtccgggtgcacgggacggtctaaggaaacgaacggccgagatcgattctatccaaaacgggcggccgagatcaacttgatctaccgcggttcacgggacaaggcgacgatgacatcagcggtgacgtcagcgatgatgtcatcaccggcgacggctcggccttgcgcgctcgtcggcgaacgacggcgcaacgacgcaaacggaggacaccaacgggtagaggacaacacggcgaactcaccggtgaccaaaaccacggtggaagagcaacggacggcgccggcgacaaggaagaagcggcgacggtcttcgggtcgacggtgacggcggtgctccggcggtcttctgcggcggcgaagaggtggacggggacggcgacgacctcgcgatcccgatggtggcgacagcgaccaacgacggcggctgcaacggcggcgcggcgcggctgaaccgacgacaacgacagcgacggctagggctacgcggaggcggcgctagacgcgacggcgggctaaggcaaaggtggcggcggatagaggagagctcgagggtgcttataaaggggctagcgagcggcgacggaggcccacggcgaccggcggcgagatggaaagctagggttggagggagaaaagtcgatccgaatcgagctcaaatccgtcgatttccaaacgtaattgaccgaagtttctataagagaaaaggaagaggagatcgaggagattatttcccctcaaacgatttcaccggaaacggaaaggatcgaccggattggaaagcggcggcggctagggtttcggccggcagcggcgcgaggaggaagacgggcccgacaggtggggcccacctgtcagcgggagagagagagagaggagagcggtggcttggttgcgggccgacttgggccagggagggagagagaaagagagaggttttgggccggctttcggcccaaagccaaaaggaggatttaaaaacatttttctatttaaattattcatgaaatgatattccattgattaaaaatacttccttggctcaaataaatcccagaaaaatctaggaactatagaatcaagtaaagtatttaacaaaattttatctaacccaattttatattgagatttagcaaattagatcttctcttttaagatcatttctaattattccttttaaacaacaatttataatttaaggatttttaaacaagaaaagctcttaacaattataattagatcattattgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagtcgcggcagtgattccactagagtttgcggtgtgggcttctccatcttgtcctcgagctcctcctcctccttttctccggtgagtatgttttgattcttctccagcttcatttgttagcttgctgctcgattcgttgttgttttgctccgctagttgtgctccttttgccgacggagagagagagagagttatagaaggagaggttgacgatttcgtcgtctcgttctcatcgtctccggcgacgcggcggcgatttagcgaggcgacaaggctgctcttcggcgagccgactcggtgtctgctgctgttgtggaggtgtcgcaccgtcgattgcgcaagattattccagtggctttcctttttgttttttttccttttttgttcatttccatctcctatttagcatgctacatgctgttgtggagctgagaagtaatgatctgacccgggaggtcggtacatttccaattgagctgttgaaaagcatctcttaagtcgatttgagacgcaagtctctttttgacccaaacttaaaaagaaataaatcacttagtgatttcaaaatgatttcaaacaaaag

SEQ ID NO: 14235 - DNA, 5788 bp, Oryza sativa
aaaaaaattggcatacaattttgcaggagagaaaagggaaaattcctaattgcaaatgcacagtgaatagttacatgcataattgcataccaatataccattcaactttacaaactttacttttgtctctgaaaatgaaagattaatgtgtaaattacaagtaaattattaaggacaattctataaaagaaaacttggtggaaaagaagtaaacccaaacctttcatggatcaaagaaaaccactgcaattggtatcatgccttataatgctcagcttcgttccaggaagaacacctatatctttgtcgatacctatttgagagctcaataggaaacaccactgctctcccaataactaaatcaaatgtgaacagtgcacacctcagctagccttgaaccatcaccggtgatgttctggctatcagccatgcctacacaggcaaaaatgcagacaaacacagctagcgccgcaagctgaccagtgccaatctccatgaaccaagagatcccaaatggcttcttgactaaatgaactttagagtccggcaagaatattgtgttctctatgactttactctagcagtcattctcgataatcaagttcccatagttgaaaatgggggaacagagttcgcatgcatcaggtgagataatcatttgcttcagattcctagaaatgaccaccacaagttgcttcaagaaagagatcaatggccgaatctccttctcagcaatcaagaaaccccaaattgttggcaagtagccagttcataatcttgctccacaaaaaagtgcagtttttaccagcgcttgcctaccaactacttgatgaaatgctcaaatgacaaaatggcaagcacagctagccttcagggctgcaaacgcaaatagaaaggggaaaagatgccatcaaagtcataaacgtgctaattaatcagattgactgtccaaagaaaaagatcaggaattacctagcgcttgccatctgatcgacgcagatatcgtccagagcggacatggagacgaagaccccagtagtatggagcgtaaatcaggaaggagatggcgatgctagcaagaatcagacacatgagtcctactgttgtatccatctcgcattgcaagcgagggtgagcggctgccgccacggccagggggaacgatgactaaacagagaggtggattggtagagcgacacagccgggacggtgatggagtggttgagtggagcacgactggaacggtgagatggagtggccgagggggtggggggccgggccgccggggtggagcggcggccgggacggtgatggagtgaagcacagtcaacacagcgtggtggagcggaggaccggcgcgtccgagatgatggagaggagcgcatgcaggcgagtggagccaagtgtgatcgagggaaaagagatggcatatgtaacgctccgcttttcgtgagacgttaaaaactaattcggtaaaatcctaattgcgaaaattttcgttctttgtgtgcgagtctaagtcgtgccaagatctcatttcaaatctcgttgttccctctcatcgaaatcaaaatcctccacctcaaattcctcttccgattcaagtctccaaatcaaattccgaaattcagtcgcatcctttgaatcctcgctaaacgctcgctcccaattccgaaaaataccaaactctatcttgagccttccttgattcctccctgaaccctcgagttcgaatatcgaatttgaatccaaatccaaactccaattctctccaaatcagccttctctgtgaaagtctattctacctccctctggctcagtgggccgactcttcttccccggcccatctcctctcagcccgctcccctcctcatgtgcgttgcacgtgccctacctgagagaaagcgcctctctctctcccccgatctctctctctcgttttctctcgctctctctcgcccgcgctccgcgccgccactttgtcgttcaaacccgccaccgccttcgctctttcccgcgcgcgcgcgcgcgtggccgaccggccggtcgctgccgccgtccgccttgccgcgcctgcgccgcgcagccacccagccccgctcgccttttgccgacgtcgccactgtcatcgcctggttccgatgcccccatgccgcatccttccaaaaccaggagacagagctcgtgctcctctctctcgttctcatatcctccttcctcccaaaatagcaagggagcaaagctcgtttctctcctcttttcacctttttccttagccggcgtcacgcccgtgaccgcctctgccgccgcttggccgctagctccgagcacgaccgccagctgccgccttgaccgccccaaggtcggtttgaaccgacctcccgcgcgaaccgacctcgcctccactataaagccgagtccctcctctcaatccctcccgcttcagtctccaccgctgcagtgccatcgccgccttgctgccgccgtcctcgccttcctccgccatcgcgtgtgccgggaagccagcgtgcgcgcggagccaaagaggactctggtcgccctctctccctccccttccccggcccgagaccgaggtgatcccgcctgtgccgtcggacgctcttcccagcgatctcccgacgcggtagctcctgttctccctccccactcttcctcccccctagcttgcgcgattgctagcctatactttcccaaacgcgcgtggacgctaccccgagccccgccgccgcccggcatggcctcgccgccattgccgtccgctcccggaggccgccgctcgtcgccggctctcctcggtgctcctccgtcccatcaggcgccggaaacggattccttgaaccccgaagatgttcccaccaccgtgaatcgatccctctcctctcccggcgagttttcctctttccctcgcaggcggtgacctccgtcgcgattcgtcgtcgtcggcccttccccttctaatccgtcccgtaggctcactcctcctcgatccgcttgtcgctccggtggtattccctcctcccgccgtgcctcgcgccgccccgccgacgcgcgccgctgtccgccgtccatctcggccagccttcgtcttcctcctctcgccatccgacgcggccgccacgtaggcgccacgtcggctagaccaagtcaacccgccagcctcgtccccgctcgcgtgcgctcggtccacggaaagcctaacggctgtgcgtgggcccgccacccttcggtccacccggtgcaccaaaccgcgcgccactcccatccgaaccctagcgcgcgccacatgcaccgctcccacgatgagccgcgccaccgacaagcgggccccactcgggaccccgcaaggtggactcggcccaccggccctctctctccctcactctccccgcgccccttgggccgcctctctgggccggccggcccattagtttggccgagccgcgcctctcctctcgggccacgcccaagccgcccgagggagtctaaatcacatccctccaatttctttccaaaaagggtttaataaattattaaatcctttttcctttgattagtaaatccaataaactttgaaaatccatatattcccaaccgctcatccgattgactccgttccacttccagtaattccgtaaaattgagatctatttaatggcactattaattaggctaaataggatctttcttttgggtcttgtgtaggttttcgattgtttgcgtatagttgcggttaccggattttcgtcaatcgtggttttctcggagattcgtgaagcttcgtgaagaccttgagcaaggcaagtcaccctttgatcaatttctcctataattggaaagtcattattattttgtttgcaacttgcattattagaatcactcacgtttaacttgcttggcctcggtttgcatgccaaaccgacagacctacctagtagtcgcactaattcctgtaggctgtactaccctgactccttatcgctccacctttgtggtaccacggtatccgtgctctctgagcgcgtataccaaatatcccacatacaccgttgtttatcgaaaacttgggaaatgggtttgtaaagccttgaaaacccgacatgtggtgtcggtgtgtttaaaaataaaatgaattgtgaaaactcgcgatgcgggggttgtgcctatgtggcactgtcccgtattcgcatataaggaccgattcctgtgggaaacgcatcgagcataatcaaagtgcaaccacaaggtggaatgggacaccctggctaagtaactagtcggttcagggaaacctcgcatgccaatagttgggaacgccagggcggggtcggttggagccaaaccgggttcctggtaagcaaggaagagaagcttgctgaattaccgatcgaggtggttggagtttgatttgtgaaaactaaaatggcctatatttatgtgaggatttgatccttctatgtggcatgaggtaaccctgggtcggcttgggaaaggctttgtcgcgagcctctgacaccggccagtgtctggagtaagttcgtatcttgtgggtaaagtgtacccctctgcagaggttaactaactgttcgaacagccgtacccacggtcatgggcgggtgtgaggtggttcccgttgcgtagatttgtttgcctgtactttgtgaaaagttgttgtggattgggaatcgtaaccagaatcagcctatgtggcagatggatgacctgagtggtcagaaacgaatctgtgtgattcgggatgtctgcgggcatcatagactaggcttcccgagtggaagcggattgctttgctgctgggcagctggactctgggagtccgagaaaatgaaaaaggctctgggagccgcctaatcaagtgaaatggctctggaagccgataagtaatgatctgactcggggggtcgatacattgccatttgagttgttgaaaagcatctcttaagtcgaatcgagacgcaagtctccttttcgacccaaacttaaaaagaaataaatcacttagtgatttcaaaaatgatttcaaacaaaggatttacaaaacaaccttgcctctcttctaagcttgcattaaacacctaagtccccgtgacttgctgagtatgaaagtactcaccttgctctatataaatatatatatagttcctccgccctgaagagaagatgaagtgaagtgaagaatagggtttcgccctgattcccagctgtcgcctgtggtgttgggtgttagaccgttggttccgctgctgctgttgttgttggtgtttgcctcgtccgtgtcgtcggttgtattctcgggctgtctgagctgcaaccaaggttaaggtaaataagtcctctatttattttaaggattgctatgattcatatttgttaccgtgggtaccagcaccatgtcctgggactggtaccgagaccgcggtttcgtaggaagcggttcgcgccgttttcccctacgacacgctcctgtcaggtgtcgttgtacgacggtaccagattggggtgtgacatttaatttcatatttccttttacatttataatttgttttatttaattttttcagctcttctttccaattctctacaagcgccactggtttgttttcattgttcatctggaagatgaaatgtttgtctttcttgactcattacatgaagaaggttctgaatatcaagatgaagttaagaatagattggtcagtttattttcaaatttttaaatatatgtattactgttcaatttgtgatttggaat

SEQ ID NO: 14236 - DNA, 1180 bp, Oryza sativa
tgcccgttctgttgaaaccatgcttggaattcgttgactttgatagtactcatacccttgcaatggtgcaatattcatcatctttctctaaatgaccatcaagatccatagctcatcttatttcctgaagtctttgatgcaactatccaactcaggccgttcttcatttcttggggctgcaattagaggttaaaaaaagactaatggtttttattaaatactaatgtatagtttgattcgggatgatgattggcagtagagtagggggaatttgaattggaagtgattgatatgataagtagtactacaaagtgataaatagtactctcttcttccctaaatataagagattttgattggatgtgacacatcttagtataagaaagttgtccacattcattgtactaggatatgtcacataaccaaaatatcttgtatttagagacggacaaaatatcttgtatttagagacggagggagtgtagtgtaaacattcttctttagatgcactatattatactcagtgcagtaaaaaaattgtatacttgatgtagaattgtggatacaagcatatataaggataaatatacccgagctggcaactgacgagttggcccaggagccacagtagtagtagtacaatacattgcatatgtgactattcctacgtgggcccacttgcaagagaccagtctggctttggcacgcacgggtgattagcttagtgcttaatcaccatgtactttgtgctaatcaaaagggattaaaactagcttcgattaagcacgcgcgtgaggcggggagcaccacgtccacgcggacaccgcgtagagcggcgtgcccttccaccccagccgcaccgtgccgtcgtggtctcccgccaccgtgtagcccagcccgcccggacacgccgcggccaccagctgcgcgcgcccgccgccgccgccgccggcgtgcgcgaacccgtgccgggcgagcacctaccgccagctcccgggcccctcccggccgttgctccgcgccggcccgccgacggcgagcacgttcgcgatctccctgccgagcacgccgtgctccgccagatgcctgctcgcgtcctcgccgtccggccgcgacgcgcccatggcgtctaacaccgccgagtagtggtgcagcgcggagacgaacctgtccaggaagc

SEQ ID NO: 14237 - DNA, 1532 bp, Oryza sativa
cactgcagcgcgccgccggggacgacgtcgaggtcgacaatgtggacgaggcgcttgccgtggaacgcctcgaggatggcctggttgcacgccaggtaggcgaaccgcgcgaacggcgcgacgttgtacagcgcccggaacgcggcgttgatggccccgcacgacggcggcggcgccatgggcgccacgacgccgacccacgaccccaccagccgcgccgccatggccctggcgaagtaggccacgagccgctcgccgcacgacgccgcgtacggcgaggccatctgcgacagctcgagcagcgccccgttggcgcccgcgaggttgcccaccgacatcgccgccgcgcactccatcagcagcgcgatcatccgcacgccgtgagcctcctcctcatcctccaccgccacctgttcgacgtcggcccccgccatcgccacgcccgtcctctcctccgccgcgccgccttcctcggagtacacctccttgcacgctcctaactccggccgttgctcgaacgtcccggccgccgccgccgccgccggcggctcgacgaactccggcgagtcgtcctcgccggcgcaaccctcattggcttcaagaaatcggtggtgatgggacaacaaaggctgctgcagtggcaggttgctgctactgctgctgtatagatactggtgatgatcaagaaactgcatcaagcctagagaatcttgcatgtctgaacctcttcccgtcataagttgatttatcaaggatcaatcaatcaagtagggtttctgcatagctgaagatgagtggagcaagagaaagcaatgtgcttatatatactccctccgtctcacaaaaaacaaacctaactggatgtgacatctccagattcattgtactagctagaatacatcacattcagtactaggtttgtattttgtgggacgaaaggagtactttttgtggcaaccagcagaggctgcttgcttgtttattatcaaccgcaatcaaattttaaattttaaaacttaattttagaatattagctgtagctcaaataaaatgtttccattaccttaaaataactatagtgtgtgcaaactccgtagtatccaatacgtaacttaaaatattgaatagggaggatatctagtcctctgtcttttccgaattttttcataactatttatgtactttacaattggaaagagattagagcgccctagttatcatttgagtagtattactaggtcaacctggaagctagtggcagtgtgagagcaatctacacggcaggaatctgcgaaacatcaatctgatgattctttggctgtattcagattggccagtgtaagcttggccggtacaatgagccagcagagctgcatggttttggtaagagtctttggtaattggttaattagctcatagtttcactgaatatttaagcagctaatgatcatcctgatcacatgtgtacatcaatccggtattttccagaaaattcagaggtaaatttattggagcaaagcaattctgcatct

SEQ ID NO: 14238 - DNA, 1307 bp, Oryza sativa
  unsure (1)..(1307): unsure at all n locations
ttgacctggtattgttacaaggccatgcgaacatatttatatatgtatatatcctgctaattaattcagnctacaagccaattttttggggggcccccgggtttaaaaagaaaaattttggttaaaacccccccccgggtttggcncccctttaaaaattttttttaaaaaactttttcccaaangcggatttaaatttataaattggggccccccaatttttcccccaaaatttgcccgggaaaatttccgggataattgnnaccaaattgttaattttaaactacgtatatatactgaagctgatgatgcctaccgcttgcctttgtctgcacttacatggacgcatccaggagatattgcagagacaaacctggcaaacagacgacgatcaggaccaaaatccaagtgattagtgactgattttgcatttcttttagataatactccctccattttaggttataagatgttttgagtcaaagtcaaattgattcaagtttgactaagtttatagaaataaaatagtaatattttcgacccaagataaatttattataaaaatatatttaattattaatttaataaaactaatttggtaatgtaaatttactatatttgtctataaacttagttaaatttaaagcagtttaactttgactaaaggcaaaatatattataacctgaaacagagagattataaatgtattacatcttggcctattccataatacacggtcaatgagtctttaaaagaacaaagaaaaagagtgtgggacatatctactcttaagtaacagattttgtacgcacgagtggttttcaaataatcaattgattgattacagtttagttaatcatcaaacaagcaagctagtaagcatttggcttccagacagcgttgcatctccttttacccaagtcctaatctgtcttgacgcattgacttcggttggcgctggacatggccttgaccatccccttgcagatcttccggaaccagaggaggttcatcgccgacatcgccggcggcaccgccatcatactgtagaaccctagcgggaacaccgtcctcacctgcaaattaatcgaacagccaggaactaatttaacaacagactgtcacaaagctgaaccctgaagagaagacgattggttgattatgattacctggtcgaagtgaaggtacacatgagcgaagaagtatacgaacagtatgacgcgagcaacctgcatacaagaacaagaagatcagtatcacttggagtataagtgaattgttagttttttttcatcattttaatatt

SEQ ID NO: 14239 - DNA, 6218 bp, Oryza sativa
ctcatctaagtttaaataaaccgagagcttgacatgccagattatgaaaatgcgaagaatactagaaatcagttatgatactatgtagcagcaactagaatcctgcttagatcgtcagaagagatgcagtagcttaccccagccccatcttggacagtcaacaagcaactgaagcagacaacattcagttgcttgttgacaattcactgtcattcttaaatccatttgatgcagagaatacttaattcttactgctaattaagcacattatgcactaatgcaatccaaatcatggctcatgggtcttgtgatctcgtaggcttatcaaactaactgttccagatgcttaacagtccgattctaaccgagttaacactagtaatcaagcgaccaaccatgaaccatctcatgaacaattgaccaactattagacaaaatggtgctacaagttcagaaaaatgaatatgcagagaaacatcctctccgtgaatttaacaaatttaccactcattctgccctgtttgcagagcagaatatcctctaatcaatccttagtttgtacaaattgtcctctaatcagtactagtgaacatattaacaaaagcctgttatctctaaatgattttggcgaccaagaagccctctgctactaaattgtactcaacattctacatcatgcacacaatctaggaataaatcgtggcacagaaagtaaattcagcaccatcagtagtagcaatctatagaagaacaaatgacattcagacgatcatacaacatcgcatgatgaaagaaaacataaacgacctgcatctttcacatctagctgaaagcctgaaactgatctgtgaacagttaacaaactgaaatttggcttcggagaagaaattcagctacattgcaaatccatttcatgcaaagaattcttctatcaagaaaattaagcacggataattgggcacattttctcattgcattattattaactgcataaacaatgatgcatagactcaatccaagtactgaaagccaaaacgttgctgcattcatacaaatcatcagaccagagtccagagatcacatcacatgcattgcgttcatgcaagtctgactcagcaaggagaattatactgattgatcgagaattatcataccggatcaggaagactacatcatccacccaaacaagaggagaaggacatctcgaacaaatcaatagcgaatcatacctgtaccaggacgatcaaaactaacatgagcaatctcaggggagaagccacgccggcggtgagtagtccgacgggccttgctccggcaagaacttgtccacacgcggaacccccgccgcatccgccgccggtagccacttgccggtgtctctgcaggggtatttccccgcgacggcgcgagaagcgaacactgtcgactcgcggtagagcctcccgtcatccaggaagtagacgccctcgccgaactcgtcgcccggatagtcacccgcgtcgtacgatctggagcagcctcgcgcgacgaacagcatccgctcacccagcgactccagctccttccagccgtgcagggccttgttccgcttcctcggcggcggctgcaccatctcgaacaccttgaacgccgatgtcgtcggcggcgcggcaagaggagcaggaacgcgcctgaccaccatgaggagattgccgcgggactccaccaggtagcgagcaacgacgtctccgccataatcgcgccggccacgccagaagcgaagaatcaccctgggcgccatcttcatgttgccgtcgccgtcttcatggaaatcccgtgctgtgaaaacatggaggtcttcttctgcggtgaggaaaaggaaggctcccttgtggtgtatgacatcctccagagctggctcgtcgatggcactagggccatgccccatcgccgcaacctgatcctgggaagcatttgctgactgaacgcgccagaatgcgtgagtgcgtcgagcagcctggaagggccagtaggtgatgatggcggcggcgacacaatcctcgtcctccggtggcgaagagagcgtcgcggcgagcatgatcacaccagtgttagggacagggccgtctggccgccccaattcagcagccgtcttgtccgggcggacaaaaaaggggaggttgaagcgcagctgatggtcgcggaggctgaggagcgtgttgcggcaggtctcgccgaggaagatccagccgccgtcgtaggcgccgaagcagcgcgcggcgcgcgcgccgtccgggacgccgaggccgtgcccgccgcagccgcggagggcgcacgagaaggaagggccgtcggcgcgcgggacgaggatccacgggagcgggcggagatgcggcgcgttctgcagcggcttgacggcggcgcgccagtcgtggcagacgcgggccatggtgcggcggtcgacgaggcacgtgaggcggttgtggacgaggcggagggcttccgccatgaagtcgcgcgcgggcgccgccgcgtccatgggagaggcggaggcggaggcgggggcgggggcgaggcgtgaaggtggcggtggcgagggttgggcggcggcggaggaggtggaacgcgacgaggacgcttcgtcgttgtgcgccatgtttgaacttggcttctggaagcaggggaagagaggggaacagagtggattggtttggaagaagaagcagagaaggccagccttttgccagccgagcaagtggttgggcccaatttatagtgccggttttcttgggcctgaagtttggatcgctgctctttgctgagcgtttcttcttgggcctaaatgttttttttttttgagaacgtaaagttcggatgtacatatggtgcagaatcgtgtctagcagacaggagaaacaaatgggagcagggaaggttaacccttttttttttttttgagaaaaggcattcaagcaggttaacagttcagatggacagatggttattatcctacaggaaaaaaaaagagaaaaaaaagatagaaaaagttattggtccaatgaggtcatcatctttagtaacataggcacacatgttttctgtaggcgatatggttaatcttttcattagtgctgaactgaaggatgctcagttcacagctcgtcctttacagagagaaggggatgaggaaatgttgatacatacacaggatgcttatctctgaattccttgttcactttttctgaacttgtgcatcagtctgatggtacaacaaaaacactagattagacgctcgccaagccgtgcttttgccgaaaatatacagacatggcacccatccgacctcaaaacaaaaatatgcatggcagagctggcatcacaaacgaactcccagtttgaattttaaattcccggaaggtcacttatgaaaaagaaaaagtaaagccttcataaattttagcccatttatccgcctcaagatttggggcccaagaaagctggccctataaatgaggcccagtcccccatcccccttccaaaccaagcacatctcctccttcttccagaagcagaggaatccatcggttccattcctcctcctcgcctcgccaccggcaagccgcgcctccgcctctccaatggactcgccatggcgcgacctcgacgccgacgtgctcggattcatcctcaagcgtctcccgtgcctcgtcgaccggcgccgcatggcccgagtctgccgcaactggcgcgtcgccgtcaagcctgagcagccgcggccggggacgaggccgctcccatcgatcctcgtcccgcgcgccgacgggccttccttcgcgtgcgccctcgccggttgcgccacccacgccttccgccccccgctcccggccgacgcacgcaccgcgcgctacttcggcgcctacgacggtggctgggtcttcgtcgccttcggccaaatcctggactacgcgctactcagcctccgcaacggcacgcgattccacttccccgacacgggcacggacatggtggccgcgaccctctcttcgccaccggatgtacgatccacgcgttcatgtacgatccacgcgtgatgtacgatccacgcgttcatgtgttctggcgcatggagcatcaagttgtggagaaggcgactgctgttgagttcgtcaccacgtcagttctggaggatgtcatacaccacaagggaagcttccatttcctcaccagggaagaaaacctccatgtttttcctgtagcgggcttccacgaagacgacgacggcaatctggagataccgcccatggtggttcgccgcttctcgcgtggtgggcgagattacggcggagccatcgctgttcgttacctggtggagtccggcgagaatctcctcatggtcgtcaggctcgttcctcatcctccccaactgccgccggggacatgggcgttcaaggtgttcgagatggtgcatgagacgcccatcaacaacgacggggcaccatacgcttggaaggagctggaatcgctgggtgggcggatgttgttcgtcgcgcgaggctgctccagatcgtacgacgcggacaagtatccgggcgccgagttcaacgagggcgtctacttcctggatgacgggagactctacgatgaggcgttccaaatcttgaatccctttgcccagttcccctgcagcgacaacggcaagtggctgccgccggcggcggcggcggcggcggaggcggttaccggccgcgtggacaagctcttgccggagcaaggcccgtcgtactacacgccgccggtttggattctgccgtgagactgccatgttcttagttagattgtctgatgacttgttgtcgtgttgatatggtttgttgatttgtgcaatcgatgatgtgttctcgagatccatgtgtgcttgcaattgcttgatccatcatagcatctcttcagtactctgctattttcaccatgttagactaatgcagaaattgttggttctcatgactcagattgcattaattagtgaatcattatattgcaacgaacaatgattcagtgtgggggatcctgttcatgccaatttttcaggctaatcctcctcttccctcgccgaaagtcgcttaatcagcatccacagtgacagttatgctgaatcagcttgattcatgtcgaatttcccatgggtcaataacttgagactcgtattattttaattttctggagtctgtgagttcttatcactttttgtttattgagttccagactgaacagtaaagaatctgcaagtgatacatcgaagtcgtagtgaactgccaaaattttctcgtggttattgctggtgattaaccaaccaaccatctaaattttaccaacattttcttaccatcattcacaagatcctgagtgcaaattcagaaaaatgaacgggcaatgcagagataattatcctcctctccgcgtgtcaactttttctctcatttgatccactcttctgtagagcagggagggcagaagaacatcataatctgatcagtagttcagtactagtgaacagaataccatgacgcctaacatcaggctgtgttactgaagtaatgcctaaatgctgataactttgggtgaataaccatctgttaactgtttaaccattcttcacaacgttctaccttatgcaccgtcccgtactgccgaagcgccgccgccgtccgagaagggagaggcggtgtagcgaaaagaggggggggggggggaagggacgcggacgacgacgacgacatggagatggcgcggagctggaggggattgcctgcacgccgccgccgccgatccggtggggaagagaaaagtgagagaagggagagagagagagagggggaggaataaaggatgatatgtgggccccacatgtcagtaggtctcacatatatttttttaaaattttaatgctatataagcgtcacgtggcatgaagaccagatcaacacccccacgacaacaaaaccacccttcaaaattgctagagaattcaaattacactggtttcaatagttcggtcttacccgatattttagttaagggtcacgaattagatttgatgaacagttaaggaagttaaagtggatttttttccgaaggtaaaatgtctttctacatttgagcccattaatcttcctcacggggaagatgcacttgggggcttggggcccaagaaagctagccctataaatgaggcccagtct

SEQ ID NO: 14240 - DNA, 841 bp, Oryza sativa
agatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcatatcgcagtctaggtcatagaaacattatatggacttaaacaaggagaattatgtaacatgaagaaatagtagtacaatttgaacatgatacaactatttgcattgcagttacatagatgatattagattcgaactaggagggaggtagtgcaatagttgaacacaacgacgatgtaataatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggaatcatgtaatcaaaatattcttaccatgaaatcgtcgtcaagaatatttggacaaacaaagaaccttcgacccaatgttgtaggatttatggaacgaagaacctgacaacgatcaccacacctgtatcttggacgggcttcccatggagggagtgccgtagttagcacccgccagtcgctctgttgttcacgacatt

SEQ ID NO: 14241 - DNA, 843 bp, Oryza sativa
gctgttgttttcgtaattgattttatttgaactcttttctaaaaacatctaggtgagtgcttctcaaacgacacggttgagacagtgcgtcccgtccggtcagagtatgtgcaatgtatcaatctttagatcttagaacaaggttggcacccggccaacagtttttcaaacggccacccgggccaacaacttttcaagtggccacccgggcctagctgatcccgtcagctgctgattttccaaacatcgaaccctttttcacaacagtaatttcacaagcagttgtcaaacaaaactacgctaggaatcacctcacatccgcccatgaccgtgggcacggctgttcgaacagtttgttaacctctgcagagggggtacactttacccacacgatattactaacccggatcacccagcccgtggggatcagccacgtcgggagacctccaagctttcatgacaaggcatttccaaagccgacacaggcttaccatatgccgacgagaggggtcccagaccaacaacaggttaggtcctagaccatactgtgccaggaagcccaggggtcctctctgacaccaccccggcgaatccacatgtctctcggcatcatggctcccctgataagctagttactcagccaggggtgtcccattccacccatgtggtcgcacttgtcctatgttcggatgtaattccaaagaatcggtccttaagtgcgggagcgggaaaaccgtacacccgtattgttcccgggtccgcggtttagaaattcatttagtccccagcaccgaccccagtgtcgggttttcaagtctttttgtaaacccaagtttacccaag

SEQ ID NO: 14242 - DNA, 9147 bp, Oryza sativa
  unsure (1)..(9147): unsure at all n locations
aaggatctacgtccgatgcaaccgaaaaatgctctggtcgagtcacaccagatcaccaatgattaataattagactatagtgttagccaaaaattagctagattaactatattattagcttagccgatggcatcgctgagcatttctttttcttcttcttctttagagaatcatgtgcaaaagcatgcgtcgcactatgtaattatcgccgtgttaatttgtcctatatagnnnnnnnnnnnnnnnnnnnnnnnnnnnnnntgactaattcaagatgatctttttgatggttcatgcagtgctcgtaatgtgatctgatcatcatcaggttaaaaatatcagcctctttgcattattttataatcacgctgaatgtacgacaggatgatgtttaattgcgttttattagatttgtggatgtgtggttttcaacggccaatgtacatatcgggttagttgccattacaaaacaatgtacttaataaagtaagtttgaaatcctgtaattatgcccaagctggaattgttgttttcagcattcaatcgacagggtggatgatgcaatgttgaagaagatcttttctgtgcgtgcgtcttaaatgtggttaactgtgaggcccagctgccctctttgtccacactttcaaatttaaaaaattgtaggaattttttagcacgaaaaagacaatacattgttttaataaaagagagaaaaactcggtcgacacacctaaaataattacattgtattaaaaatataacaagagacatgagtatactctatgtcacgccccgagctagtcccgactggaattagcccgtgacgctccaaattaacctgttaatcgataccagtcccaggaaacagtgctggtatcacaggaggatagaatatcacagcaacagaggtctctttattatagagtaggagtacagtcatgttgggctgtggacagatcccgagctcacaactgcattacaaaagggaaacggaagccgggacttggaccaaacaacacaggcgcgacttgggaactaggccgaaaccctaaaagtcatcgtaaccggcttgctcctggaagaactcctcatcaacagggtacgcttcatcttcatcagcaactggggggtatttatatagagcaaggaggagtacgggagtactcagcaagccaggggaaataagtgtttaatgcaggcttcaagggaaggctgttgttttcgtaattgattttatttgaactcttttctaaaaacatctaggtgagtgcttctcaaacgacacggttgagacagtgcgtcccgtccggtcagagtatgtgcaatgtatcaatctttagatcttagaacaaggttggcacccggccaacagtttttcaaacggccacccgggccaacaacttttcaagtggccacccgggcctagctgatcccgtcagctgctgattttccaaacatcgatccccttttcacaacagcaatttcacaaggcagtagtcaaacaaaactacgctaggaatcacctcacatccgcccatgaccgtgggcacggctgttcaaacagtttattaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacacgttaggtcccagaccatactgtgccaggaagcccaggggtcctccccgacaccaccctagcgaatccacatgtctctcggcatcaaggctcccctgataagctagttactcagccaggggtgtcccattccatccatgtggtcgtacttgacttatgatcggatgaaattccaaggaaacggtccttaagtgcaagagcgggaaaccgtacccccggtacgttccccggtccgcggttttagaaattcatttagttcgcaagcaccgacccaggtgtcgggttttccaagtcttttgtaaaacccaagttttacccaagttgtttctcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacggaacaacagattaagtgtgatcctatcaatgcataatattttgcaagcaatataattaaatttcaagtataggctcaagatgttcaaaggtggcttgccttgctcgagatccagagcttgatcctcgaaatcctcgcactgcgggtcttcgggctccgaaactacacgcgaaacgggacaactcaacaaacggcgaaaataaagccctattaatgacctctaagcgtgccattagatagatctcgagatttggggaattttggaagttgaacggagtcaaacggatttacggtggggaagatattgaatttctaagattattggatttttggtctaaaggaaaaggatttaattaaatcctttttggaaaagaaaagaaaagaaaaagggagagggagggaatatagacttccctcgggcggttagggcgcggcccgagagaaagggcggctcggctgagcttaacgggccggccggcccaagaaggtggcccaaggcggcccaagacgcgcgcgcgcggtggaaggagagagagagtccggtggaccgggctcaccacgcgcggtcccgggtgggacccgcttgtcagctgctcggctcaccgtgcggagggagcacgcggcgcggcgctagggtggaggatggacgtggtgcacgcacgcggttcgcggtggacgcaggtgcggcgggcccacgcgcagcctcacggctcgcggtggaacgcgcgcacggggagggactgaccggggtcggctcgacccggtttaggctgagctggcgccgatgtggcgcctacgtggctgccacgcgggccggcgagaggtagacgacgacccggccgcgaatggacagcgggcggcggcggcgagcggcggagcgaaccacggcgatacgggcaaaagctagcacaccgggcggttgttcgtgatgaggggagacgaaccaacggctcggatttgccgggggttgctcgacggcggcggattgcggcggcggcaaccggcggcgggagaagggggaaacggcgacgaggtcactaggggctaattcccggcggcgagagcatctacgcggttacgggaatccgatgctagcgtcggattgggcggaactacgccgagcgaggccggcgacgagcggcgcttccgagctcgggcggcgacggcggcgagcacacggcgagcgacggcaacggtcggggcggcgccggctaacttcggggaggctactcgagctactaccgaaagctaaggaggggagatggagcgaggaggaagaacggagggaggcactaccgtgcgggacgggcgcggtgacgagaggccgacggcgcgggagtgatctctccggcctcgggccgaggaagaggaagaagagggcgcgcccggagtccccttccgcgtccacgaacgcaccggctctcccggcgcttggcgatggacggcggaggcgagacagagcacgggagcggcggcaatggcacggaggcgaatggaagaggaagggaaaggggaggctggggtttaaatgggcggcaatgtcggtttgggaaccgacttgcgcggtcaagggcgcgagctggcgctcggcggtcgcggccaaggcggcaacagggaggatgacgccggcgaggaggaaaaaggggaaaaggagggggagaaagggggcttgcccctttgccgattcgggaaaaaggaggaggtgagcgggggcgacgcggcagagggaggagggatgctgcctccgtcccttggcggcttgcgcgcggagtggcggggccgggcgatgacgacggcgatgacggcggggcggtttggagcggagcggcgacactggcgacaggcgcgtgcagaggctgacggcggcggcaaccgggcggtcggccaccacggcacgcgcgcgcggcttgcaatgggaggcgcggcggatggagtggcacggctcgggcacgcgcgctggctcgcggggtcaagcggctacgcggctgcaggcggcagggcagcgggaccgggcggcgctgacgcgacgcgacacgggcggcaaccacgcgggcgtgcgcgcgaacgagcgtggggagcggcagcgagggagccgagaggtaagactcggctcggcgcgggcggcgcggctcacgcgcttgcgcgcgcggcgcgcgggcgaggcggagcggagctgagcggggggagaagcggagcgcgccggggaggggagagggcgaaagagagagagagagcgagggcgcccgggatagagggggggccgggggagagatgggccgagcgggattcggcccatcgaccccgggggaggcaaaatggacttttgcggaggaatgatttggaaggatttggattcggaattgaactcgacgatagatcggggattgagatcttgagatggcacggacactagacaacaagcgaagaaacaaatttcgcaattagggtttttaggagataattttcccgctaggcgccacgacggaacgggcgctacactctagtaggagaaaaaaaacataaacatgaaagaaaaaacataaaaaaagagaaaaataaaaatattttaaattcctagaagaaattaaaccagaatttgttgtcgcggattcgtaccattggacgactagaccattggtcatttagcttcacccgataaaatacgaattaccagctgccatattcttttaagtctaagcctcaactaatgtaatttacgtagctttgcctttaattttctgctttttgaagttttaaagtacagtgctaatggatatttagattcatgtgtagggctgcagccctagctatcctatttttgtctctgcccctctgctagctatgacagttgcatttctgatcgatataaactcgtatcatatcgttgtactacaagtttgatatagttgaaatttatgaataattgatgggttattatatgaccgtatgaagtaacttttacaaaactaaaaagatattattcaaaaaaatttccagataattttatacagaaaatatataaacgaagaattaactttttacaaggttggcaagcttgaaatgaaaatctaaaataataataataaaaagagctgcacctaaataacagaaaaaaatcaacgcaacttgactacccgttcttggtcagctaacgatataaatctcggactgtgattgggtgtacgagtcgattgatgggatcatttccttggcttccactgataataataataataatctcccctaataaaaaccatgtttagccatcgtaatctccagccgaccacgccgcgtgctgacgccgccgccgccgcccccacgcgcgtggtctacctcatcgtcgccacccgaatatccccctcgcgccacgcgtcgacgccgcgccgcccctccggtttctatccgattccgcgagagaatttttgacttttcgccggttcgagactctcttgggttcatgtgcaccacaggattttggggtgtagcagatccggcgccgtagtcaatttaagattttcaaacttcatttttggatttttttttccgttcatttctatatttgatttaattttttaattacacgaaacgcgtgcacacacaccaacgccacactcacactcccacgaatatgtccccttaacacatgctctaataaatggaaaccaacgttacatccctgatctaactgcaatcctgttgaaaactcacttgaatatgcgtaatattcgtgtgcatcaagatttaaactctgatagatgaaataacatcattagaggtttcccggtattcgattttagtttagagccaataaaagtagaaatgtaaacttttatatcatgccttcgactaacgaaaatatgaaccgcaacaaataggctcgaacaaacaagtccattgactttgactacttatccttttcattgatttctatcataaataaatatttaatgttcagaataagatttagttaaacttataatattttgagaatcaaatctggtcctaaacatcaatattttttttaccttaaggagcattttaaggactatgatttttcattttgtaatgcaaaaatagggactaaagttttgaaaagaaaatagtagaatttaaacagggttttactgactttgaaacccttttttgctaagttaaaaaaatcaatatttttcttttgctagaggcacattctaacataaccgcgaataaacctgaatttttttaaaaaatcgtttcaaaattggcaaaagcctggatctaatatgcttgtcagttaagcttccatctagctagagtcctttgtccaaagcttcaaagtactaatcttattaaaaatctcacttaggactaatcttcctttgcacaaaggtgaaaggtcattattagttgatggcgtcccatgtcccatacacacgtgacagccatcagccacataacccttccaacccaacctaattatcccaggggcattcctgtccatctcccgtgtatatatactcaccaccacccttctcgaaccctgacctaatcaccacctcgctctttgcatttcttgatttctcctcgatcacctagtagttgatcgagcaatggcggccaaggtgcaccccaacctggccgtgccgtcgctgatccagccgccgatggcgccaccggcggcgatggcggcgggggacagcgtgatgaagacgaaggcggcggcggcgggcggggatgtggtgctgacggtgtggaggaagtcgctactgttcaactgcagggggttcacggtgttcgacgcgagcggcgacctggtgtaccgggtggacagctacgcggcggactcgcgcgcggaggtggtgctcatggacgccgcgggcgtgcccgtgctcaccgtccgccgcaagaaggcgatcggcagccagctcgggcttgggggcgaccagtggctggtccaccccggggaggagacccgcctcccgccgctctacgccgtgaagcggacgccgcagtacgtccgcggcggcggcagcgtcaagaccatggcgcacgtcgcgccctgcggcgtcgccctcggcgccggcggcggcggtggctacgagatcgaaggctcgtacctgcggcggagctgcgcggtgtacgacgcgcggcggcgcgcggtggtggcggaggtgcaggcgaaggaggcggtggggacggacgtgttccggctggtggtgcggccggggatggaggtgtcggtggccatggccgtcgtgctggcgctggagcagatgttcggcaagccctccctgctcaggagctggtcctcctaataattagcctgtttctttctttctctttttttttcttttttttttggccttgaatttccaacattgtttgggcctgagagcagaagagttgctcttggctgcctctttctctctgatcctgaaatgaaacctcaaattgggtgtcactgtacactgaaaagaaaatccctcttggtgagtatggttttgggtcttttttttagcagaaaaccagagggatgaaagtgtaaatatttctaagaagaagaagaagaaaagggggttaattaaagcaggaaattcttccctgtctatctttctcctccatttcttgttataagctaccagccttccactgttgcgaggcaaaattcccccccccccccaattaatactagaattaactaacaatatattgtacaaattcatccaagatccacatgcccaaaacatggaaaccattttaatcgctactactatgtactccctccgtctaaaaaaaaactcaacctaagaggagttcggggttccttctagtacaataaatctggactatttttatccagatttattgtcttaggagggagatttctcttaggttgaagttttttttggacggaaggagtacatttctgcatcttcttcacacagcgtctgaaaccacaaactgcatgtctgaattgtgaacatcaaaactgtctgttctccaccttgcagagactgtacatgccaactctgaaccagagagactagacctactactgtctctgaactctggaagagaaaaaaaaaaaaagggcgtttggtgccttgttcctttccagaatactacggaccgacgtcgccgcctcgccggccaagcactcactcgcaccagctcagctgcatatgagctaaggatgatatctgcaagcaggctgatcatcatgaggctggctcctcctcctctcccctcgccgaaagtttcgctcaaccaccatccatgacgacggacatggtcagcatcatcttctcggcttagtcattagcatcaccctacaaggattaatcgcgcacgaaaaacgagacaagtcattagcacataattaattgaatcgtaattattaaaagtttgaaaaatggatttatttgttttttatagcaacttatatatagaaaattttcgtacgaagcacactactttttaacagtttgagaagcgtgctaacgagtaccgaagaaaaaaaaatctttatcttgttagagtttagaaggagaccagcttttggactgaacggtttgcatcttgctcttgcgagcacgcagcaaccacgggcgcgttagtgcgttacgttggtacgctgcgtacgcacgtacgctaggagcaaacacggcgccggtattgccacagtgggggcagtggtgggctggtggccacttgttgctgctcgcggtcacggatcgcggcgaggctgggtctgttcgtggatatttagattttgagaagtggcgtgtgggaatttaaattgtgagaatatacaaaaaaaatcagttccatggactctgtaactatatcttctctgaacgaaaaaccgatttgtttaggagaaacttttgattctggagaagatgtaactgtctgaagctatcctaaacaaaccgatatctattttg

SEQ ID NO: 14243 - DNA, 16725 bp, Oryza sativa
tgaacggagtcaaacggatttacggttgggaagatattgaatttctaagattattggatttttggtctaaaggaaaaaggatttaattaaacccttttggaaagaaaaggaagagggaggggaagtagacttccctcgggcggctagggcgcggcccgagagaaaaggggcggctcggccgagctaaatgggccggccggcccaagaggacacggcccaatagggcgcggggaggggagagagagggcgccggtggaccgagtccatctcgcgtggtccggggtgggacccgcttgtcagcggctcggctcaccgtgcggagggagcacgcggcgcggcgctagggtgtggagcggggcacggtgcatgcgcgtggttcgcggtggacgcggatgcggcgggcccacgcgcagcctcacggctcgcggtggaccgcgcccgcgagcggggccggagggagcggctgaccggggtcggctcgacccggtcttggccgagctggcgccgacgtggcgcctacgtggctgccacgcgggccggcgggaggaaaaaggggaaaaggagggagagaaagggggcttgccccttgcctctttgggaaaaggaggaggggagcgggggcgacgcggcagagggaggaggagctctgcctccgtcccctggaggctagcgcgtggagtggcgggggccgggcgatgacgacggcgatgacggcgggggcggtgtggagcgaagcggcgacacgggtgacaggcgcgggcaggcgcggcaggcgctgacggcggcagcgacccggcggtcggccaccacggcacgcgcgcgcgggaagcaacgggcggcgcggcgatttgagcggcgcggctcgggcacgcgtgctgactcacggcgcagacggcgcaggcgcggcacgggcggcgaccacgtgggcgcgcgcacgcggacaacggcgtgcgggaagcggcagcgagggagcggagagggagggctcggctcggcgcggctcacgcgcacgcgcgcgtggcgcgcgggcagagcggagaagagggagagcgagagcgagagagagagagagagagagatagccggggagggaggggaagatgggccgagagagattcggcccatcgaacccgagagaggcaaaatagacttttgcggagggactttcgggaaggatttggattcgggattgaactcgacgattgatcggggatttgagatctgagatggcacggacactagacaacaagcaaagaaacagatttcgcaattagggtttttaagagatagttttcccgctaggcgccacgacggaacgggcgctacactgctggtcgccatcagcctggccactgacagcgaccaccttggttgtcgcgcagcctgcatcgcccgtgccatcctgatcgcgaggagtcaaggagcttggggagcgcgtgcgacgggatctgtagcggcaggagcatcgggagctgtgcctggtctgtgagcggccttggcggccatcgccgtgcgctcgctggcggccggaaggatgcggcgtgcggctccggtgtcgcaccccttccgccgcccgcgactcaaccgaccggccccttccaatgatgacatcgcgcagcgagcggcggcgtggtggaatatcctcagcgtggcgccgccgcccgtcatcatcctcatcatcctccgggtcttctcttctctgtggcggtgccctgcatccccgcctcgctgccgcccgtcgccgaggaggctgggttccgtcggcgcagcccaggtaccactggaaggtgcgcaccgtgggtatcgggcctcccgaatcagacaagtccgaggagggcagtccgctcaccccgaaagaaggcgagcggggcggtcctggagtccagtcctccatctcgtccagatggactatgacatgcggcagcctccccctcggcggcagcgcgatctcgtccggaagcggcggtgtgatgccggaggtgacacgcccagctcccggcgggaagaaggtggagagcactgttcatggcaggagatcaggattccgcatccacatccagcatgagaagatggccgtgttctgccactgaaccgacttatgctcgatgcgatcgaagaggcagatgggacccatgacgccctccaatcccgccctattccatgcgtactgcggcaatccctccaggcagagccgcacacgaaaccaccagttcgggtggtgcacatgcctgtcggcgctccatggcgtgatggtgaaccttcctccatccagagtgatgaagcctctccgcgctgccgcggcctgcccctctgggaaatcgaagaagacgaagaaatcttccgggtgatggcgcgtgactcgcaggtccgagatggggatcccaacctgctgggtcagtgcacgcgccacctccctgggggacgtctcctgtccctcgacctcagccgagatgagtgcgccatgatagtgaaggcgctccagctcgtgctgcatgagctccgtcatcggcaccgttgcatagccgactgccggccgttgattcggcagaccaggtatgtgatccatggtcaccgctggtttgtgcaaacgatggaaaaccgaaccagggcgggttgttgttggttgctgttggttcttgctgggaagtggtgggaagatgagtcgggattgaatggagggggcttgcttggggaaggtgaggcgggagtgaatgggttgctttgatttgtttgggcagcggaaggagatgtgtccactgcgtctacaagtatagcagcggatgggatccctgcaagctgctgcctggtgatctgaagcgaagcagcggaagcacttgccgtgcaagatctccttgaacttttctctgagatttagtggattgaaggaggtagctgggcgattgaagacgacctgagaggttgatgaagaaggattttggcgcttccgccaccaaaactttggttttaccgcttgccattttgatgaaagatcttgttcttctgcctcgatttgagacttgcttgtagctcttgccggggctactattatcgactttaatgttgctttttctctggccttcttctctgcatcttcctcttgtgccttttccggagggggcgtaatggcgctctgtccctctcctctctctgcagtaatgtcgagctcctcttcctggcttcgggcattgatttcctgatggaaagccttggacgccggagatggagaagctgctttgcgtgctttggcggtttgcggattgaatgtctccgctgaacgttggtgtagctccggagcaatgacgtcgtcctcatcctcctcggcatccgttccccagtcaagggcttggatagcagtggcgaggcctgacttgcttggggcgaaggcgtgactggggaggtgagcgcggttgtgcggtggccgccctggtcggagtgaccagaggcgcagggctgtgggcgccggtaacggttgccccgccgacgctcaggttgacgagctccccaggctctcgctctctcgtcatttctctcccctacgactattcgctattaagggttgccccaatttccttctcttcacttctcttgggtctccttctgtgagtgatcgaaaaagacgcaaacaattaaatatttatttgtatagtttcagtgaaatcaataggctaattttcgaaaatacgtatgaagggacatgtttatcggatatttgaaacactctcataattaacattatattgattgatatctggggagaagacgtgttctatatatcagcggtcgcaaaatttcaacaacaaaatgaattcaattaatgaaatcttaattatacaaaaggcagaaaggtaaagctactcattaatatcagtttccgcatagttgttttctcataaatttactttatactttaaaatataagtttttttagaggtcagctaaaatgatatggcttttggaataaagacaaacatacatgaaaaccctggtccacacagcacgacatgctggggaggccaacttacaatatgccttatgcaattttaaaatactactacctctgttttacattatactcactgcatgcatgtttggcgaatctaaacaacagatacatctattatgtgttttatagtctaatttatatgaatattagtgaatctaaacaagggatagagaggctaataaaatgcacacagttataatgaagataaacgaaaactatataatatgtcatagacaaaatataattcttaaatacttttaaaaaacaaatatagtattaaaatatattcaatgatgggtttaataagctagttcggtgttatagatattactatatttttcaaattttaattttaaaaaaattcaaaacatcttatatataaaattgagggagtcgtaagtagtgcgtttgctaataaaagtatatatacacacggaaataaattgaagtattaattcttagaggctggacctggacgtcgtctctcattgtcaccgccagttgaactctcaccgtgtcgtcggggttggtgattctgtaagtcatctccttaatgattccggggtttttggacagcatacttgcgaagccatgcatcatcccagagttgtatttgtcttggttttctgcataaacatcttatattatactcctaaaatatttagaaacggaaggagtatatagggacgcgatgaattatcaacacgtaatggcaatggtaactaatttgattagccgttgttgcatgcaggctgcagctagcggctagctttaatcgatatcgatcaatcgcgtgatgccgtgatcgcgtatgataattaattacagagatgaacttaccgatgatctgctccagcttggcggtcagtctcatcatctccgtttcatgcagggacgaggagctagccccaggcccagctgcagagaggacggaggacaagtagacgacgcccgagagaagcaccgccgcgtggacgcacaccgccaatgcgaccggacgcgcctgtatccccaccgtcgtccgggccgcatgaccagggctcccgcggcaaccgccgcggcgacggcgacggcgacggcgcaacgcggaggccggcgtgcgtaaggtttaagggggccgcgacgcgagactgattggaacttactatatatcgatcggtacccttttcgatcgtatattgtgtttgttggtgcgatatgttcccggatgggatgcgtttcgtgcgttcgtacgtagtcttggctcttgacactcttagagtttctgaccggccaaccgccgtgtccatatatgtaggggtacaggtattttccgactgcacgtccgacgagaggtttatgggaaaaatatgcgacagaaattaaaatgggatggctgatactgtccaatttcaaatctgagtctataaagaaatatgagttaggatatgagaagagttgcatccacccgtatatcccatgttatgaaatatatatgaaaatcccaaaatctttgctgtcttgatgatactatttctgatcgatttcatggatacacaagttactcggtcgtagcaagtaattagtcactgaatttgtttttgtccgttctatgattcattcatatacatgatgcagaatgttgagtacgtcagtaagcactaacacatagggatgggttaacgtttgagatgggttattgttccactgtgatcatctcactactactgaacagagaatgtcctgctctgcttcgacacaaggagaaaagctgatacacatagaggaaaggatgctttctctgaatttcctcgtttacatttcttaactttgaggcatcctggccaatggtgcagtaaaaacagttcattggagtgttcgctgcttaattacttatttggaacgccaggccgtgctgaggaaaatacatgaatatgcacccatacgagttaactagggcctgtttagttccaaaaacatcacatcgaatctttgacacatatatggagtattaaatatagataaattaaaaaactaattgcacagttaggggggaaatcgcgagacaaatcttttgagcctaattagtccatgattagccataagtgctacagtaacccacatgtgctaatgatggattaattaggctcaaaagattcgtctcgcggtttttaggcgagttatgaaattagtttttttattcgtttctgaaaaccccttccgacatctggttgattcatagttttggaacatcgaaaaggttctctctcttttcaagagaatgtgcagtctgacaaaatcacaaaatgtactgttagacagatgctacacgttaagaaaaatgcgtggggaatgcagagataagcatcctctccatgattctcaaatttgccattcaggtgttactgaaagcttcagatatcatcagataaataccaactcttaactgtttagccaattccacagctactaaattgtactcaacattacatcatgcatataatataagaataaatcgtggcacagaaagtagaattggtagcatcaaaagtagtactggtacagtactacagtagtacctatagaagaacaaataaaacacaaacgatctgcatctttcacatctagctgaaaagcctgaaactgattaactgaaatcagtccccagaagcaattcagcttcattgcaaatccatttcaggcaatgcacacgattttatcaggaaaacaaaagcacgaataattgagcatataattttcacattacattataatcgacttcaatataatgcagcattaatgcaatcaaagccatggaaacagataatttctgcactaatgtaatccatcagatcggagactaagcacatctcagacaaatcaacagcaaagcaaacctgtaccacgacgatcaaactcaacacgggaaatctcagggaagaaaccaagccggcggtgagtagttcgacggggcttgctccggcaagaagttgtccacgcgtggaaccgccttcggcgccgacgccagccacctgccgctgtctctgcaggggtattgccgcagatttggatccctgaacattgccacctcgccgtagagcctcccgtcgtccaggaagtagacgccctcctcgaaccccggatgcctcgccacctcgtacgatgtcgagcagcctcgtgcgacgaacagcatgcggccttccagcgagtccagctccacccagtcgtactcggcgccatcgttgttggtggcggcgaatgccgtcgatcgcctcgccatctcgaacaccctgaactccgacgtcgtcgtcggcgacggcggcgaggggcggagaggaccagcgccagcagcgatcctggccaccatgaggaggcgcccgcgggactccaccaggtagcggacaacggcgacgtcgtcctcgccgtagtggccgcgcccgcggcgagggaagcggcgaatctcgatgggggctatgtcaagctcctcgtccttgaagtcgtggaactcggatactcgaaacacgaggaggccttcttctccggtgaggaagtagaaggcatcgtcgtagtgtatgagatcctccaggcctgatgccgaccccgcgttgctggcgtcatcgccgttcgccaccatcgcgggcaagactcccatgcggaagaacgcgtagatggacgggttggtgacgtcggggaagtgggagaggatggccgcgccgatgcagcgttggtcctccggatgcgacgagatggtcgccgcgaacatgaccacgtccgtgtccttgtccggcggccgatcgtcgaggtggaggacgtcggggatgcccgaggggaactcgtcgcggaggatcgcgttcttggttgtctgggcgacggcgaagaagagccagccgccggggtgggcgccgaagcagcgcgcgtcgcgcgggatgtccggaatgtggaagcggtgggtggcgcagccgcggagagcgcacgagaaggagcgctccccatctcccgggaggaggatgtacgggagaggcctctcctccggcggaggatgcagcggcttgacggcggcgcgccaggcgtggcagacgcgggccatggtgcggcggtcgacgaggcacgtgaggcggttgtggacgaggcggagggattccgccatgaaatcgcgcgcgggcgctaccgcgtccatgggagaggaggaggcgaaggcgaggcgtgaaggtggcggtggcgagggttggccggcggaggaggtggtggaacgcgacgaggacgcttcgtcgttgtgcgccatgtttgaacttggcttctggaagcaggggaagcttggggtggtttggtttggaagaagaagcagagaaggccagccttttgccagccgagcaagaagttgggcttgggcccagtttatcgtgacggtttgcttgggcctgaagttttgatagctgcactttgttgagcatttcttcatgggcctaaagaactttggatctgtatgatgaagttaattggcccgtttattctttcgtaattatatatgccgagaaatgaatgttagctacagaggaatgttgtgctgagggaatgtttcatctcatcatcatctgagatccatgtgtcatgtatgcaggagtactaccttttcataacatctcttcagtacttttctggcatttttaccatgaacttcatgatgactcaatgtagaatggttggtgttcatgacttggattgcattggtggccgccgcctgctccactgcaatgcggtgttcttgtatgaacttttcaggattaacgcaattgtctcctggcatgaacgtgcagaactattttgtaccatcagagacatcagacagatgctactactttcagagaaatcagaaatgtaatgggcaacgctgagaaaaccatactcattgtgtagcacttaacttttttttctgaacagatgagtagaacatcctctgttcagtagctgtgattcagtgaacagagcaacaaagcacctatcacatacctgtatggctgtgtttcaaaagatgatgaccacattgaacaaataaccatctcacctgttactaacactcaactttttacatcatgtacatagtccaggaataaattatgtcacaggaaaaataaatccagtggtaacaataatagtaattgcagaagaacaaataacagacatattatttactactacgaggtaattaacttgagtgaaacaccatgcaattgatcacaaagcagctagtactatcaagaaagcaaagaaacgatcaaattcttgcaagatgacgatgttatctcagtatgacaaattaagaagctgagtgttgaaactaatttatagcatccaccaaggattcagaatttctgactagatctcctcagaaatgaattgaagcaactgaaagaaagctgcagaaacaattcctcttcattgaaaatacattctatatatgcagcatggtgcactaatgcaatccaactcatgaacaccaactgttttctgcattctgtaatcatgaagtatataatggtaaacataccagaaactcagaacgtactgaagagatgttatgataggtgacataggtcgatccttgcaagtatacaatggaacatcacagattgtactaactggacaatcaacaacaactgccatatctgaagttcagaactggctgaaagaaaaaccgaagaagttcagaactggaatgaaaacaacaactgttcactgatcactgatcagcaccacaacaacatcacacggacacgtcgatgtgaggcaagcacatctcatccagatcgatcggcagaaagctcgatcttactggagaaaccaagccggcggtgagtagtggttcgacgggccttgctccggcaagaacttgtccacgcggggaacctccccggcggccgccagccactttccgctgtctgtgcagggccagcaggggcatcgcggctcatcggcggcggcggcggcagcctgatccacgaacaccgccgcctcgcagtacagcctcccgtcgtccaggaagtagactccctcgttgaactcggcgcccggatacttgttcgcgtcgtacgatctggagcagcctcgcgcgacgaacagcatccgcccacccagcgactccagctcgttccaaccgtatggtgcctcgtcgttgttgatgggagtttccagcggcggctccaccatctcgaacaccttgaacgccgacgtccttggcggcagtcggggaggatgaggaacgagcctgacgaccatgaggagattctcgccggactccaccaggtagcgaacagcgatggctccgccgtaatctcgcccaccgcgcgagaagcgacgaaacaccatgggtgctatcttcagattgccatcgccgtcttcgtagaactcttctacttcaaaaacatggaggtgctcttgcgcggtgaggaaatagaaggctcccttgtggtgtatgacatcctccagaagtcgcccagcaatggtgttagtacaggtcgtcgccactgcaatctgcttccccatgcgccagaatgcatgaacgcgtggactatacaagctggcccggtgaaagacgatggcggcgccgacgcagcccttgtcctccggtggcgaagagagggtcgcggcgaccatgacgatgtccgtgtcgaaggctggtctccccgcgaagtcccagcgggcgatgtcgggtaggtagaaccgctgctcggtgcggaggctgaggagcgcgtggcgcttgatctggccgaaggcgaggaagagccagccgccgccgtacgtgccgaagtagcgcgcggcgcgcgcgtcgtccgggatgccgaagccgtgcccgcggcagccggcaatggggcacgagaaggaaggcccgtctgcgtcgcgcgggacgaggatccacgggagcgggctctccggcgggtgctgctcccccttgacggcggcgcgccaggtgcggcatacgcgggccatgcggcgccggtcgacgaggcacgggaggcgcttgtggacgaggcggaggacgtcggcggtgagaccgcaccatgaagcgtcgtccattggagaggcggaggcgcggcttgccggtggcgaggaggcgaggcggaggcgcgctgctgtgtgttggggattgattgattcctcctctgcttctcgaagcggaaggagaaaggggggatttggtttggaagaagcagaggtgggttgcttgggccaccaaacgatgtaggccttatatattgggccaattggcttgggccacgagttaagagaaaatgttatccacgccacacaggaataatgtttcatctgagatccatgtgtgtacccaatgcagaatggctggtgttcatgacttggattgcattagtgcaccatcatattgtgttgttagtaatgcgttttcctcatcatagaagagttctttgatcagttgcatcaaacggaatttgcagtgaagatcgatggattgcttcttgagactggtttcagtcgcttctcttatcgggatccaattagaatcctcagtgtatgacacaaattagtttcataactaattcaatcatactgacataacacggtgcatcggtgtcagctaaccagtcaacatgctgatgccttgtctttgttctcctgacatactagttgttttgtgatcagttgcatggggatagctagatgcagaatgtggtcatgaaaaagtagactttctacagtacagcccattaatctgcctccagaggaagctacttttgggccccaagaaagctggccctacaaatgaggccgagtccgatctcacagtggcccacccacttcttccaaaccattccaccatctccttccgtttcgagaagcagaggaaccattccaaaccattcccgccgcgcgcacacacagcgcatcgcctcctcgccatcggcaagccgcgcctccgcctctcagatggacgcgctgtggcgcgacctcgtcggcgacgtcccccgcctcgtccacaagcgcctcccgtgcctcgtcgaccggcgccgcatggcccgagtctgccacgactggcgcgtcgccgtcgcgccgcagccgcagccgccgccggggacgaggccgctcccgtcgatactcgtcccgcgcgccgacgacgggcattgcttcgcgtgcgctctcgcaggctgcgccacccacgccttcggccacccgctcccggccgacgcactcgccgcgcgctacttcggcgcctacgacggtggctgggtcttcgtcgccttcggccaaatcctggactacgcgctactcagcctccgcaacggcacgcgattccacttccccgacacgggcacggacatggtggccgcgaccctctcttcgccaccgggcgacgaacgctgcgtcgccgccgccatcagccattcctgcatgatgaacaatccacgaatccatgcattcgggatcctgaggcatcgaggtgtggaggaggcgactcatgatcctgctgagttcttcaccggccatgctctggaggatgtcgtacaccacaagaaagccttccacttcctcacaagagaagaaaacctccatgttttttcggtaccggacttccacgaagacgacgacggtaatctggtgataccgcccatggaggttcgccgattctcgcgaggcgggcgagattacggcggatgcttcgctgttcgctacctggtggagtccggcaagagtctcctcatggtcgtcaggctccttcctcatcctcccctctttccgccgacgacatgggcgttcaaggtgttcgagatggtggagacgcccatcaacaacgacggggcaccatacgactggaaggagctggaatcgctgggtgggcgggtgctgttcgtcgcgcgaggctgctccagatcgtacgacgcgggcgactatccaggcgacgagttcaacgagggcatctacttcctggatgacgggagactctacgatgaggcgttccaaatcctgaatccctttgcccagtaccgggaatacccctgcagagatcacggcaagtggctgccgccggtggcgccgccggcggcggttaccggccgcgtggacaagttcttgccggagcaaggcccgtcgcactacacgccgccggtttggattctcccgtgagagactgccatgttcttggttacattgtcgtggtacaggtattgcttgcttgctgccgatctggcatggcattgtgcttggcttacagcgaattcaccgtctgatttgatgtggtggttgttgatttgtccagttagtgcagtcgatgatgttttctcgagatccaagtgtgcttgcaactgcttgatccatcatatcataacttctcctcagtaccctctgccattttcaccatgttagagtaatgcagaaattgttggtgctcatgcatgaattagtgcatcattatattgcaatgaacaatgattctgtgtgggggattgcattagtgcacatgcatgctttggatcggatttccagtgaagacgaaactgcttgtgcagcttgctttcagttgcctcaattctcttctgaggatctagccagaaattcagcttgcttttagcgctgctcgggccggaggctgagaagcgcgtggcgctcgatctggcggaaggcgaggaagagccagccgccgctgtacgcagccgaagtagcgcgcctcgtgcgcggcgtccgggtctccgggatgccgaagcaattatttttattaatttttttaaaaaatattttttatgtttaaaaaatattatttttttcgctttttattcgccaatacttctctgataccgtatcgcgcgagtatcggccgtatccctgtatcagatacgtatcccgtacgggaatggcaacaaaatgccgtatctgtgcatcatgcagctcggcgcatgaacagaatcagaaatcgttttatcgttgttgttgttatccttttcctttttcttacataaaaagaatcggcataggcaatttggctttacacttgtgcctagcgatcttgtacttgtaggactattatagctgatcaacccagatagtagtacttaactgtctaattataatcatcctaacactagtaatgaagcaaccaaccatctgaaacaagttaacaaattcgtacctccccgctaaaataaaaaaaaaatcgttcattagacagatccggcaactgcaagttcagaaaatgaatgagaaatgcagatttaaacaactctcccgtggatcaatatttactctcattttatctctcctgtcgacaagagagcagatcattctcataccaataccagtgcgttactgaaaaaaattcgatcactttagatcaataactatcttaaccagttcctctgctgctacaatatactcaatattctacatcacacacataatctatgaacaaattgtgtcacagaaaaatagattcagtaacatcaatagtagtgccatcgcaagagcagataacacaggaagagtggcacagctagtagcaagaaagcaaagataaatgatctgcatcttgcacagccagctgaaaccgatgctgaaaatatctcagtacgaatattctgagaagcttggcatggcaattatgaacaaatgaagaagactagcagttgagttatgaaatatatacaatccatgtccctcaaaacagagtcccatcttggacagttaacaagagactgaaagcaggctgtagaagcacaatcaataattcaccttcaatgcaaatatatttcatgcaaaacatgcttctatgtggaaaattaagcactgctaattgaccacattttcacattgcattataactgacggcaatacaatgatgcgctaatgcaattcatgtcatgaacagcaaatttatgacttcatgtaattcatcagatacaacacctgttttttgattgtcctatgataagatatatttggagtgcggtgcattttacctttggcattcgtccactgctcaatatgtctcatcttcttggtagttggctaaatggtgttaatcctaggctaaaatatcgagtttttgtaggcatagcggcgttgtgctgggcggtgtggttgagtagaaatgatgtggtctttaatggatcaaatgcttactcctttttgcaggtgattttcagggggacatattgggcaagactttgatccttgttgcttaaggaagaggatggcactttggtgaaagaatactgcaaaatgttagagatgagagttttagagttctactccaactatggctggaacttcagaaggagaattcaagattaggttggcacttcgtgtctgtttgatgtggtgtgcctggatggtggttttactgttttgttggttgttcttgactctttttgtggtccaagttattttgtttttgttacccatgtaatgggtggagcttcaatgcttatgtctgaacttggttggctgtgtacatcccgttggatgtagaggccgggtttttaacccattatctaaaaaaaaattcatcagatcagatatcaaattgcattcatgtaaatctgatttggaagcgttttctgctacggactatagagtacaacagcaagcatacctgtaatagcaagccttaagaacaatattaatactccttgtatatgtcatctcattgttaattatcagtaaattcagaacctgttggaaattatgaacaggtgaaaatgactgcatagtatgaaatttgtagcacccgttgtaaggattaacaatgcaaatgcaattcatcttcgttgaaattcagttgatccaaagcatgcttagattaggaaaaagccaagtgctggtgttaactaaacgcattctcacactgcagaatcgactgtaatacaatgatgcactaatgcaattctgaaaattagcagaaggtacagaaaacatgaccgagcaattgcaagaacgcatgggcctcgaaggctcgaaatcgaatgaaacatcatagattgtagttactgcacaaatcaacagccgccaaatcagctcactaatgaaaatagcaactgttaaaactcgctctaagctaagcagatctcaacaagatcggcagcaaacattacctgtgccacgacgatcaaactaacatgagcacgctctcaggggagaagccaagccggcggtgagtagctcgacggggcttgctccggcaagaagttgtccgcctccgccgcccccagcagccacttgccgctgtctctgcaggggtagcgccgtccggtgccatcgaggaggaccgtgaactcgtcgtagattctgtcgtcgtccaggaagtagacgccggcgctgaacccaaccccgggtaatcggccacattgtatgattttgagcagcctcgcgcgacgaacagcatcctcccacccagcgattgcagctcgttccacgcgtactgggcctcgccgttgttgatggccagctccaccatctcgaacaccttgaacgccgacgtcctcggtggcatttggggaggatcagagacgaacctgaccaccatcaggagattctcgcgggactccaccaggtagcgagcaacgtcgcgtccgtcgtaatcacgcccatcatgcgggaagctgggaatcttcctgggtggtatatccagatagccgcggcggcctactcggaactccggtaccgcgaaagcatggaggcgctcttgcgcggtgaggaaatagaggctttcttgtggtgtatgacat

SEQ ID NO: 14244 - DNA, 20744 bp, Oryza sativa
  unsure (1)..(20744): unsure at all n locations
ctatcatgaccatgtccctgatgatgctaggattcaggtcgagcagacgattccgggggatgctgatgcagtacttggtgcgaaggttgagnagnccgtcccgcccgtgcccgcgggtgttgccgaagtcgaggaagagccagccgccgctgtacgtgccgaagtagcgtgcttcgcgcgcgtagtccgggacgccgaagtcgtgtctgcggcagccgccgacggcgcacgagaaggtagggccgccggagctcggcacgaggatccacgggagcgggcgctgctgcggcggcgccggcgccgcgacggccgcgcgccaggacttgcaggctcggcgcatgttgcgccggtcgacgaggcacgggaggcgcttgtggacgaggcggaggacgtcggcgttgaggtcgcaccatcgcgcgtccattggagaggccggtggcgagaggcggtggcgcggctggccggcggcgaggaggcagaggcgcgctgtgtgtgtggggattgattcctctgcttacttctagaagcggaaggagagaattttggtttggaagaagtagaggtgggaggcgtgggccaccaagcgatgagactaggccttatattgggccaattggcttgggccacaagttctctcccttgagcgtcgcgtgaagagtgaatgttatccacacaggaatgtttcatctgagatccatgtgtgatgtgtgtacttggattacataatggctggtgttcatgacttggattgcattaattgcttcttgagactggtttcagttgcttctcttctcgggatccaatcagaatcctcagtagatgacacaaattagtttcataactattaatttagtcatgactaatttttttgaacgactcacgtaagacagtgcgaagttcatttgatagagtagaaaaaaactacaagattacaaccctaaaaggtcgtaaccagaaaaaaggaaaaaaaataccaccacccacacaccgacagcgccaaaacacaggttcgggagaaggctagcaccggaccggccgccgctaagtgtgaccgaccgccgctaggccaacaaaggaacacagacgagaacgcccaaaaaaatgccattacaatcaacacaaagcccaactctatcctagagcgtgcttgcaccaattgttcgagtggtttcgacaggaggatgtctaaacgacgtcaaacgacagaaaaccgctgagtcatgactaatttttgcaagttgaggtcctggagtggagtagcaggatccttctagtcacaacattttctctccttttctgcttatagctgatgtataaagtcctcatacaaagatatgcaaaccttatgcatattctcaaataatagcttcattcacgtggaatttcctttcggttaagaacttaccctggagtctctgatgcgagtgcttatcagttcatcacttttgtttatcgagttacggcctgaacagtaattaaacaagttattacctaacttcccaattttaatcaagttaatactagtaacgagtatccaaccatcagtcatcatcagatgctgcaaattcagaaaaataaatgggcaatgcggagataaacatccacctctccgtgtcccaacttatcctctcatttctacacttaagtagagcatttagcagaaaatcatctgatcagtattagtgtacagacctactaccaatctaccatcagccatcaggctgtgttactgaagaaatgctgatagcagaacatcatctgatcagtactagtgatcagattaacacgatgcctatcatctgtgttactgaagaaatgctgataacttgggatctgaaggaatacctcttgacaagagaaatatactcaacattttacattatgcacataatctaggaacaaatcgtgccatcctggcacaaaaaaaaaattctgtagcggaaacaagtagtccctaagaagatcaaataaaatccagatgatcgtacaacaacaggaaacaaaaagtaaacgatctgcatctttcacagctagctaaaagtctgaaaccggtgtgtacaagtaatgtcagaagcttggcatgctatattatgaacaatggaagaagattataaatgaatcaaggaaaatatatagcagagattgaaaattcagctaagatcctctaaagagtggcaccatcctaccccagttcatgttggactgtcagcgaggaactcaaaacaggacgcagaagcaattcagattcactgtaaaaccgtttgatgcaaaacatacttctatcaggaaaactaaccactgcaagttagttaaacattgaattgtttttttattgcggcatagcatatattaatgcaatccaagtcgtgatgaacggcaaccatttgaagcatattgcgttcttgattcactgcagcatcagatcacacaaattcatagtttcatactgcgttcatgattcacgtagttctgacttgaaaacattttctgctataaaaggagaaattctccagcattatagcaactaccaatccatgattatgacatcaaatctggactgaaactgaaactgcactaatccatcgcagcaagaggagacgggacagagtacaacggcatcaaatcgacagctgatgcagaggatggagaccgccatgatcaagcacagcgagcagagcgcacttggctctcgaagcttctggaagcaggaaaggccgattcggtgggcccacccaagccgtaacgcctctctcttcttcgtcgagctgctttgccgccgcgcgcgcgcgcgcggaggacatcgtccacctcgggcctcctctcgaagacatggaggacgagctgggaggcgctcctcttctccatgagcctccacctccgccccagactccgccccgccggcgccgcaccggcgtccccgtcccaattctccacggcaacaactgcaacagcgacctctatttctggctgcctttggtcgacgcgaagggagtccaccgcggagacctgcgtttaccggacgttcgcggcatcgctgaggcggtccgcgacggcgccagggtcgtgtacgccgacgtcgtcgatggcctcggcggaggtcgcgtggtggcgcgcatccggggacagctggtgctacttgaggtagcccctctggctgcctatgccggtggagatggcggcggcggcggcgacgacggcgacggtttgcaggtatgcgcacacaccaactcgcatcgaaatgcttgcaaccattgcttgttagttctgtgtgttgaattgacctcgtcgtcctcctccgtgaagatgtatgttccgaagctatctgcggagaattgcgagcacttctgtcaggcctccatctccaccaagagcaagagaagatacagaagagatgatacaaggaggagcagaggaggaagaggtgctggagcctgacgacaaggaagctgatgcccaggagcaaggaggaaaaccagacttcaagactaagaagaagcaagtaccagtccagcttgggccaagagcaaggaggcccaatccacgctacaagggggaccaatgggtccagtaaacaaccagctagcatgagctgtctgagagagagatcagccgaagctatgtaatataaacatcaacgaagaacaagtagaagggggctaagaactggaatatgcgcggtggcgtaggcggcggcggctcgatccttcggggttgagaaatcttatatgcgcaattcgtgattaattccagttcctgagagataatcgttgggagttcctaacaacttcttctgggtccctttcgtggacgagatcggcaccctacgagggcacgtgccgtcgtcagccctgggaggcatcgccgacgcggtccggggcggcgccagggtcgtctacgctcgcatcggcggcgtagacatatccatatatttgagtcggttttaagatcgttcacttttggtaatatataaggaatcatataagaaatatgtttaaaaaaactcgcatgctaacttgggacgatcggactcccaagtacatctcatgattttctaaaaatatatatatccaagcgaactcccacgttaaatttcattttaactaaaccaaatatataagattaaaatagatttcacccgttgcagcgcacagacatttttctagggaataagttcactttgggtccctctattcgttgttcagtccgattttcgtcccttgaccgcaaaaccaggtacgacccgtcccccaacttatgaaaaccaggcaaacgaggtccctcaacggttttggctgacgtgacgcctacgtggctaatttgactcggtcttcatctaacgtggcgcttacgtgacaatttgatctggaaaaataataaagctgtgggacccacatgtcattttcacacataaaacaataaaaaatagtgggacccacgtaggccccacatgtcatactcaccccctcatcttcctcctacctttccctctcccctctctccaactctctcccctcctctctccagcctccaagcaccacggcccacggggtcaggggaggtccggcggtggcggccggcgacgcgacagccgccgccggcggcgagctccacctctcggcgcagccgtgcagacgttcagtagagctccttgttcacgtcgttgagtacagcatcagcatcgagaccatggacaagatcagacactttcgagggattccactgggggtactcgtgccagttcggtagcttgctcactcctggccaaacttgctcatttggggtgcccagcaacctggaaccaaacaatcaagataaatcaccaccatgaatacacgattatgccccttaagtttgccagcgaacacaaagaacaattgatgaggaaacaggcacagtacttgaaaatgtgcagaagctgctgaacctcggaatctccagcgaaaagaggttgagtagtgaccaactcagctgaaatgcacaagatatatcaacactgtcaaggcatgaatcctgaagaaataataatttacagtggctaaaatatcagttcaccataccaaaaaatgcagcccacagaccagatgtcaaccggagtggagtagtgtgttgcgccaagaagaacctcgggagccctgtaccacagtgtcaggatctgcgcaaaacaatccattcatcagagagagatccaggaacagaaatcacgcctgcgaaacagatcgtcaagcagatcagagactgctagtaggaagtaggaaccggacgcctccgctggttcacccccgccgccgaggttgcctccccttcccccaaccctaggtttcctgttactcgtgttctgtgtgttcatccgcacgcgtcgtcgtcttcaggtggatctctgcggccacgcgacgctggcatccgcccacttcctcttcaccaccgtcctagcgaagcagcagcacgccgccatggtcgagttcgtgaccaggtccggcatcctgaccgccaagaaggttcctgctccgcgtccgccgcggcggggtcagaaacgcgcgcggcatccgaggaggcgccgggaacggctgcacggctgcgccgagaggtggagctcgccggcgacgccggctgtcgcgtcgccggccgccaccgccggacctccccgtgaccccgtgggccgtggcgcctggaggctggagagaggaggagagagagttagagagaggggagagggagagggaggaggaagaagatgagggacatgtggagcccacgtgggtcccaccatttttttattgttttacgtgagtcccacggttttattattttttcggattgaattgccgccacgtcagatgaagaccgagtcaaattagccacgtagacgctatgtcagccaaaaccgctatcaaaactgtcaagagatctcgtttgccccgtaagttgggggacgggtcgtatctggttttgcggtcaagggacgaaaatcggactggttgacaaatagagggaccagagtgaacttattcctttttctagtgattaaaaaaaagtaaagccttcatacattttagcccatttatctgccacacgaggaagctacggagtactcttggggcccgagagagtggaccttttaaatgaagcccagtcggatcgcacggtagcccacccacttcttccatgtcctcctgtgccgagaagcagaggaaccaatcccggcgagggcgcgcacacagcggaatagcgcatcgcctcctcgccttgccaccggcaagccgcgcctccgcctctccaatggacgacgcgccatggcgcgacctcgacgccgacgtcctccgcctcgtcgaccgcagccgcatggcacgagtctgccacaactggcgcctcgccgtcgcgccgcaacagccgctgccggagacgaggccgctcccatcgatcctcgtcccgcgcgccgacggcccttccttcgcgtcttgatttgatatggtggttgttgatttgcccagttagggcagttgatgatgcgttctcgagatccatgtgtgcttgcaattgcttgatccataataacatctcttcagtactctctgctatttttcaccatgttagactaatgcagaaattgttggtgttcatgactcagattgcagggaagacgaaactgcttctgcagcagtgcagcttgctttcggtttgcttcaaatctcttctgaggatctaatcagaaattcagaaattctgcattcattgtttacttttctcaactttgtggcatcctgtccaatggtgcagttaaaaccagttcattgcttaattacttactgggaacgccaagccgtgattttgaggaaaatgcattcatattcaagcatgcggattcactaggttgattcatatggacacatgggagcatgtagagttggacagatggttattggtcctcccggccaaaaataaaaaagagaggaaaaagaaaaggagagatttattggtccaatgtgatcatcatctttagtaacacagatatgatggtaaaactacccgtacagattaacagatatgatgcctaccaacctaccatcagccatcaggctgtgttaccgaagaaatgctgatagtataacatcatctgatcagtactagtgatcatattaacacgctgcctatcatctgtgttactgaagaaatgctgataacttaggatctgaagaaatacctcttgactgaagaaatatactccacattttacattatgcacataacataggaacagatcctctgaagagaaaaaaaaaactagaatattagggaaggacctaatatcaaataattaggaggggtgaggctttgaatccaggtcgtctagcccaccaccttgtggagctagccggaagacccctgggcatttctcgatcctctgaagagtggcactagcctacctcagttcatcttggactgtcagcaagaaactcaaaacaggacgcagaagcaattcagattcactgcaaaaccgtttgatgcaaaacatacttctatcaggaaaactagccactgcaagtgacacattgcattgttattgactgcagcataacgatgtactaatgcaatccaagtcatgacgaacggcaaccattggaagcatattgcgttcttgattcactgcagcatcagatcacacaaattcatagtttcatactgcgttcacgattcatgtagttctgacttgaaaacattttctgctacaaaaggagaatttctccagcatcatagcaactaccaatccatgattatgacatcaaatctagactgaaactgcaactgttgactgaaactacactaatccatcgcagcaagaggagacgggacgggacaaagtacaacggctgcaaactaaaccacatctcggaggatcaaatcaacagcgaatcatacctgtaccaggacgatcaaaagtaacatgagcaatctcaggggagaagccaccccggcggtgagtagtccgacgggccttgctccggcaagaacttgtccacacgaggaacccccgccgcatccgccgccggtagccacttgccggtgtctctgcagggatatcgccgtcgccgccgccgagccgtgaacactgccgactcgcggtagagcctcccgtcatccaggaagtagacgccctcgccgaactcatcgcccggatagtcgcccgcgtcgtacgatctggagcagcctcgcgcgacgaacagcatccgcccacccagcgattccagctcgttccacgcgtacagggcctcgatgcgcgtccccgacggcggctccaccatctcgaacaccttgaacgcggacgtcctcggcggcgcgtgtagacgatcaggaacgcgcctgaccaccatgaggagattgccgcgggactccaccaggtagcggacaacgatgtctccgccataatcgcgcccacctcgcgagaagcgacgaatcgccctgggcgccatcttcatgttgcctttgccgtcttcatggaaatcccgtactgcgaaaacatggaggtcttcttctgtgatgaggaaaaggaaggcccccttgtggtgtatgacatcctccagagctggctcgtcgatggcatcggagccatgacccatcgccgcagcctgatccgggaaagccttcgctgactgcacgcgccagaatgcgtgagtgcgtcgaccagcctcgtagggcccgtaggtgatgatggcggcgccgacgcaatcctcgtcctccggtggcgaagagagggtcgcggcgagcatgaccataccaatgtaagggacaggccgccccaattcagcagccgtcatgtccgggcggacaaagaaggggaggcggaggcgcagctgaacgtcgcggaggctgaggagcttgtggcggaaggtctcgcggaaggcgaggaagagccagccaccgtcgtaggcgccgaagcagcgcgcggcgcgggcgtcgtgcgggacgccgaggccgtgtccgccgcagccgcggagggcgcacgagaaggaagggccgtcggcgcgcgggacgaggatccacgggagcgggcggcgatgcggcgcgtgctgcagcggcttgacggcgacgcgccagtcgtggcagacgcgggccatggtgcggcggtcgacgaggcacgtgaggcggttgtggacgaggcggagggcttccgccatgaagtcacgcgcgggcgccgccgcgtccatgggagaggcgaaggcggaggcgggggcgaggcgtgatggtggcgagggttgggcggcggaggaggtggtggaacgcgacgaggacgcttcgtcgttgtgcgccatgtttgaacttggcttctggaagcaggggaagagaggggaacagagtgaatgggaggtttggaagaagcagagaaggccaagccttttgccagccgagaaagtggttgggcccaatttatagtgccggttttcttgggcctgaagtttggatcgctgctctttgctgagcgtttcttcttgggcctaaatgttcccctttttttttagaacgtaaagtttggatgtacatggtgcagaatcgtgtgcgccatgtttgaacttggcttgtggaagcaggggaagagaagagacacagagtggcttggtttggaagaagaggcagagtcagagaaggccagcctcatggtggttggtgttcatgtcttcgatagttcgattgcattaggtaatgtttggttggtggaataggatgggatgggacgggatgggacgaacttacttttagaggtgttttgttgaggggcgagtggaatgggttggtctctagagaggaatattcctcccagatccgggacaaacccatccggcaaaattggccggacgagctcgtcccacttggacggagcacacagtgtctcctcggcgaccgccggcgctccgccacgaccgcctgccaccacctccacgaccgccgacgctcctccacgaccgccgacgctcctccacgaccccctgcctcaacactggtcgccgccacgagcgagatgctcggcaccatcccgccactcatcgcgatgctcgacgagagcggctgcggtgatgtcgacgcggcgggctcgagtggcggcgaagcttggaggtagggagggcggcggcggcagatccagaggagggggactcggcggcggcgaaacttgaaggtagggagagcggtggcggcggatctggcgcaggggatctcccgatccagccgcggtgacgacggtgggccagcgggttgggtgctccggcggtggtggccgtcttgctgctgccgttgtgcttgatccggttgttccacgcgtggatgcaggtggcgcagtcaacggtcgttgacggtgatggcaaacagcgtccatcccatttctccctcatcccttcaaccaaacaaaaaaattgggattgtcccatcctacaaaccaaacatgtgagtggaatcatcccaaccccaaaattagggatgaatggtttcatcccatcccatctagtcccgaaaccaaacacatgcttagtggatcatcgtcgtgttgtagttagtaatgcattttctgcgatgtgtttactcaacattacttagcgttttttctgttaaaagaatgcattgcattgcatcaaaaccgatttgcagtgaagatcgatgaattgcttcttgagattggtttcagttgcttcaattctcaggatccatttaagcggatgctacatattaagttcataactattaatttgctgttcttctccacttatatcttttaaattactagaaaaaatgcatgtgcgttgcaacattgcaacaggtgaatgttattttaatcctattattgttatacgatttacatgggatgaaattcactgtgtgaattcgcttgaatatttttttagaaaatcatgagttataattaggagtccaactttactctcaagtgaccatacaagtttttttaaagaaattttttatatgacttcttttgtattttctaaagcaaacagacttaaaatccgactcaaacatggatatgtatttccaaaatagaacgaacttaataaccgattcaaatacggatgacttaccaaaataccggtaaaaacatcttcaatttttataatagtagagatagagatatattatttttaacatccgtttgacctattgtactccgctcaaaatatgtgataaaacaagtccaatatttaatatatttaaattattttaaaattgtattcttgttcttagctcttatagcagtgtagttactttagataccatgaaaagttactttcttacagcaatatagttatttctagtaacgtggggtaaatatttgcttttattttgtttttagagttactttcctctagcactgagttacttctaataccgtgaagagtaacttctatttctccagacttgcttttttttctagcaatatagttactctagtaatgttaaaagctacttctatttcttcaaagttttttctaatcccataaaaagtacttctatcttatcagttttacttccctctagaagtgtacttacatctaacaccataaaaagttacttctattctttttataaaaagattattttcttccaagtgtgtaattactttgaatacctaaagagttattttctatatgacgctaaattactctttacaaaatatttatagtgattacttccaaataaagaaaattactttctcctctcaatataattactttgtatttagttaggagtcttttctatattttacttcgcatagtttcttatttcaacatcattcaatatgtttcctttcaatgctactcaaaagtgccggttcgttaaaaaagtgctacacaaaacactagacatggcacccatccgacctcaaaacactaggcatgacgagttggcgtcacaaccgactcccctgttttagttttgaaattttttattaggattaggaattatcttagacgagaaaaattatcttagacgaggctgattcagagtaggaaaaattgcacacatcagtaggagactaggaggacatgatactgatcgtctgatccttctcgcattgggcgttcatggcctcgtgggctacataaaaggccatctaaaagcccatagagaataaatgaggcccattatacatttgagcccattaatctgcctcacgagggagatacacttggggcccaagaaagctagccctataaaagaggtccaaactgatcgcgtgctggcccacccaccttcttcttccaaacgaagccgtcatctccacccgcttccagaagcagaggaatcaatcccacacacacctcgccaccggcaagccgcgcctccgcctctcgccctctccaatggacgcgccatggttcaacctcaacgccgacgtcctccgcctcgtccacaagcgcctcccgtgcctcgtcgaccgccgccgcatggcccgagtctgccacaactggcgcgtcgccgtcaagccgcagccgcagccgcagccgccgccggggacgaggccgctcccgtcgatcctcgtcccgcgcgccgacgggccttccttcgcgtgcgccctcgccggctgcgccacccacggcttcggccacccgctcccggccgaagcacgcgctgcgcgctacttcggcgcctacgacggtggctgggtcttcgtcgccttcggccgaattctggagtacgcgctactcagcctccgcaacggcacgcgattccacgtccccgacatgagcatgggcatggtggccgcgaccctctcttcgcctccgggcgacgaacgctgcgtcgccgccgccatcagccattcctgcatgatggacaatccacgaatccatgcattcgggatcctgaggcatcgagttgcggaggaggcgactcatgatcctgctgagttcgtcaccacgtcagttctggaggatgtcatacaccacaacaaagccttcaaattcctcacaagagaagaaaacctccatgtttttcctgtagcgggcttccacgaagacgtcaacggcaatcttgagataccgcccgtggaggttcatcgcttctcgcgtggcgggcgagattacggcggagccgtcgctgttcgctacctcgtggagtccggcgggaatctcctcatggtcgtcaggctcgtcaccgatcctcttctcttgccgacgaggacgtcggcgttcaaggtgttcgagatggtggagccaccgacgaggactcccatccacgacaaggagcccgcattcgcttggaaggagctggaatcgctgggtgggcggatgctgttcgtcgcgcgaggctgctccagatcgtacagcaagaacaactacccggacgctgagttcaacgagggcgtctacttcttggatgatgggagactctaccgtgaggggttatcgttcttggctcccgattccccagaatacccctgcagagacaacggcaagtggacggcggcggcggcgggtagcagcatggacaagttcttgccggagcaaggcccgttgaactactcaccgctggcttggcttctcccctgagagtgctcatgttagtttcacctgtctgaaatgtgctatagtgtagtttcagtcaacagtttgatgtttccgtcaagattggtgtgataattgtcggttggtacagttgctactatgctggagctacctagtaaattctccttttgtagcagaaatgcagtgtggtctgatgaattacatctatgcagcaatgatattgcagtcaatagtaatggaatgtgtaattttcagtgcttatttttcctgatagaagcatgttttgcatcaaatggattttacagtgaagctgaatttgcttctgcaccctgctttcagttgcttgctagcagtccaagatggagttagctgaattttcaatggctcccacacatttcataactttattatctattcacttttccataagttagctgaatttttaatgggcttctcaaattgctgctgggaaacatgcagattgtttctcttctctttcttcatactagttgtttcatagcaacttttttctttgagccagttctgaacttcagatatgacagttgttgattgtccggttacttcagtctgtgatgtttcgtccatgtgtgcagtgtacttgcaattgtttgatctgccataacatctcttcaatacttcacttcatgatttcagttgctgtccagaaaatggttggtgttaatggcttagattgcatatttgcagcagtgcttcggatcaaacggattttcagtttccgtataagaagtagatcgtttatctttgctttcttcataggactagttagttgctttatgatcagttgcatcggggtagtaaataatctaccttgtgttatttgttcttctgtaggaatagatcgtggcacgggaaaaacaaattcagtggtactatcagtatagtaccacacagatacatgtatgttgataactgtttcattaatcagttcactgctactgaacagaggatgttctgctcatttggtcatctgctctacaggaaaaattggttgctcatttggtcattctgaaattgtagcatagtctgatggtagtggtaccaccaaaaaaaagttcttcagacggttgtttcccctttctcagtacctatatggtaaaacgccaagcaatgcttttgccgagaatgacacattgacacccatctccctgcttgagttttgaaattttgattctgaataatttgtgttcacccggttgatgcagaatagcaatggtcaccctatttcagtatttctgtttcgttttactccgaaaaaatgcgtgttgaatttgagagattatgatacgagtacattggaatatgggttttgaaatatcgagcaggctggccctattggcccagtgaaaaagtaaaaccgtggggcccacgaaaactggcccaataaataatgcccagtctgatagcttcgttccccagcccaaccccctgcctcttccaaaccaaagccacccatctcccacctcccgcttcgagaaacagagcaatcaatcccacgcagccacatcgtcgcaatcgatcgcctcgcctcacctcgcttcgcttcctctccaatggagtcgctccaccacgacgtgatccgcctcatccacagccgcctgccgtgcctcgtcgaccgccgccgcatgggccgggtctgccacagttggcacctcgccgtcgcggagaggcagcgcagcaagctcccgtcgatcctcgtgccgcgcgcggacggcccgtccttcgcgtgcgccctcgccggctgctgcgccacccacggcttcgcccacccgctcaaggacgacgcgcgcgccgcgcgctacttcggcgcctacgacggcggctgggcgttcgtcgccttcggccacaccgtgggctacgcgctcctcagcctccgcgacggcgaccggctccacatccccgacatcggcatggccgtggtggccgccaccctctcctcaccgccggacgacgaacgctgcctcgccgccgccatcaacctctcctttctgattgacgatctacgcactcacgcgttctggcccatgcggcgtcaatctgcggctgcgccggagaaggcggcgaaacctgcaaaggtcatcagcggccacgctctggaggatgtcgtacaccacgacgacgccttccatttcctcacgagagaagaaaacctccatgtttttccggtagcgggcttccgcgaagacgacgagggcaatctggagataccgcccgtgnaggttcatcgcttctcgcgtggcgggcgagattacggccaaaacaacgctgttcgctacctggtggagtccggcgagaatctcctcatggtcgtcaggctcgttccccatcctccccaattgccgccgaggacgtcggcgttcaaggtgttcgagatggtggagccgccgctggggactcccatcaacaacgacgaggcaccatacgcctggaacgagctggaatcgctgggtgggcggatgctgttcgtcgcgcgaggctgctccagatcgtacgacgcgaacaacaatccgggctccgagttcagcgagggcgtctacttcctggatgacgggagactctacgacgaggagttgatgctcggtgagcccgatttccgggagtatccctgcagagacaccggcaagtggttgccagcggcggaggcgaatccccgagtggtcgagttcttgccggagcaagccccgtcgagctactcgccgccggcgtggcttctcccctgagattgccgtcgagctacaggtttttgcttgctgtcgattcgatcccccgagatgtggtttagcttgcagccgttgtactctgtcccgtctcctcttgctgcgatcgattagtgtagtttcagtccagatttgatgtcataatcgtggattggtacagctgctacaatgctggagcagtggagattgtacttggtaaattctcctcttctatcagaaagagtatgcaagccagaattacatgaataatgaatgcagtatattcaactcagcatgaatatgtgatctgatgaattctacatgaattacaatggttgccattcttggcttggatttcattagtcggtaagattgcaatgtgtaattttcagtgcttatttttcaggatagaagcatgttttgcatcaaatgtattttacagtgaagctgaatttgcttctgcagcctgctttcagttgcttgctgacagtgcaagatggacttggctgaattttcaatggctgctacacatgttcctaactgaattaactattcacttgttcataagttagctgaatttcagttgcttgctgacagtccaggatgggctgaggtagtgccactcttcagtggattttagcagaattttcgatggctgctacatattttcctaactcataatgtagcatgttaagtttaccaaattactgatacacatcggtttcagctagctgtgaaagatgccgatagtttacctgtttgttcttgatactagttgctcggttctgttgttgtataatcgtctgaatcttagtggagtactattgattctactgaatttatttactgcaccacaatgtattcctttattctgtgcataaggtagaacgttgtgtatgttttagtagcagaagaatggttaaacagttaacagatggttattaatccaaagttatcagcatttaggcattacttcagtaacacagcctgatgttaggcgtcatggtaatctgttcactagtactgaactactgatcagatgatgatgttcttctgccctccctgctctacagaagactggattaaatgagagaaaaagttgacacgcggagaggaggatgattatctctgcattgcccgttcatttttctgaatttgcatgcaggatcttgtgattgatggtaagaaattgttggtacaatttagatggttggttggttaatcaccagcattaaccacgagaaaattttggcagttcactacgactttgatgcatcacttgcagattctttactgttcagtctggaactcaataaacaaaaagtcataagaactcacagactccggaaaattaaaataacacgggtctcaagttattggtccatgggaaattcgacatgaatcaagctgattgagcataactgtcacggtagatgccatgctgattaagcgactttcgaagagggaagaggaggattagcctgaaaaattgaaaaattagcatgaacaggataatgatgcaatcccccagactgaatcattgttcgttgcaatataatgatgcaattaatgcaatctgagtcatgagaaccaacaatttctgcattagtctaacatggtgaaaatagcagagtactgaagagatgttatgatggatcaagcaattgcaggtacacatggatctcgagaacacatcatcgattaactggacaaatcaacaaccaccatatcagcacgacaacaagtcatcagacgatctaactaagaacatggcagtctcacggcagaatccaaaccggcgacgtgtagtacgacgggccttgctccggcaagagcttgtccacgcggccggtaaccgcctccgccgccgccgccggcggcggcggcagccacttgccgttgtcgctgcaggggtactggggaaggggattcacgaattgggacgcctcatcgtagagtctcccgtcatccaggaagtagacgccctccttgaactcatcgcccggatacttgttcgcatcgtacgatctggagcagcctcgcgagacgaacagcatccgcccacccagcgattccagctccttccaagcgtatggtgcctcgtcgttgttgatgggagtccccagcggcgtctccaccatctcgaacaccttgaacgcccatgtcgtcggcggaaagaggggaggatgaggaacgagcctgacgaccatgaggagactctcgccggactccaccaggtaacgaacagcgaagcctccgccgtaatctcgcccaccacgcgagaagcggcgaacctccttggccggtatctccagattgccgtcgtcgtcttcgtggaagcccggtaccgaaaaaacatggaggttttcttctttcgtgaggaaatggaaggctttcttgtggtgtatgacatcctccagaactgacgtggtgacggactcaacagcagtcgccttctcctcaacttgatgctccatgcgccagaacacatgaacgcgtggatcgtacatcacgcagctgtggccgatggcggcagcgaggcagtgttcgtcgtccggtggcgaagagagcgtcgcggccaccatgtccgtgagcgtctcgacgtcagcgaggggtaatttctcgtcgccgcggaggctgaggagcgcatagtccagggtgcggtagaagcagacgaagacccagccaccgtcgtaggcgccgaagtagcgcgcggcgcgtgcgtcggccgggagcgggtggccgaagccgtgggtggcgcagccggctagggcgcacgcgaaggacgtcctgtatgcgcgccggacgagtatcgacgggagcggcctcgtccccggcggcggctgcggctgcggcgcgacggcgacgcgccagttgtggcagactcgggccatgcggcggcggtcgacgaggcacgggaggcgcttgtggacgaggcggaggacgtcggcgttgaggtagaaccatggcgcgtccattggagagggctcgagaggcggaggcgcggcttgccggtggcgaggtgtgtgtgtgtggggaatgggttcctctgcttctggaaggaatttttttcggatttagatttttttttaaatatttacagaaataatctatcgaccaaaaaaattgcagaaatagcccctgccgcccacctctggggcggcaagctgacgtggcaaacgggggaggaacggacggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgagagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggaggattctgacaacgagcgtgtagaggaagttgattcgtcagatgatgagacggatattaatccagcagaatgggctagtgaggatttttctaggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgg

SEQ ID NO: 14245 - DNA, 4535 bp, Oryza sativa
ctgctctacaccatcctgcaacaaataatatctttctttattactttttttaaaaaaatcaattcatatggatttgtaatttttgttacctgttctcttgtatttttaacctttcttctcttcttccttggcaagtcaaactcaacgtgtttcagagggcacgttggaaatgtgtgatctgtcctctgaaaatgactgcaatgatatagttctttttgctgtatttcttccctaattgtcttgtatctttgagctggcctgcctttggattttgcaatatctggatccaacaatatttcttctgtattttcctcagattgttgattgccttgttcatgtgagttcaaattgtcttctgcatttggatctgaatcattgatctcctgctctgcatctttatttgaacacattaattccaattgtttagcgattttgtccatctcttccactgcaaactggaaagtttcattgcttttcgatccatttgatgctatttctgcacttttccttgacaaaatgttgaatctcaggattgagctctatgctaaaggtatatttccattgccttttcccccaagacctttgtactctttttttgtccatctttcaataatatatttttctggtatcttcattgcattgaggtggagcattactttcaatacatggcagcatagaagtccatctttctcaaactttgagcaaatgcagttgaaatcctccttttccaagtccacaataacaaggtacttccttcttctgattacttgaatattttgattcaatgccaaaaaaacttcataagttttgaacttctctacttcatttatttgaaatctagttgttcttttcaactcaacttgaaacttgatgaagattttgcgattatacattctcattgcttggtactcaatgtagtaatgggaccaaagtttgcttggtttctttgttcttgaaatgtgatcatcaaactgttccaagttttgaattgtatccattactctttcatactctatcatgaagtttgtaatgttgtactgtggaccaacattattcttaaaccttgagttagtcccttcactgagagctgtgctttttataaatggacagaaatcacccttgaaatacactggaataaatctttttctaattgaccacatgtgctttagaaaattgatatgctgaacttcaaagctgtcaatcatttcttgccataaatactcaaattcttcttctgtaactgagttatttatgatgtcttcatactcatcatacaacccttcttttgctttgaacaaatttccagatagattgaaagctttctttacaatatgaaagaagcaatttccgtgctttgcattttgaaatacttgagcaattgctgatctcattgctccatcctgatcaggaatgattatttttggttctttttgtgacatagctttcaaaaaagttctgaacatccatttaaatgtttctgaagtctcatcatgcaaaaatgcacaaccaaaaacaattgtgtttccatgtccagaaattccaacaaagggagcaaacgggaggttgtatctgttggtgaaatatgttgtgtcaaaactcacaacatcaccatatttctcataccactccctcgatctcccgtctgtccaaaacagatttttcactttcttgctctcatccaaatcaaactcataaaagaaatgtggatctttttcttttttccttctgaaaaattccaaagttttcatcatatcattgctgcttgtctccttgttaattgtggttctcacattgcttatatctttcttcgtataaggcaaagaagtcaatcctcctcttagaacagataaaattacaatcatgtgccttgttggtattgtcggtgacatgggaccgggggtatcttgactagaggtttggggcagctgcagtcacccatgtggcctgaccccctcgggggggggggggggtcgggcccgagggtgatgtgcccgcccctccctctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcaccccacgccgcatttaatgcagcacagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtggacaagaatgatcggtctgtgactggtctgacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacagggagatccccggtgtcaggcgagtgacggcgctgagcctcactcaaggacaagttgtgatttagcttccaggcgaaggtgcaagccaagttttggtcaagatagggtaggtccccacccaaaagaaaagtaggtagaagtggtgcatgtggtatccccttgagatataaaaggaggaccttgcccaccaaaaaggggggaaaaaaagaaaaaaggacgctagaggggttctggagcctgaactctctagctctccggctctctgtaactccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgtccccggccgaaccggcaaaggggggcctgcgcggtctcccggtgaggagctccacgctccgtcaggtatattacattccttcaaggtccttatgagcattttttcttctgtagtcatgtgtttgtgtgatttgagaaatctcacttcatctcttggacttagttgatgattgtggtctaattgtacccttgaaatattccaaatctcattcctctctgaaataaccagagcacacttgcaatctgttgcatcattttcatttgtatttctttccgaaaccactgtttcctctgcgcttactgatttggattgagaagttggtttgccttgtctattacatctgaacgttactctagtcacttctccattccttttcttgcttgttgtgtggtagttgtgagccctgacaatagaaaatccagccaacagagcatagaagttaaagaattcatgtgcttttgtaatagtcttaaattgtgttccaactcttggtatatatctgctatcaattgctgcattattaccctttgtagcttcttcctgttcattctctacgaaaatatttatgtcttcttctgtcagctcttgttgatttgtttcagagttatcatttggattattgtcatcatctcttgttccttgaactgaagtacatcgatgattatccattgaacttggttcctgcaaaaaaaaagcagttccattagtttctgaaattaattttctagcctattcattgctaatctgaattattcaatttaattttttaagaaatattaatgtttgtactctttttttgcagactatgaaacttcaatcatcaatcattgttatctagagaaaaaggtacaaccaacaaaaattaccttttcaccatctaacaaattgaatatatcaagattccaattatccattgcatcctcttcattactctcatcttcctggaatttgaattacattacaaagttaaaatttactaaaattatcataatttttaatactacaacaggaagtaatacatccaagacaacatgcctcatttgccgcatcattattccattcttcaatattagcattagtacgatttgttgttaatatcattgaattctgcaaaacaaaatttttatatcaatacttatttgcttttgaatttgaattattagattcaattaaataattaatatttcatacctgaaatgcacttggactcgcaacaaaagtagagtgtgctgaattttgttcctgtaaattccaataaaaacagaaatattacaactaaattatatatgatattcaaatattgtttttcttacctgcatatcagaaatcgtaggctgtgatgatatgatttgttccattaagcttgtgtacgacatatttgcaacctgcaaataaattttcatatagtattttgactaccaccttcaaatttttcctttaatagcaaaaactttgtaatatgaacttactgaattcattgatccgaaa

SEQ ID NO: 14246 - DNA, 864 bp, Oryza sativa
aacccgacacttgggtcggtgcttgcgaactaaatgaatttccaaaaccgcggaccggggaacgtaccgggggtacggtttcccgctcttgcacttaaggaccgtttccttggaatttcatccgatcataagtcaagtacgaccacatggatggaatgggacacccctggctgagtaactagcttatcaggggagccttgatgccgagagacatgtggattcgctagggtggtgtcggggaggacccctgggcttcctggcacagtatggtctgggacctaacgtgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaataaactgtttgaacagccgtgcccacggtcatgggcggatgtgaggtgattcctagcgtagttttgtttgactactgccttgtgaaattgctgttgtgaaaaggggatcgatgtttggaaaaatctgcagctgatgggatcagctaggcccgggtggccgtttgaaagttgttggcccgggtggccgtttgaaagttgttggccgggtgccaatcttgaacaattctaaagactgatacattacacatactccgaccggacgagacgcactgtctcatccgtgtcgtttgagaagcactcacttagttgttttcagaaaagagttcaaataaaatcaattgcaaaaacaacagtctttccttgaagcctgcattaaacacttatttcccatggcttgctgagtactcccg

SEQ ID NO: 14247 - DNA, 3974 bp, Oryza sativa
caggatggacgacagacttaattgaccaacttgtcacaatctggaccgccactcagacactacaactagaagagcaagaggatgacaaaataacatggaagcttaccagccatggtgaatacacggcaacgtcggcctacaatgtgcaactcctcggcaccacagccaccaactttaataacctaatttggaagacctgggcgccacgaaaacacaaaaccttcgcatggctaatcatccaaacagagtatggacctccgacagactagcaaccagaggatggccaaacggttccatatgtcccttatgtcgtcgatctcaagaaactgccctacacctcctcgcgggttgtagatacacaaagagaatctgggaggcaattgcggaatggacggcgtgtgaggggttgaaaccatgtcggtggcagcaaaccttcacggtgttagaatggtgggaggctaccttaaacatccaggaggcacccaagaaggctcttcgcacactgatcctgctggtcgcatgggagatctggactaagagaaaccgcagaacctttcagcaaaaagagctatcgaccacctcccttctagctaaaatcaaggaagaggccaaaacttgggccttagcgggcgcgaaaaatcttcataattggctttcttttagttagctcggaccaaaggtcctgagctcgttttcgcctttgtacagttttactcctctattcaatgaaaattggcagcttgccttttcttcaaaaaaaaagaaaagaaaaaggcaagtgctggtgttaactaaacgcattctcacactgcagaatcgactgtaatacaatgatgcactaatgcaatccaagtcaaccatttctccattctgaaatcacgaagcatcgaaaattagcagaaggtacagaaaagatggccgggcaattgcaagaacgaatgggcctcgaaggctcgaaatagaatgaaacatcatggattatactaactggacaaatcaacagccgcaaaatcagatcacgaatgaaaatatcaactgttacaactcgctgtaagcagatttcaacaagatcggcagcaaacattacctgtgccacgacgatcaaactaacatgagcacacgctcaggggagaagccaagccggcggtgagtagctcgacagggcttgctccggcaagaagttgtccgcctccgccgcccccagcagccacttgccgctgtctctgcaggggtagcgccgtgcggtgtcatcgaggaccgtgaactcgtcgtagattctcccgtcgtccaggaagtagacgccggcgctgaaccccaaccccgggtaatcggccacctcgtaggattttgagcagcctcgcgcgacgaacagcatcctcccacccagcgattccagctcgttccacgcgtaccgggcctcgccgttgttgatgggcagctccaccatctcgaacaccttgaatgccgacgtcctcggtggcatttggggaggatcagagacgaacctgaccaccatcaggagattctcgcgggactccaccaggtagcgagcaacggcgcgtccgtcgtaatcacgaccatcatgcgggaagctgcgaatctccatgggtgctatatgcagatggccgcgacggtttactcggaactccggtagcgcgaaaacatggaggtgctcttgcgcggtgaggaaatagaaggcttccttgtggtgtatgacatcctccagaattggtccgatgacgccctcgatagcagtcggcatcacagcgacctgacgccgcatgtaccagaacgcgtgcatgcgtgcaccattcatcccgggcgccagtacgagctgatggcggcgccgatgcagtgctcgtcttccggcggcgaggagagggtcgcggctatcatgaccatgtccctgatgatgctaggattcaggtcgaggtagacgattccggggatgctgatgcagtacttggtgcggaggctgaggaggacgtgccggccgtggccgcgggtgttgccgaagttgaggaagagccagccgccgctgtacgtgccgaagtagcgtgcttcgcgcgcgtagtccgggacgccgaagtcgtgtctgcggcagccgccgacggcgcacgagaaggtagggccgccggagctcggcacgaggatccacgggaccgggcgctgctgcggcggcgccggcgccgcgacggcagcgcgccaggacttgcaggctcggcgcatgttgcgccggtcgacgaggcacgggaggcgcttgtggacgagccggaggacgtcggcgttgaggtcgcaccatagcgcgtccattggagaggccgaaggcggaggcggaggtgcggcttgccggtggcgaggaggcgaaggtgcgctgctgcgctgtggggattgatttggaagcggaaggaggaaagtttggtttggaagatagcagaggtgggtggcttgggccaccaagcgatgagattaggccttttatattgggccatttgtcttgggccacaagttctctccgttgagcgcctcgcgtgagggaaaaatatctgtgggccaaaatgttgtaaggcggaattgaggcgaccaatttcatcaggatggagtaggcctaatttggtttgggggaatggccgaatggaccctaatcctggcctgtgatttgcacgccttggacggatgatgcttcattgcatggcacggacgcacggtaaaccaaatttgcttagttcgttcgtacacgattaccaagaaatctatagaaaaattatcttaaaaagtattaattcatttttaaatttttaaagctaatacttagatactatttgacatttcacgatggatttgaagtttgtatattaaactgtagtgatataaattctcatattttatttaaaataaaaaatagattcatacatgtattatcaatgtaatcgtaaattcagatccatagattcatggagttaaaaatatccagctctaaagtattttcgattcgaagctatgtcaaatataatcttaattaatcatgtgcttatccattatttcattttacgtagcgtatttaggaatttcgtcgggttcaactgacacaggggactcggtaactgtaggtctgtagcggtgctgccgccaaggaggcaatgcgtacgagacacgaatttaaggataacaggataagtcaatatttagaagtattttctaaaaatttaagctaatattgcattgaaagtaattcttgctatgttaatttcatagttgtcaatgagagattcaaaactcaacattaaaataacgtgtaaaaacctaatgcaccttatattttatgaaccggtaaatacatcatctccgatctaaagcatgaggccagataagctggttttataattgcgtcaaacattgaatttagtaattataagcattaattaactaaatatgtcgatcatgcatagcaagagatcaagtcgtctttgcgcatcgcataataatatttccacgaactctttatacaactcgtaccacatttctaatttcaaaagtaaaattaaggcacagagttcaaagctgttttctcattctctagtcaatttcgtacggagcagcagttaaacatggtaattaagggctttttttttctcggaagggcgtatttgccatcgagctaatcttgtgggctaatctgcaaaaataccagaagagaatcgcactcgctctatttatatcgaccttcctcctctccaagccaagcggcttcatatcatccggcatccagagaaaaatatagcaacgaaaaaaaaggagaaaaaaaaaacagtctctcttccggtaatcttctcgatctcacctcgctttgaactctccgctcgattttttttctatgatttctccaatctggttaacttggattgttccctacccccagaaatctgttgtagtgtagatctggtaaatttgtttccctcacatttttgcgctct

SEQ ID NO: 14248 - DNA, 1205 bp, Oryza sativa
gctccatttcctcaaggctgcttcggtgtttctgagcttttgacttagccgccaagtggggtgaccttcctggataggctcgttccaagcctaggttacgacgcctaggaaaccttccactctaatctagaaattttcaaatcggaacctcagtttcctctttggttcttgcattggtgctagcagcaactggcagtggtctgagcaggatgtggatagtgctagcaaggaatgcccagagaaaagaatatctccctcactattgctcagaatcctatctaatttgcttagaatcgggtttccctgctcattactccaagtgaactgcctgttttgcaatctattgtcttttagctccaaagtatttaaggttgacctgaagcgccccattagacgtctgttcaaattctggttattcttatccctagcctcgtatatgatgttgaagtcccccatgaccaaccatggcgtgtctgttggtggcttggctgcgactaattcggcgaggaaattttccttgtcacagtcttctgagggtccataaactactgtgatgatgaagctgaggttatcagttatggtcattccatcgccgaaagatggtgtgttccttgggagaaattcgccatgttaacaattgtgtcatcccagaagatggcaattcctccacgagttccattggcaggaaggaaattgaagttcgacaacctgtttcccccaatctctttgccgatccattggtctatactacttaattttgtttcttgcaagcacaggatgcctgctctggccagctcggctgcttcgaggactgcctctcttcgtgctgggttatttagtccgcgaacattccaactgagaattcttagatgttgtaacatttgggcgaagtataacacataattttttccaaaaggatcgatcccatagtgttttccaaatgaattagttcataagcagatagagggctacatattttcttccatgacctacaactacaaaccaaacatgaccatgtagaagcaatttcactatcttctagcctgtctactctgctactaaccagctgaaggccggtgtctaccgggagcgctattcgcatcaatcgactaaggagctccggcttaaggccgttgctacatgggagcgctagtcgcatcgaccatacagcgagcagcggcttaagaccgcaaagaaatgtaaag

SEQ ID NO: 14249 - DNA, 523 bp, Oryza sativa
taagacgaccttttcacgttcaccttctcctccgtggatggcctgagtctggaccgtggcctggtgttgctcctcgcagtcggcctgctgcaccagggtgggctggtctcctgtgaaagcttgggcctcgtcatcttgagtggactgagcgaggaggtccatcttgggggcctgctgcgtatctgggctgagatggcccatcttctcctggcccaacttagctgccgacgccaccttatcctctcccagtatcggttcttccccacccgtcctcttcgtctcgttctccgcctcccgtgaagacttgggagcgatctctgctaggagtggcagcatcgggtcgtggttcccctgttcgtctgagaaggggaggagaggtaaggagcataggatctggatcagagggtcggggagactcacgagagcgtcgactggctgcttgtcacgccccgaactagtcccgagcggaactagcccgtgacgctccaaattaacctgttaaccgataccagtcccaggaaat

SEQ ID NO: 14250 - DNA, 3488 bp, Oryza sativa
  unsure (1)..(3488): unsure at all n locations
taaatgcataaaagttctgtgcatcagtaacaagatgaaaacccacatttgctgattcctgaaacactgaaaagaactggtgagtgtcatgatgcagaaatttcaagagaccacatggtctacacaacaaaagtaatatcatacctcagaatttatcacagtcgagttgacagtcatggaagatgcaagaaggttggtagagaaaataacatagtgccggagaactggattttcaagcttttgcacattggagtactccatgtcagcaaaggatttaaagtagtctactgtcaatctcattgaaaggcagtggaggctcttaggtaatgtctgaactccaagccggtaaagatatgcaccttgtcttgcatgaaaatgagtttcatcctcagtcatatcaagcaattgcctcagttttttctcaaaattagtgcattctatcagacatgattttgctgcagctattgtcttctccatctttgccatattggctccatggcttcaaaaataacaaataatcactataacaaaacaaataatcattatagcaaactctaaacctatggggaaattttctgttccaaagtgaatctgtataacacattgagccatcagatcatcagtccactcatcatttagaacttactgctacaattattggtaaattattcatcccaatatcacacttttagcttaatacaatgttattcgatcaaactacagagtgttaatacatttcacaaaataataaggactacgaacatgctaggtgatgaaagagataatcctaaggaatcattcaggtaatgctcaatcaactgtaggctgtcaattatgcataagttatcttgtatacgtgcatattagacgacagtggatatcaaaatctgtgaaaataaaaaacaaacagtgaagcacaacagttagtaggtagaccatttttggtgcaaagtcaggctgcttaaatacccaacagtttcatgtatggtaaaatatcaatttctgaagttagcagtgccttatggattaaagatgatagcttaaaaatgagaactaaagaaagtatttctggaagattacttacaatgcaggaagatcagcatcacatatggcttcgctgagcatgtgctcatgctcttggatactttgcttcatttcatgtgaaagtttttccatcccctcaagttttgctatgcttggatagtaagctcttgcaacaaagagctggtctttaagtctcttcactacagaatctttcatcacttccttgtgttcaacagaccaaacacaatagcttccaaattctagttggcacgattttatactctcatcaccaggtaaaccttgttcaaaattgtccttaggatcagcatcagtattctgcaacattaggtgaaaaataaaaagtatgtaatatatgataattctgcaagtccgcaaacaagttacaaaggattattgaaatgtttctttaaaatattgcaaaagcaaggtgcatatcacatgccctgctcagaaattcatgcgaaagcagcatatatatttactgcacgaacagacaagggcatgttaaaaataactgtaaagcatattagctcttacactcagtaatgatatatcatcaaagatcacgatttgtttgataggaaggcctgcacattacaagaagaattaaagctgtaacttgatatttaaaattttaaaactaaataagtggtcaaagaatgggccctgcttacctggatggattgaggtattgctaatcggtttgtcaatacttggttgattgttggtcccattgctttctgcatcagaattaccggtatttgttttgctccagtcctgtgaacgaacaactaaatcaattaggtaacgcaaaaaaaaattgcatgtttcggtagatagacaagattttcagatgatgcaatgcaatttttgggacatagtgacaaacagttagtaagttcaaaaccccattcagctctgagcctcttacatgccaaaaggaaagaaacagtgccttgattgcagtagaaatgcaaaagagggccatgtgaaacaagatccatgatatggcaaaagcagactgacatttccaaaaaaatggggccatggaccatgtattaaaaggcaattccactcaaacactacccatgagaccacaatcggcacgatagcaactcacaacaagcactctacttggataaaatttcacgcatgaacaaagagaaaaacagctgcgggcgatgggctcaaatgcaaaccctttcaatcgatggcggaaaatttgtcgtgtcgttgactggcagcctgtcattttcctgcgaaaaagaaatgcatcactgatctaaagataaattctcttcccgcagtataccccatcagtcatcattgccaaacctaattaggataaatacacctaaccacactcccatgtgattggaacatttcaggtaatagaacaaaaatatcccagaaatggcaatcatgagcacaccccctacctgcgatgtatttggctcccaaccaccaccctcgctgccgccaaacacctgtgcaacagaaacatgaggcaaaaatcttaacagcaatggattaaacaaatcaaatggcttaagcatgagctactagttagtttcaatctcaattgacactcaccgacacggcgctctcgtcggccaaatacactgtgatatcaaaagacaaaacaaatacaaacaaaatcgagtcaggggagcatagagagagagttgatgagcccctagatcgagcgcgagccggcgagccggacgggaagcccagatctgggagcggagaggctgaagagaaaagtagggttttggcaggggagagaggggtgggtggttacggactggacgggaagcgctggtggaggccgagcagcacggcgagcggcacgccgacggagaggaacagcagcgccagcgcggcggccgcggccgccacgctcctccaccgcctcttcgccggggcccccgcgccgccaccctggcccttcatccccgctcccccccgcccgcacgcacaggggggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14251 - DNA, 3796 bp, Oryza sativa
agttgatttaattatttcatacttctgaattctcatttctgactaacaaactggctgcatttatatgaaacttttaaaggttggtcttagtggaagtggaaagagtactgtggttaacctactacttcggctatatgaacctacagatgggcaagtaagataatttctgcgtcaaactattgtctgtgccacatgaccgcatgcagtcgcttcaaagcaaaccagttggctggtctgaagttatgttttgtgatcaatgcagatattagtagatggtgtcccactcagtgagcttgacatcagatggttcagggaaaggattggttttgttggacaggttcagatctaactcaaggctctgtaccactagaacttttgttgtattaaatagccacatatattggtgtgtgcaggaacctaggctattccgaatggatattagttctaatattaggtatggttgtccaagagaagttagcaatgaagaagtggagtgggctgcaaagcaggcatatgctcacgatttcataatgtctctccctgatggttataacaccattgtcgatgatgctcttcttagtggaggccaaaagcaacgcgttgctattgcgagggcccttcttagggacccatccatcttggtattagatgaagccactagtgcacttgatgctgagagtgaacattatgtgaaggtaacctcttcatcaagatatttgaccaattatgtacctagatataaatacaatgtgcctatgggcggcttgctgattcgctccctcctgctttgctagaatgtaatcacaaagtttagtactgatcctaaggctagaagaaccgtgatcatcatagctcacaggtaatgtatgctcatactgcagttgtttattttgaattttaagattttagttgacacaatcatttctcttgtagactatctacaattcaagcggctgatagaattatcgtgatggaaaatggtaatattgtggaggtatgttttcggccgctgttgcttcactgaaaacgcaaaccagaactaatctgatcctactatacacatgatatgatgtcattcagatttcttaaagttcttttgtgtggtatgcaggatggaaaccacagcgagcttattaataagcacgatggtttgtattccagattagctaggcgacaaaacgacgccctcgattagtcctgaattcacagagattggtctactccacaccattttttttcaagtggaacggcaggcaaggagagttcttagtaattggtgtattctttacgagtgaccctgaccgtggtggccaaacaggtgaaactggatagtttacaaatgatgataactaatcaaactaagaagttgtttcccaccataaaacgggtcggtagtatggaggatccgggaacctgtaactgcaaatgattctttacagaagtcaaatagttatacatgtcatcaggcgcaacctgtaatacaaatgtataggcattctgatcagagtcaagaccatcggaaatcataacttatatactctgcagggaaagtttactccagttttgacaatttgcatagagcattacactgtatacttatttctcaaattgtatacttacaatttgtatacctgtgtgaccgtgtcacgataaacagacattatttttcgaagttgcaggttgcagcgaaggtgtgtttccagaaccatatggtctgatgaaatggagcacgcgaatgcccccgtgcaaagtttaatcatatctaaattctgaagtcaccgttcgtgatatcatatgggcctcgggattaagagtgttcatattctgcatatggaactcaatttttgcaaaaggcatactatgcatttgcagaataagatattattaattctatcatcaaacatacgtctattgagaacacatcagggcatcatcatacaagaaggtgaggtcctacattctagctccagtattcttaacccccacaaaactgaaatcgactcgtccctcgtaactcgaagttgctcaagaaaaatggtcagaatatcaaagcgaaggtgctaaaataaggaacctaagcaacttgtgacgcttgaaaattttgtgattcggaatactcctctttggatcgtcctctcaagcagtcttctgtttcgctgacgtggaggaaaggtaagatagagccctatggcccacaaacacaaggaagacaccaaggaagctgaggtacttcagggttgtgaaaagatccagctattacaacaagaatgaatgtcagcgccagcagaaacctttgttaatgcaattatgctttaccaacaatgaacggtactaaccttaatccagaagagaacgtagagcagcagcactgctccaattccagcatggaaaagtgaggcaaatgctgcgggtgctggcaaggacgggaagttcttcaagtttaccccgagacgcataagctgcaaacgaatgccacaagcatagacaacataagagtgacacgttagactaaacaaaaaaaactgcaaaggagaaatgaagaaacacacataggagttgttgacccaccccaatcaagaacccaacaataggcagaagcgtgaggcccgtaaacgcaaatgagagttccttgggtggcctcttctctggtgaacggaatatgtgcgatatttccttcttcggaccaaattttgagaatggatcaacagcctgggccggaggctttggggctttttctggggcctcaggcaggtccaattcaatatggccaagggctcgtagaaatgaattctcctgagaacaaaaagaaatcagcaagggcaacaaaacgggaatgagagtccagtaacatggttacataccattgcagcatcaccaactgcaagctccaggtcatatcttccagaaaggtagtagaatttctccaccaaaccaagaaagtcctatgacaaattgaacagacacgtaggaacacttgttactgacaaatcccatgatattataatctgtggtaacatgagaatgtctttgtatagtagcaaatacaggctgaatccaagaaaaatacaggaagatccatccccgctatattatgttgaaacatatataaataaatcagttgtttatttcaaggcaaaatttgctacaggacactcgaaaatcgtgtaattggctgtgagacaccgcaaaatctgggctttgcccacggacactatgaaagttgtgaaattggctgtgagacactggaggcaatatttaataatttccgagataaaagaggtcagataattttctaaaagaccaatctacccctgcgcaattggcatgccggcatggcatgtgcgcaccgcgcctcgccgcgcacagacgcgaatagggccgtgcctagcgcgttccatacagagaaaatctctcgctcgtcttctccgcctgcgctccattactgccttgggctgcttcttcctccttgatcctgcacggtgacgatgcacctactgttataatccactcagatgctaattggtctatggcaccaggaaatatttgtcaccaaaggacaacttaattagttgattaactgacgactgtgcagagaacgtgcccttcatttggcaactgagatccgccgtccgccgctatcggcttgaaaccgccagaccgcgcacttgccgtcaggactcgtcgggtttgccacagggatcgatttactgcgtcatcatcacagcttcagcggccgccgtcgtcgccgtcctcaacaccgtcgctggcgccgaaactgcctccgccggtgccggcg

SEQ ID NO: 14252 - DNA, 7394 bp, Oryza sativa
  unsure (1)..(7394): unsure at all n locations
gatgagtgtaactaactggaggatggggtactcaactagaacaattttaaactgccttgcagagcctggtacaacaaataaatgctcaaccttgctttcatcatgctttaacttgaggaacacctgaaaattgatttgctcaatgaagtcagggaaagaaccatagtgttccactgggaaaaaaagggttaaattctagagcaacctggtgaggtttaaatgtcttcccgagtggtgtactcagttgaaaagataaccgcaacttctgcagatggtttgcagaaagagaaacactagtatctttctgcagatctatcctgaaatgaagaagcttgaaatatgagacatataaagcaggctttcccgcttcacaattttcatgcaattttatattaactaaatcagaatattaaatagattcacaatcacaaaacaacaaaagtaaacaagttaaaaatagcaggaaaatctccagacatatatcagggaaatgaaaaataaaaactaagtaattttgtagcacttgtctgctattccagatgagaatggaactctttcagtggctatatacttaagaaagcagatgaaatttcttcagtacaaggttggcagcttgtctttttttaatgtagctctaactttttttctctctttctttttttttaaaaaaaaatggaagggaatcacatcgttaaacaatttacttttgaacagactccacagtcccagcatcattatcagaaattccgatttctgccttatcaactttgatcaatcctgtgacaaagatcgcctcagtatttgtccctccagtagcataaatagtttcatgttcttgttcctgaagagaaatctggcgagaaaaaaaaaaggcttgtcaattactattatcataacacaaacaaactaatacactttacacatacctcaaaaacaagcgagtacttcccaacatctattttcaatggagcaatatccaggtaatgaacattgttatcaaggtcaaactgaagttcctgatatcagaagtaaaagggttttagaggatggcagctgggaaaaagacaggcatagaggaagttccaagaggtagccactaatcttgattctaccttggtttcagtagtgatgaccttagagtcagagcccagcacttgtacaagattcactctgagaggaggtgcagcagatccaaatactgtggtgacttcaacctgaaaatgccaagtatttacaaactggagttaacttatatggactaaaacattacaaaaaaaggaaatcgatgagaaactattgtagataaggtatactttatactaactgtagacataatcgagtaataagaaaaatctaggtgtagaatataatctagaaggacaactgaaaatggcatgtgagttactataacagctttgctggttcaaacttaaaatatgatatgagttaggaattaaaattttacaattaaatgcagtgcttgcaagttgaataatatgggatttctcccatcataacagtcacttttgcagtgttcatataaatgtcaattcatcacagcacatatcaatcgaatgctcattcatacagagattcacactcaatcctagtaaaaattttatacatctggcaaaatccaatatattagcaagtactaatcaccttaagctggtctttggaggtcagcgaaaatactttggaaggaagtgaaaggaccagaggaacaaataccctgcaaattgtagataagaaataagcacaaaaggctaacagtgcactaagaaacatttacatttttgaaaatatattaagaaaagggcagaaagaggtgtcactcaatatattacaaaaaagaataaaagatgcatgccaattgaagaaaacaaataaataatgacttgcctattgttttccaagaatgataatgactcaatctggttaaagcaatcctttgcgctacctggtagccctataccaagaaaaaacttcgccaaacccagtattttctcaccagggatctgtagattaagtgcagctacttaacaaagcttttacacataaatttattgaatgattattacaagattgatgcaagaaagctcacattcaatttcccagaagcaacagctgcaaaagaggtgacaccccttactactgaagcagatgttgttatagggcccttgtattcggcagcatcaacatgcttctcgtcaaagtaaaatgtcccatcatctgcaaatataccattagaaagtattcattcattatattttgtatttgtaggtgggatgattcctactaatctttcaaagtaggcaaggtaaatttcctcacttactacgcataaaatcaaaatatgaaaaataaattgtactggctactgtcacttatctaaatctcataggttttgtaatttggaagctgataccatcagggtaactttgcagcacaaacaaaaggttatagaacataccatagctcttgatcgtgtcaaatagcttcacaatgtcatttttcaccacagctatctgttgtcatgatattttaatagaagaaacaggaatcagtacaaatttgcaacaccatgctaacaggcaatgacacatacgaatgaagagcaccaacaaattgtatgaagcagtgctacacaaaagataacacataatcactaaaataaactatgaaagtcatggtacatagaatgccatagtggcatggttgaatctcttttaaaatcacagacaaggttgatatatgttcaaggtttcagatgaaagattgtcgcacctaaaggaggatagttggggagatacaacattaccagattgttggtttcttgtgaaattaagcacttcaaactttaatgaacttgtattatgatatttagctatctatggtcatcgatacttctttatcagttacagaggtaatataatctataagatgagtgctatatatgttctccatccattcaaagccacttccctattcatggttttataacataatttacaccatatgaaattactggtactttattatttaggtcaaaggaagaaaaatcatatagctattgcaaatcaagtatatatactagatactcaagtagagaggatgcacacaccatggatgagtcaacttccgaatctgccagtgaaataactgcagacaatgcttctagtgcgatacctgtagaaatacattatgttaaatatcagtaacaaaaaatatgcaacccaattgcagtaaagatcttcccattaagtggtgaatggtggtatagaaagcttcacagagatagaggcactgattactaatccactattcaaccctataataacttaaatgagtctcaagaaattaaacagtgaacagcaataagcacaccctctaatacaaggtcagatcaacattaaatttatgtttacaggtgccagaaatattttaagtgttacaatttaataataactgttaccagcagcaaacgtgctcgattcagcgctgttagtgtcataacgccatcttccgtcactttggctaagtgcctaaacgaacaaagacacatctcagcaactctaattttaaaataaaattctgatgtaaattgcagaatgtaaacaagagaaaaaaacgcaaagctataatgaactgttgtcaccttaattgcgtgaaatgtgttatctgcatcaggtaaaacaacattgtggccttgttcctgaagcaaacaatgcaaattcattaatggacagaaaagatcaaccaactatcaacaagtggagatgagcaaatcaaacaaacaagtataaactagtagtgaattcagcggagtaaccttgatgctgagcaaccctcccacagaatagtagagttccagcagcgagttagtgtccttgatcacagccttaagcctcgtagcgacatcctaacaccaataacacaagtgtcaccatgccatcaaacaagaaaaccccattggcatcaacaagatctgttaagctaagctaagacccacatcgtaaactccggaatcaacactgcacttgaggacgccgctgatccgggccgcgtggaacagatccttcgcgggcgacgatgacgaggaggccagcttctcggcggcgaacttgcacgccttaccaatcaagcccttgtccttctccaccccgagtatctggaacgtcctgaccgcctcatacgtcgtctccaaactgcgcgaatgaacagaccaaaacgcaagtaagcatccataattctcaagcagggagccccgcctcggatcgatctggagctgagctcggtggcgcgcgcgcaactgcgcccggcgtgggacaagcactcgagatcgggacactgtcgacttactcgccgaaggatccgtcgggggaagcggcgaagagctcggcggcagcggatctgtgggcgtcggaaaccgggcggacggcggaggcgaggggagcgacggccacggcggcgatgacgaggaggaggagggtggccgaggctgggagacccccggcggcggccatggccgcggcggcggcgggtggcgcggccggcgagaggagagggggggagggtgtgtagggtttaggagactgggtgcgtgggagtggccagatctgatgagaggttgagggagggagactactagaaatattttcgctcgccccccggtcagcagccgcctcgacgtctggactccggcctccggggaggaggagaatgctttgagattggtgctctggtttagctttgagagcaggtacaatagagttataaaccagctataatcatatatcgagaagaagagagaagagagagaagaaagcggactacagatttgtagccggctacaacacggattccaagacgttacgtgtgtatgagaggtgggaccgggtattaatgatgtagtatatttttatagttaactattatataaatgggctagtattaatgatgtagtatatttttatagttaactattatataaatgggctattatattagctatagatgatttggagccaacagttagctatactattaaacttgctctcctgtttgggccaatcttttcacttatgcttatatttattagtcaaaatttgaattttcaatattaaattttgaggttattttattaaagtttactttttagtatttacttttatatcactaagaacacgtatataaaatttttattcacaaattactattcgtttgtaaatatatcgtttggcttattccgcgaataaacgaaacgaagggtccgttagtctctgccatttgcatgattttcaatttgtttttcctgatctttcattttatttatacgagcgaattacactatagctagtttttattactcatgttacgtgatggaccatgtttctactaggtttttcacttaacagcatataagattacacttgtttgcagcttggaccagggtatagcgatatgggcttttggctaccagcctagctcaaaatcatgctcggagcaaaagagtgaacatgatctcgtagagtgcatttaaggttcacgttgacaatgccgaaacagatggtgcctttggcgtgagttgtagactggtatttaacccctcaccgatgtggtgccaccgtgcagggtgccatccacttctcggcattcggacacatccaaacgacactggtttcttctgctagcgagctgcatcatgaaactaaaggtcagacacccacaaaggaagtgaggatgtgtactttatgcatctgtgctatatactagacatctttgttcctagcacccgctgcttcaattcaaataaaaataccatcacatatctcctagtaacatgccaacggttattggaggttggggcaacaacttagcatgcagatatgaagccatttactcatccaaaatgtatgttggctacagcctcctctgctaacttcactagcgctgccaatcccatctttcgtgtgcgtgatgttcgagactcgagtttagcgcatatgtctcacgttggaccaaagccagcgtgaaagttcaattctcttagcctttattgtcccctattttcaattgcggtaaacataaaacaacctattaaaaaatttcaaggtcatccgaaagctttttatcatttgaaacgcagaaatcttatacaaagaaaaactatatatttccttcgagattcttgtgaaatgcctccgatgagacctcaaacttgtctactattctcctgggccactatgccgagtatttgtagctcgaggactaccaggccatccagagcccaagcaatggccgcgtacagtgaaaggaataagttcacttcgtaaccctcaaaagtgatcgaaatttaatccgtgaccctaaaccacaaaaccggatatcttgaccccaaactcttgaaaccggtgcaatttgactctctcggtggttttagagggcagtttcacactgacgtggcgcctacgtggcgatattgaccgagtcttcgttagtacgtggcgttgacgtggcacttacgtggcagtcgaattaaaaaatatgagtaggacccattagtcattcaaaaaaaatgtgggcccactgacatgtggggcccctccttccttctacctcctccttctctcccttctctctctccccttcggccgggcaggagggcagcgagagcgatcgacggcgggcggcgaggccggagctgcggcggcgggcgagggcaggcggtgattggccatctccggcgccctcgacggcgacgaaggctaggcgaggcgacgcggatcgaacaccagcgcagctccagagttgtttccttgtcgcgatctcgtttgttcgtatcctttgctctacctctcgaattcgtgttgtttgcttgtcgtgatctcgtttttgttcttgctagtggcgatccgttcttctccctctgtttcttccttgacttctcgccgccggcgtggtgtgcacgcggcaaccagaggaaccgcgaccgcgagcgcgcgcaggcgcggaagcccaacgccaaggacccccaggacgggctcacctcggagcagcgccgcgagaggtctgtttgctcggtgtctcccgattcgatctcccttgtccccggcctgacgcggggttccaatctgcgggttcttagatcttcgagtttggatttgacgcagggataagaaggcacttgaggagaaggccgccaagaaggcggcgcaggccgcgggcggcggcggcggtacctccacggacaacaggagtaaggccggcggtgcaaagaagtagccggcaccgccgtttgtacgattagtaatgccttatnnnnnnnnnnnnnnnnnnnnnnnnnnnnnnnnnnnnnnnnnnnnnnnnnnnnnnnnnnnnnnnnnnnnnnnnnn

SEQ ID NO: 14253 - DNA, 13300 bp, Oryza sativa
tgctcagcagttagcttcccagccatgatggatatccctccaatcaacactgcaatgacctacacaaagcttatttgcaagaatacatcatcaacggtacaacaaattcatatcagaaccaggcattttatattttacaaaattgctaatttaaatatgttctgattggagtatcattatgaattgaacagaaacatcaaactacctgagtagaatggtatagatagttcaaactcaagctccagccttcataagccattgtttgccgaaagcttacatcatatagcttatctagccactttgcatatctatcagagtacaaggcatcgtgagattttgtttttgtgtgtatgtatgagcgtgtttgagatagagagagagagagagggaggtagagattgccttttaaactcctgcttttctgttccataaacccgtactgtccgaaccaaacttatcacctcttgagcaacctgatttagtttaatgtgaaaactgagatgaaaactttgccttatgaaatgctaccttcatccaaaaatataagggatttttcccatgggacagaggaagtagcttattgtaaagagtacaaacttacattgttggcacttgcagtgaactcctgtgcaaatttggctgctcttttctgatacctattaatcacagtatcataatgatttctctcgcatggatcacaggtgttaagcaacaaaataaaaacgtggtggtgctttcttgaactttcactactcaggtgatgtaatatgaaagacagctaacacagaaaagggagagacaatatacaaggtaaataagagtaggtttttaccgtccatgaactagcataatggtcgacaatgtcgcacaaatcaacatagtgcacattccaagtggccaagataagactagcagataaattagtgcgcctacaccctgaaataaagtgacaaaatggtacgtgagtttttgaagctactggttacattttcatacaagactactaaacaaccttttcacctgaagcaaattgcgtgagataagattaagatcattgccaatgactcgtgacacttgctggcagtcagaaccaagcctacttgtcaaatcaccaacagtttcttcatcaaaaaaagcaatgtcctagcataatttaaaatacagttaaaagcttcatacttgggtcaaccaaagtaaaacaacagaaaactttatgtacattaatgaaatttctttcagcagtaatattttttattccttttgttttacctgagaaagaatagaatcaaacagcatttctctcattcgtttgacctacggaaaattttcagatgatgaaggttagagactggtcaaacaaaggggcaatcgtgaggaataaacttggaaagttacattaagaaatctaacatggttttaccaatatcatgtttgcaacaccaaaacagcagcttcgcacaccactgcaaaattggataccagctagtaagcaaccacaattgatttttcacaaaaaaaaaaaaaaacatgcagaagacaaacaattttggtttcaatgcagattacggagtatcttgctaaatgcctatagtgcatttgacaggacactggtaaatgtagaaatttgtatttatgctaccctatagtgccatgagctaccaaatcgattcatcagcataatagaagattttcaatattcagacccattgaagctcaaagcatttccattcctgccctagatttggactaccaacacattatatgatattacattgtcaaccacaccatccatggaagtgatcttatggacctaaacgtctaacgaccttttcagttttcaccacaacaacaatgtgatcaggtacagttgtattgtggacagaaatacagaatgcatgcttgaaaatgcaggattaccaacttctttggtttttccgatgaatgcagcatcacctacttgttggcttctctaatgatcgcgttcacgacttaagcacagttttaacaaagcaaagaagcaataactgacctaaacactccggaaatcaaacacagaacaaccagaagcttagcgttccggtagaacacagcccctccgttctgcgccgagaagatggacgctgcgaggagatggggtatcgcgatctccgcgagctgcaaccacaaccacacgtcaccgcgttttagacccatcaacgagaactctgcagcagcagaggtcaaacccagaaatcgccattaccgcagcgccgacgagggacgcgaatccgacgaagacaacccatcggtcggaggcgacgagcgcccacatccgcctgagcgcggaggcggccgtggcgccgctggcctcggcgcggccgcccccggcctcctcgccgtcctcgaggcgccaccagcttcccccgggcagcacgttccgcagccgctcgatgaactccccggcgagggcgcgccgctgggccagcccgccgaactctcccccgatcgccgccgcggcgcggatcctcgtcggcctcgcccgccccggggccctcctcgtggccgacgccgaccgcagaagcagcgacggcgccctgggccccaccgacgccacgcccaccgacagcgccgccgagccggtggccgcggtgaggagcagcgccgccggagtcggcattctccactctcgtcaaacccctctatccctccctacaccccaccgcccgattcagatcacgattccgcgttcgccggtgagagagtccgccgcctcggatagcaccggcgaggtttaaataggcgtaggccgctgcgtcctcgccggagttggttgctctgccgtgcgcggcaccggcgccgtaacgtctctaccttctccggctaaattgtattttttccgcggcttttttaatcctttttctcttccacttttcgcgtgtgcttcttttttttttctttttcctaacgtgttttttttttgcgattttttctacgagaagaaatggatggaatgaggcgatgtggtgtggtggtggtattttgggggatttaaaacaattttctggaggagaataatcgtcgttggattttaggattggacacggagaaggattgaaagaacggcttcgtgcgtggtcgtggcattggaacatgaggtcggtgacacactgacacgggatgttagagaacaggtggtggtgccgtggtggtaggccctatatagactccatcgtttgtcatggagttgaggtagtgtttgtaaagtgctcccggttttaagctttaaagtagtgctactgttgttgtaaaaggtcaactaaccacttataaacgttgcagtatgggttagtataaaatattatctcgatcacaaaatatgaaaatataaccacatttaaatagattggatctatcgtactatgaatctagataggggatttgtatgattcacccgttcaaaggttgctatattttgaacgaacgaagaagtaatttaacatagagcatgatgatatatgtcacaccacaaacatttcagttcaaattttatcttcacgaggaaaaacaagttctaaagaaaagctggaattgaatgagcatgggggcatggtacgatgcatgggattcgatcttcgtcaagagcattttcttacaacatattccattcgtttcaatttgatcgtcacccataatagccctactcctattgatcagccaatatataagcgtggaactcgagcatagtggttgaggttagctgttgtaagctacgagattagaggtagcttgtattgtgttatctctgtttcttattggtggttccccactcttctcttgggccttgtatttctacactcaggtgccatcttatccaagtagaagtgtagaactaggatgcaaggatggatacgatccgagtggtcttggtcgggtcaaagtacgattgtattttttttctttatcggggactcctttattttctactacggactctaatataacatacttgtttccgtatatataggacttggaacatggtgctcccaccgaggtatgtacacgtatgtagaatatcctatatttaagaacagtaaaaaatattatgttgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcaactagctctcggtgacttggctcctcgtaagctccggcttcgtaggctgtggagattgtgttggctctgagattcaatgcctaaaccctccccggggggccccttttatatcgcagatctggaggtctccacatagaactcggagatatcagaccctatacgatacgccaacgacccagttctgcctaagtaggattcttcccatctgtagattccgtaaaaggtttccttagaatatacaggaaatatctgcatgcgcgtgggtatgccatatcgatatgtaacgtatatcgaagggtaaagggtatgcctaacccgtaaccttgacagtagcccccgacttctgcttaaaatgaactcgtgcaaccatttgcgacttcgggtgtcgagactattgtcattcccggtgcgaggaccgcggagatagaccgtagtcgagcacgccatttgaagcccaacggtcacgagcgaattttaaactgaagtccaaaaaactgccgcgcgtaacgggaccagaaatttccggcgggcatctctctctgttccctggaattcgcaccgtcggtagtgcgcctatttaaaggaattttgggaatccattttgaagtccgccaaatctgttaaacacacaccacctgcaagcactctttgccttctccgccgccgcaagaaaccctagttcatcaacctaggctcgttttccggcgaccttcgatcagcaacggacctcggcaaatcggcttccaccagtgcaacgttgaagaaactccaggaggatggcgctcttcctggccgtggaaccatggagagtgaagcaggaggtactaatcctcagcccatcttgggtcgcatggttgcgatcgaagattatgttctctgcggttttctccctcctccttccgaatttcttctcctggttttgaatttctatggtctttctcttctccatttgaaccccaattccatcgccttccttagcatctttgtgcatctttgcgaggcgtacatcggggtagagcctttccttgatctttttcgcttttactacgaactgcgttggatggaatccaacagggtatctggttgcgtcgggttccgacttcgggatggcctgaagtcgcgttacattcccttccagtgcccttcttctcgcagcaagtggaggaataggtggttttatcttgagatcaaggactcgaaccctgtcttcgtggttcccggagatcaaccggacaagattccgtcttggaccgccaagccccccttgaccccctctcttcagtcgtttattgacatcatcgacgatctccgagtacgggggtttttcgggatatgaagtcgttgcagacttcgttggtaggtggatccagccgcttcaggctcgggcccatccagcttataactattccgggccaaaggacgtgacccgagtttctcctcggggtatctttctcgcattcatcttgacatacttgtgttcgcattcctcttgacttatcgtaggatggttctcgattaacaggtctgagcggcgaaaccgtggagcgtcgcgtcggccaagtgatgatcagcgacccgaccacggcgagtgacatccctgtgcccctttgtgaaaagggggcagcagaacgtgatgaagccatcaacgtaagtatattcgatgaatatcccgcattctcctttcgaaatcactttatgacttgattgagcgtaggcccttcctttgactgatatcatcggaccgctcacggaccatcaggtggcgtcatctctgaaagtgaaggtcgtcaaggaggtatctgatgctgccaccactagcggtggcaatgttccaacaaagccgaggaaattctcgtctgtaagcggacaatgtcgcaaggtgtcgaccccctcggtaatttattttgttgttaaatcatgcagcaagaaggatttttccttactttgcgttgattgtattccaggcctcagatgcgtctcccccacctccacgacgacaacgcattgtgacgatcggcgagaagtaagtagatgaattcttgaatccccgcgcttcttatttgattgttgtctgactcgtggtcgtcctgtagggaggcgcgggcaaaggctgcgcaagccaagtccggaggagcttccagtgcgtcgcccgtcgtggcctcgacggatgtcgtgcccgcagccgggagccgggaggcgacgcctagtggccccgtcagcgaccccgcggcaggtcgtgatctaccagttgcagtcctcacctgggaggagctccaagtcgagatggggcgcctcctcgaagccggtgctcgcagcatcggccgcgaaattgcggaggcgaggtcggaagcggcgacggtgaacgtgcgtgctgacagactggtgcgcgagttggctgaagcccgtgaagacctcacgaagatgagggagttggcggctggcaacgagcgacaacggaaggggcttgaggaccgaatgtcggaactcgggaacaacctatctgagatctggggctcgttgagggtcacctacaccggccttcaccagctcgctggggaatgcggcgtcacgtccacgatcccggcgaatcccgatgagttttcgctgacctcctctctcgcggaactggcgacggcaatgggggaaatcccctccaagcatgcggccaggattgcggaggagacgtcaaacggaatctacaccggggcgtgtcatgtcctcgcgtgtgtaaggctgtcgcgtcctgaactcgatctgcgcgagatcttggaccagggggcggccagcgacacgcgtaaggaggtgatggaagaagtcggtgatctgggggagtctgttctccccctttttgaagagtaggacttcttgtatttcctagataatgtgtaaaactcgaactctgaccgcctttgtgagtgcgattactatcccggcttactttggtatgctgacctcgggaacttttgtcctcttgtagagatattgatgacgaggatgtccagcagcgcgggcagcccgagtcactggcagtaattccggtactcgagtttgaaccacacgtctcgcctgaccatgtggatcaaccccttgatatagagggaaggatggcgacgacttcctcaggttagtagtcccttcaccccttaatgcccatctgactaggtcagccatgttcccgaaagagatgtacagctcgacttagtgattatcacgtttagcagatctcgagggtgcccttgctagccaagatcgtcgtatccaatactggaagcgaagtttgaagtggcggagctcgagagaaccatgctggccgtgaagaaagagcaggctgtggaaacgctccgaggccgtgaggtatggtttaactcgtacttgaagagttgctgcacatccatggccagagtatgcagggagcttcgagtagtccgcggagatcccgatgagtcggcggccaggtacatctcgtggcttaatggggcctgtgcccaactcgatggaatcggtaagcgtatcgacgaggccttgaagcaggagtgtcgtcgatcgagccgatatgccggggggcatgtgttggcttgcctacgagatcatcgcccgcacctggacctcgaacatcttcgtgagggttttgctcgttctcggagggctccggcggagatagaccatctggcaaggtcaatgtcgttctcccatcttagcgacgaatctgcttagtgctgccatgcatccggttagcttttgtacctccttgagtcttgtaggcgacttcatgttctcgattgccttgatcttctcggggtttgcttctatccctctgccagagacaaggaatctgagcagcttgcccgacggtactccgaacatgcacttctcaggattgagcatgaggcgatatcgtcggaggttgtcgaacgtttcccgcatatcgtcaatcaatgagttgcctgtcttggttttgacaacgatgtcgtcgacgtaagcctcgacattgttgccaagctggttgctaagtgcgccctggaccgtgcgctggaaagtattcccagctgttatcagtccgaacggcatcttaacatagcaaaataccccaaatggcgtgatgaatgctgtcttctcttcgtcctcttttgccatgctgatttggtggtagccagagtaagcgtcgatgaagctcaataactcgcaaccggctgttgaatccaccagttggtctattcgaggaagtggaaagtgatccttggggcacgccttgttgaggtcggtgaagtcgacactcattctccattttccgttggccttccgcaccatgactggattggctagccactctggatgaagtacttctctgatgaagccagctttgagaagtttgtcgagctcttctcgtatggcttgttttcggtctggtgcaaatctccgcagtctttgctttactggcttggcatcgggtcgcaccatgagtttgggctcaatcacctccctggggacccccggcatgtcggacggccgccaagcgaacacgtcggcattgtcgcggaggaaggtgatgagtgcgagttcctatttctcgtttagtgtcgccctgatcttgacggtcttatcggggttggcactggagagtggaacaatcttgatggcgccgtctggtttcggcgtcttgtttgtcttggtcactttcttgggtggctcagtcgtggcgggtggactgggcgtttgctcgaccatgtcgaggctccgcttgtcacattgcaccgccagctttgcgttcccctgaatagtgattgttcccttcggtcccggcatcttaagcacttgatatgcataatgagatgcggccatgaacttcgcaagtgtagttctcccgatgatggtgttgtaagctgtatcgaattcagcaacatcaaaggtgatctgttctgtttggaagttgttggcttggccgaaagtcacgggcaacgtaatcttgcccaaaggtctggacgatgattggggagtaattccatggaagggttgatcagttggtgtcaactcgttttgtggaattcccatcgcgtccaaagtgctggcgaaaagaagattgattgagctgccaccgtcaatgagaactcgcgctaccttgatgttccgaatagtaggttcgaccacgatcggatatcgtcctgggataacggcggtcttggggtggtcttcttccgagaactctatcttctgctcagaccacttcatcttgggtgtagccccctgtcatgtcgaacagacttcatgttccactttcttgtattctcgcttggaggagtacgttgtggaaccgctgaagatgtgtgagacgtggaggtcggagtctggatacgctaagtccggttcgtgaggagccgtctcttcgttcgtctcgacaacgcgtactcgcttgcctttttcaaatgccatgtgcttctcgagcgactttttgaaaacaaggcaatcttccagagaatgtctgtccgtcttgtgtatggggcaccatgatttcgttgtgtcactgctttgtgggtctgggcgtttgggagggttcgcgtattctgctgcgaggacttccgcttgagctttccttttcccgtttttgcgatttttcttcttgcttgactcagatgtgtccatggctggtttcttctctcccccggtcttcggcctatcgttcttgcgtcttagcgcatcatcagcgtgggcgcatcgctcaacgatctcgaataatctccgagtggttgtgatgcgtcttgtcgccaactcctgggtagtgtagcgatctctgacaccggatttgaaggcgcgaattacagaagcatcgatgatttcaggaattgtgtttctgcactcgttgaaacatcgaacgtattccctcaatgattcactctagttctgtgtcaacgcgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacatggtcggtaaatagtttgctaacgcgttgtcgtctgcttcggcagcatagagtactgtggagtagacttgaagaaactcctctgggtcggtgctcccatcatacttttctattgctccgggtcagaatctctcaggccatcggacatcacgtaaggaacgaccgaaagccctacacccagcgttgggggcggtgggttgccggcggtcgtgtgtccttcgtggatgtctgtctgacgatgaggaggaggcggatgatgacgatgacgatgggtcgcttggttccggtgtacgattacgaggatgacggcctggatctcgacaatcctgtcgtcgtcttccgctgttgtctcggcgccgatctccatcgtcgtcgtcgatacggcggcgaccatgaccagtattgtctggcacccgtcgttcgcgatcgttgtgatcgtggtggttgtcgtggtcccggtcctcgtttgagcgatttcctcgatttccgttatcatggcgccgtgaagagacatgacgccgagagcgattcacgttgtctcgtgtgcgtcgtgcttcccggcggccgttgatttgatctcgaagatcgccagtgccgcgaggtggaggggtagcttgttgaggtgattccctccgttccggatcttcaccattggcctctccagttggtggctgctcctggtgtgctgcggtagcggcttcttcaaacgcgttgctgaggttagtcaccgattctcgtagacgttctgtccaacgctcgaggtcaacgttcagaacgggatcgtaaggagtttccctcagtatcgcttgaacggccctgatgtgctgggctggagtagtcgattgattccccgcttctgtgttggcgtgcgctgacgtgccaacgtcatcgatagccaatacctcccgcggcgcgctcgttgtcgatgacccatagtcctcaaggagatgtaagaccgatggttcgtgaggatcgatatcgattaccccaacgaatcaatctgaagttggagtcgctccttgttccttgccgttatccctgatggggatatatgacttaggagactgagctttcatggcgccgagaaagactttgcagctcgagaggacatgattctttgtcttgtgaataggacaatagacatcccgagttggagaagtacgctgaattccacgttctttgcaggcgcgaatttcagcacggacgttgaggaaaacccagcaatcttgcagggtgtgtttcttggttttgtggataggacaccaagaccttgtggcttcgtaagtcatctttgtcggctcgtggttcatgtcggaaggacaaggtttggccgtatcagaatccttcttgagcttggatgtcatcgatattccgttctccgtctcgacgggaggatttttcgacatggaatcgccttggttcgtagccactgcgttctcgtctccggtcattggaggaccggttgagatcggtgtcgtggtgtaaaccgggaagacgatttcgccgacttgagtccataccagcattgttgaagcagggagtacttggctgaggctggtgctgacgttgttgtcgacgaagctggatgacatagtagtagaaccttgagtaccaaggacccctacctggcgctccactgtcgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcgactagctctcggtgacttggctcctcataagctccggcttcgtaggctgtggaggtggtgttggctctgagattcgatgcctaaaccctcccggggggggcccttttatatcgcagatctggaggtctccacatagaactcggagatatcagacccagttctgcccgagtaggattcttcccatctgtagattccgtgaaaggttttcttagaatatacaggaaatatccgaatgcgcgtgggtatgccatatcgatatgtaacgtatatcgaagggtaaagggtatgcctaacccgtaaccctgacatattatttaaaagatattttacatgtatgatttacaaagtggatcatatataatagacttactaccgtaaacgtgtggatagccaaatgggtcgcccgactcggcccgagcacaaccaggccgaggctgagttcagtcaagtcggcacgacctgacctacacaccaggacgggccatgcccgtccaagtgttgcaccaacagcccatgaacgactagaaggcacgaaagcccaccatgctcctccttggaaaaagtctattttgtctccctgatctctttgggccaactctcatatggctcaaaataagtatattttgaatccctcatctctttgagccgtgtcgagccagcccatcgcgccgaggcagaggcccaagcacgacccaaaggtctggtcgggccaacaagggcctgactgcttgggccaggcccaaacccatgccattggccgagccgtcgggcctagggcgttttggtcaactatacttctttccacccgatgtactttgattttttttatttttaatatatttttgaaaataaactatttgaaaacttattttcagctctgaacctttttagcttgccatttataactgacatggtaggacaacgttttggcacttttcaacagtggcgtatggtaatggcagtgaagggagaaaataaatcgcggatggcaatggccaaaagatttatttttaaaagtaagattttcatagggtttgttttaaaatttttagttaataatggttagaaaaaagatcgagctacttagccaagcctc

SEQ ID NO: 14254 - DNA, 26975 bp, Oryza sativa
  unsure (1)..(26975): unsure at all n locations
atgccgaaaaaaaccttatcaaattgtcaaaattttggtatagtgactggcaggatttcttatatagtcacttttttgacaactttaccaaaatttgataaggttgaaaatggcatcaaagttaacaggcccgaaaattcccattagtggctctttactgaaccagtgtttttctaatgttgacttcttttcctcgactcaaaacgataacttcctcatttcttattactacatattctcgaactgctaaaatatacatcttatataaaaatcgttgtacataaaattttttaataaataaataaataatatttctaatatataatatttaatatgtaaacaatcatgcgctaatgatatgttccgtttgggagccacaaatagctctagccaaactacattcgaattaggactaacaaactttatatagcgaggttcacataggtcgactcaatctgtacgaatacaaacaggagctcatgcattcctacagaagagtgtcctagtctcttctctgatctctcttgtacatctgatcctctacatttttttaaaaaaaaaaagcagtgtaacttccggctcgaaaggagctccctagccgttgttgccgctgccttcccaaacatcttctccgccgatgccgctaatgttgttgtcaagctacggtggcggtggcggaggctctctctctctctctctctctctctctctctctctctctctctgccgcccaacaacatcacgaagcagataaggtcaaaactcggccatcaaaatacaaattggattggactacgttggcttcgctgccatgtccaacattacttgtcatggttgcctaaagccctcatcactaggtgtgatgcaaaattgattcaatctggtcgtgcttgccatggccgttggaggatggttgttggctttgtttaaaactgagcatttgatgcttccttcctccatgtttcaaatagaaagtgtttcttccattcacctgatagaggcaaataaaggaggccaaagctccatcctgatggctacactttgatactatttggtctttgtcgttggtgaccatatgaggatgcatgctactcaggtggtgtcgtggcaacctccattttgatcgggaagattggtcagcgattgttgaaatcggtttagaagatccatctttgattttttttatggtagcagttaatttcttgtccatggtgcactcgctttaactagaaggtggtacagagtgcaagcaacaatgactccagggtgaaaaccttgagatgtaatctaaattcagcagtgtcagctcttgtttgtcatctcatcgttgaaggtgtcgtttgaagtgttggataaaaatccagccctatttttggatgacaatgtggtagacaggggccaagtcgttctcgaaggtgcttggatccgagtaggtgcataataccgaggtttgttttcgttacggaattgctaaaaaatcgtgcgatagtttttttcaaagaaatttgtcaacgcgctttaactagaaggtggtacagagtgcaagcaacaatgactccagggtgaaaaccttgagatgtgatctaaattcagcaatgtcagctcttgtttgtcatctcattgttgaaggtgtcgtttgaagtgttggataaaaatccagccctaaatcgatcccgccaccttcatttcactcaggtgtctcatttaccaccaagctagcattgtttttgtgttccaaacccagttacgtacaacttccagggtgtagttacaatgtaattgcttcgcaaaaaaaaaagttacaatgtaactggggtgtagctagacatttttttgccttaaaatctgttgacagcgctataggtagacccttggtaatgtgtgttgagttgctccaagataatatatgtctgtcttcgccttccccccccccccccccccccattcccattacccaaaaaaagttgtatctcctagcttctcaccaactaaaatgcagatatcataatttgaatatggtagatggagttatattttcacgactttatcatcgcaccagtgatgttttccccttccgattgtccactcgatgcatatgccatgataagatccgctttccactttttctctgggggatgaataaaccttccatatatgtcccaatgtaaggtatagctatagctagaaaccatgcgcacgaacgaaattaagaaacgaacgcacaagaggacagggcaccaatagtacgtaccacaccactaccaatcattacaaaaacatatcataatgtaggaaaagctacaaaatatatacactaattaatagcatctataatgttgtccctgtagatatctgcattatgttcgcgcaacagcgcaccacgggatccagaaagaaattcgccgaaacaggcacatcattgccttatccttcacgaacacaacacacacctaagcctctagatagctatatccgtctatcgctctacctatcctgtccccttctttccttcctcccataaaaaaacaaggaaacaaacaaaaaaccaaaagggaaaaaagtggaaaaaagagaaaggcagaaggtccatcaacatctggtcgctcgatggggtgatcgatcaagcgcacacagttccaatcatgcatgtgactaatgtctacgcgacgaggctctgcagtgcgcgcgggcagaagctaaggttaaaccctgtttggtagagctacaactcctaaattttgcttcaggagttgagtctggagtgaagttatagagctatctaaacccaactccacatctctaatttattttgtgagagaactccacccagctccgatcacattttaagtggagcttaaactgtttggctgagctctaactccaggagagatggagctagagctgtgccaaacaaacccttaatattatgagaagttagtatagttaagaatttggagaagctgacaaaccaagcttccagtttttgtgtcaatttctagattctactgctgtagttttttagaatccggataaaaatttaaaatctgaactgtttaaaaaaaatttcagtagctagagattctacgagaaattacggctgacagaagctcccaatcaaacccgagataagatgagaagatgcggggttacgtggcgttgtgagagagagagagagcctcgaagcggggccaactagtttatcataaaaccgagcgtgccatatcgccttgtttccacaagcccttagcacatggcgcgctctcgtcgctccagcctggcagagtgaggcgaagacaagagatcagaattcagaagcagctagctctccaccaaacaggctactcttttactttagcttggttaatttcgtccagatcaagaatcttgctaggtggagagatgcaccaccaggaatcaattaacctgtgcaaggggttagtcaaactcaaacagcttgggcgggtcatgatgagatcatgcatccttggtccatggaaatttggccatgcatgcatgtgcaggcttgtaatattctagacacatgcatgcagggatggtcaatgtttttgatagcatatgcagccgaaatgccgaaattaatactatatactctagctagccgagatgggtttttttatgtgctagtattagtagatccacacaaaatatgcatgtaaatcctaaccagatgctcggctaaccacgcagaaagaaaaaaaaaaaaggtagtaactatattaaaaacatgatcctatgtctgcttgttagccgcaatggacacgacgattaaggtaattaattaattccataattcgatgcatgtacaggacgacgacacactacaggggttcaacgatgaacaaccaaaccatgcgtacttaagcgtcactggtacggggactacgggttactgatcaaatatcatccctagctagcgctacgattcacatgcacaacttaattaatttttttaggaggttttaccatcggttataatacggagctagctagctaataattaaccttcaaatggactgaagcttgctgctgctgctgtcatctgtttcttcagatgctaaccgccatctggctcatggaggcggcggcggcggcctcctggcgagaacgccgcacgccgtgcggggacttgcccttgcagccgccgccgtcagccttgcctgccgccgccgccgctgcggcttcggcactgtcatcgccgccggtgccgtcctcggcgccggcggcctttgtattggacgagacgccgggtttctccggcgagccatgcttatgcttacctaccgcccccgacgagttgccttgctcctgcgccgcgcgcctcaccttcacaccacgtatcagctgctaataattaagagataaattaagattacggttaataattaattagctgctgcttgcagaaattaacagaagtactccataaacaaagatactgccaaactggtcatccgaattaaagacaaacagtggcatgcagcaactatatatagcttattggcactcaaaatcacatccaactgagttgagttaaagagtactcgaaagaagtgggaagggcaatgatggatgaacattacatatttgcctgacttgatatcggagtagatcacaatgaaatcaccctcctgcagctcgtttgaacgaacaaaatcacctgaaaaaacatatgacaacgattaatcaacaatacttgagagccacaaattaaggatggaagttattggcatggcttgtgactgtaaaatttgaataattcaaaagtttgctattcacctgtgttttcgagaagatacatcctgcttttgttgttgggccaaaacctgtgttcatgaaaatcaatatccattaatgtcagtgaatcaaaatctaagccatcatgtattcgaataacttgtgcatatataatattgccaatggaaataattaaattaattaatcaaaaacatgagctcagcagaaccagcaaaaatcatatgcataatgttagtactgaaaacagcaggaaaagatcacttttatttttttgttgtatgcacttgagcatcaacatagaacacgatgaatgcatgctcctatttgactcccagattccaatgatatgttcgtatgacccacttgcccaattgggaaagggaccatcccatagtcatttactatttctggttcagaggtttctatcccctcccaattaacaaagaagcaagtggacttaaacaagcttaataagcaatcccaaatcatgcttgatgcttcgatcgaatgttgattactcaccggtaccgcatgttccacacctgagacgtcccgatgtcttccatggggatggagacaccatccctcgtcttcagctccggcaggtgaacctctgcttccttctgaaaccatccacagatcaagaaaggggagactttttagttctaccatgatcggaaatgtgaagagaaggttcaggcaaattccgtctttgattaggggagaaacatcaagtatgtgagtgtgtgcaagtgggatccttccatggaatggatttgtgccaagtggggtagtggatttggaaggagaaggtgttcgagatggtggtgactgtctcactttggggagcacgatgcggccgaggctcccgacgtcgctctgcttcagcaccttctgcagcaggaaccgcaggttcttgtccgtcttcgcctgcagcaatccaatcgatgccgtttaattagctaggttgataaatattggagattctatccctggacagcgatgtgagtgagtgagttttgagtgtgtggagtgtgtgtgaggaggagaatcgagttctcactcgcgtgagatcctagctatggtggatagcgattgatgtcaatcgtctgcatgcatgcacacctgccgcttctctgaagccgtcgagcgctgaaggctctccgctccggccgtcgccgccgcctgcggcttcggcttcggtttctccggcgagggtttcggctgcttcgacgtggcgggaggaggattgggcttgtttgataggggattctggatgatctgggccgccggcggccagatgccccagctccggcagccggccgacgacggggtgaccggcgccgagtgcgcggcgcgaggggagggctcctgtggatggccggagatgtggatctggctcaggttgagctgctggctacgttgctgctgcaggcaggagaggcggcgctgcctcgccatccgcttcttccgggcctcctttgtcgaggacggctcgactccggcgaggcgtggagagcacatggcgtggccgccggagtactgcccggggaatccggcggtgaacggcggtggcacgaccgacggcatggtgtaggagctcgtggaggagacggggaacggcgcgaattgctgcggccaggccatgttccctccgcccgacgcatgcatgtcgcccgccgccgccgcggtcggcggggagaacggctggctgctcacgaccacgctgctcttgctgcagctctgctggaaagggaacgggccggcggcgcctgggtacatggcgtcgccgccgtacgcggctggcggcgtgaaggcctggtagggcatccaggatgtggcggcggcggagcccatctcctggccaccggaggggaactcgtagccggggtttgcgccggggctggggagctgagggtccgacgacgcggcgccgtcgtcaatcgccgtgcgggggcgcttcttctggaggtggtggttctgcacccaggtgaggatgagcttgagcagctgcatggtgccctggcgcccgccgccgagccgcgcggccgccgcctcgatggtggatcggcggaggcggatgctgcggaggtcgtcggcggagatgtactcacggttgctcgtgagccactccatgaagaacgccggcagatcgtcgggcgcatcactcccctccatgcatgcgtcgccggcgtcgtctcctcccccggccgcctccatcaccgccttcgtatcgccgtcgccggtacagtcgtccgcctgatgcggttgcccggacatggcgtcctctatcatcatgccaacgtcgtccgggaacagcggctgctcggcctcccacgggacggacagcgacgcgaggtcgaggagctggtctatgtcggcgagctcaccaaacccgtccgccgccgaggccggctcggacggctcaccgccgcaaccccctcccgccgcggtggtgaaagcgctggacgagttcgacgacgacgacgacgagaaggttgagcttgacggggaagaaaggcacgggaagtccgggagcaacgggaaggtatcgtcagcgaaaaagacgtcatccctcgccgcctcacccctgatctccgccgccggggccttcccccgtccgccgccgccgccgccgccgccaccctgcttccccgggttcccgtgcgagtgcggcgccgacgagccggcggaggcgtccatgcagagtggaggcgggcggggggcggagagcgcgagatgtaggcgaggcggggggtttggctttgtttgtctgtgtgcgtgtaggtgtggaggtgggtgcagttactgagaaaggagacgaacaggagaagcagcgggaggtggagggtgggagagtagagagagaagagatgcggctgcggcccacacgtggcggccgccgagggctgtgggaagcgctccaccgcccacgccagcctctcctcagcgaccgtacctttcgccccccgcacggcacggccacgtcccactgacccgtgggccccacatttcctctgggcccacttatcattgctgggggctgcgtttctggtgggtggggttccccttttttttcctgagttgtaacggtcaatgacagtggggcctacgtgtcagtgggaagtacgggatttcggcgcgtgctggttttgaccgccgcggcagagggggagggagaggagcgttcttgcctgtggtccaatgacatgtgggacccaaaaggaaaaccatagagtggtagggtcgtgtgcgcgtagcgatttatgcgcgccgtaggatgtccgtgtcgcgtccgcgccgactaaggggctacgcgtccggtgtttccgagccgtccgatccgaaccaccgcgtgatcgaacggacgccatcttcgggaggagacctgtgtgctgtctggattaggaatatggggtgcgttttttctacgcgcacgtacgaaacctacacgagctggagatgatgacgtggaggtgtgggtcgcaccttggttacgatgacgtgggattttaccattggttgcagtggaggtggcccgtgtgaacacatgcagcgaacggcccagctcgatcgatcaccagcagccgggaagcgtaagcgctaagcagaggcatggcaatgccatggcatacgtgatcttgttctggccgttgcgtgtggaactgtgggtggagcatttgctttgtcttgttcgatcggaggatgcggctaggtaggatacatgttttgcaggggtaagagcaaatttccactttctctttgcttgtttgcttcgcaacaaatgcatttgaaaatgacagacaggcccccaaaatcagattaaaaaatatgttttctttggtgtccttagtgatgaggagcacccaaataacccatgcgacatcatccaaggattttattttttttttgcaagtttgtactttaaaatgagccaataaatctataatacacatttacgactacgtgtccttttcaatatccgtggaatcaattgatatattgattcatggatgcaaacaaaaacaattgtaaattttgggtcattgaacgatatatatctctctaaaatattatttatatcaagatgacgatatgcatgtatctttcattattaattgttcgctcaagcatatcgtatcctttcgagggaatgaagcatcgaagctcttgactcacatccaatacattgtctaattcaataattggatttgaacatcaaatatattccatgcgttgtgcaatttacaaatcatttttaattagtattttactattctcaatctatattatcgataatatgtattttactattcgatagcaactgtaaataaaggtcgttgggtgttacaggtcaacaatcatttgagcgatatggtaggttgagtgtttcccctatgttgttttggcataactttcatattactatgacaacaaggttattttgaagagttaataccgccacgtccattgtgcatatttataaaaagtaactatcaaaacacaactaaacccgtagcaaaccacatgcatatatattgaataagtgattttgtaaaaaaatatttatagattttgatatatgagggatacttgtaaacttatgtatataactcagccatgtcatcatctcaaataattttagacaatcggattaatatatatcacatcatttatacactgaccattcgattggaaaataccggtttgcaacattggaatactactatactttagtcatgattgatacaaatttcgatttaaaagtgtagttgcatgaattttgattcatgataatctatactgcaattatcatttgcattgtgatatattcatgattgatgacttcgatgctcggccacagggtttgtagcgcgcaatctatttgagcgtagccatgtagcattgtaccatgaacatatcaatatgtggtgacttcatgcattaaaagaagatggacacgttgtaaccacaatacaactttcttatctcccaacaacttatattacgtgcggacgtatataaatacaagaggctgcaacaacattttggctctttgtgattcattgatccgaggtaaggtcataaccttacaatggttcaccaccatgtatttttcgaagtacacccatgactacatctatacacgtacgcacggtgtttcgataaaacaattttgctatgagtatataggcttatggttcactgaaagacacacactaataaaaagacacaagatttggctcgtgttttggattcacgaataaatctggaaaatattttcaatgacatataaaattttctactatccccataaaaaaatgtactaactttctttgatcatggaaattaaaccctacaacaagattaacgcatatactccatctatctcgatatatatatatatacatatatatacatatatatatatatgcgatgttgttaaatcttagatatatatttgattttattatgtatataacaaattaaagttattcataatatatcgtaataaaagtttgtaataaaataaaataataattatataattttagtaagataattgaaaatagcgtaactgtatcattcgtgttagaataaacagaggaggtactcctaattcctttcactggagaccaaactacatcatcgactcatggcgtcgtaccacagaagcactagctgctggcaaagccgtagatcagtgggacgtggcggaagccaagccgtcggatcatcccagcgaggaaaccacccgcgaccgcgacgacgcaacagcaggaaaacccaaaaccggtcggactccacagcgacccctccgccacgaagcagcacgcaccaaaaaaagaagaagaagcgaagcgggggcgaattgaggcccaaatacttgggtggggtggagggccgagcgcgagagatttcggagagcagcgcgaatcccccaaaaatccacccccaaatcccaattccaaatccgacctccctcctcggccagatctcgccccctctccccggggggcctccgatcgaatcggcggctgcaccgcggccggcgattcccgggaggaggaggaggaggaggagtaggaggaggggatctcgccgagatttggattgggtttggtggttgggtgggagggagggagctggggggtgtggccagccatggcgtcggcgcaggtgtcgtcgtcctccgccgccgccggtgcggcgtcgtcgtcgtcctcgcggaagaaggatctccacgcggggaagaagctggtatgtctgttgcttgcgatagacgtagtcgttggttacccgatgttggtagtttaaccttctggaaatgctggatctttttgtccagacacgtttgattgaatagggagcattgaccgctttgcgttagagatgtagttccatcgatcgttttgcttatggtagagaagtcaaatgcgcgcaaattacccccgtcatcagcacgctcagtttgaaatgttgaattttcgttacctagatcttgctatttcatcaactgatcctgagtgatgatttgatgcgaaattaagttcaagttggttgtagaataatgatgtcgtgttttctgatatatccagctggcggagtaccgtaagaagaagaacaaggcggcgaagaaggctgctgaaactgcagaccaggcaacggcgcctgttcctgatacactagagaaccctcctccaaatgccaccagtactaactcgggagacaagttggtatcggacgtggatgtgaacacaacaagcacatcatctgtgccaccagtctacgagaatggcccaacgagttattccagaggtgacgagcccttgtcaaatggacctgcccctgtaaatgtgccagtcagtgttagtaatcctgccccatcgcatgatgtcagtagtgttggagggagcaagatttatgggaacttgagcttctctgacttagttaatgggcataatgaggattggagaggcgatgctgctcggaaaagggaggaacatagtcctgacaaggacgtgactttaaaatctaaattgagtgcctttggaaactcagatgaggtctcccattcttcagatgaggtcttgctgagtcagggaagaaatccagtcttgagggaagtaagtgacactgagcagtctagttcatattcatctggcagcctttttggaaagttagaaggcacgcaaagtcagggttactctgcaaacaatgatatctttggtcggttccgaggtatatccaagccctttttcatattaaattatgctatctgatgagtgatgataacttgaatatgtggcacttttaactctttacttttgctgctatgcagccacctctaaagactcttcccaagcagatggcttagcgtatgccagcagccgggagtatggaagtgccttcaataattcttggaatacatcaaattccacacctgtttgttttgataaacaggatccttttatgtcatctggttatccaactacatacaatcgatctcggccatcttttcttgattctattggagtacaaagagctccaacaactgaagtcccatacgtggagcctgcaaaggctagtaaaccatttggcaactcgaattctgagagttcattttttcagccaccaaatcaacaatccgctggaagcaatgatgtggatggttctctaaaatcaggaagacaagaatataacatcgagaagggatcatatggaaattccattcgtactgattcctttccttccaaagatgaacggaatctgcaccatagtactcaaatgttccaaaacttcacaattcctgggaaagatgatgattttgctgcactagagcaggtgatgagtgctcgatctatgttttcattgtctgtgctttcttgaggatatataatattttatatgtatgtcaggaatgacctagtaaaattggacattggacatgatattgagagctgtgcatttattaacaaaatctaaacgcttatttatgtttgtttgaattgatgacgcttacacctgaatgctattgtacacaaaacaaaagtttagctgaagttatgtctgtactagccatatgtccaaaagataattttaaaaagtatatgcttcataatatgtaacaacttgtttgactgcgtgctgcgtatagttactgttctgcgtggtgcagcttctgggtctatattctagacagaacgtccaaatcttgtgatggacgtgccatattctactaaattaacagccttatccttgattatatatttttacttctcctgaattgcatgtactttttgttatttacgagtatccgcatcctactcatgtctgctctggtttggctgttagctcattgaggatttgacaaaagagaagttcgccttacaacgtactcttgagaaatctcaagaattggctcaaactttggccacagacaactcagctttgactgataagttcaaccaacaggtatttccaaatctccattttggtttttggagttggatctagtatcctcacaaacttttgccatttattatgcaagtccacaacagaaaaacactttcttcacaattaataaaccagtttctgctataacgtagtatttcaatgtcaaagtttcattctgcccgtttctctgtctttccttgttgctctgccttattcacggtgaatgatattcaactagcataacatgcttgcaaaagtgtctctagcaactagaaaatgctaaatgagaatggaatagctaagcaatcacccaaaatttaccttacagtcaatacttcttatctgatcagtaaatcatcaattcttttacagcattggtataaggacagaatcaatactgattagtcatatttccagtcacttattgtcttgtgtatcatatttattattttgtttgcaaatgcttaggcacaagttatcagcaacctgacatctgacatggagagattgcagaacgaaattcaagctcaactggttaggcttattccaccttttctagcaatcattaagattctgtaattccatgcttgctatgctgacatgcttttgttctgttggttttttagtagtactatcgctgtgtaatttggaaatataatgtgctagttgcaagacatatgttagcatagaatatgacttatgaaatgtagaatgtctccggatatgaggagctagggaatgagttcataagatcacatggttcactatgtacccagcatgcacaatatgtttagattttggtgtttgactaggcaactggctgaagtatggcgctgaactattgcttgctaaatgcctaattcatatgaaagtatctccactaaatgtttaggttacttagtgtacatttgacttactgatgtttctggtagttagcatcatctgtgcactcagtgctagtatctatcaatatgaaacttatgatttagggccagtttgaatgtgcatattgcctgagcttacttaggggcacgcaacacagaacatgttatcagtgcattattaattaagtattaactattataaacttgaaaaatggattttttgaagaaacttcatatactttttttttttgcataaaacacaccatttagcagttcggaaaatgtgactaacaaaaaacgaggaagttgtagtttggagttgaagttttctcataatttgtatagttttcttaccaactccaatttttcaacagctggcacttgagtctgtcagaacggaatatgctaatgcccagctagaatgcaatgctgcagatgagagggccaaagttcttgcagcagaagtcattctacttgaagataaggtgcttagctatatactcgtctgcttcctctctaatgttgcaaatcaacctaaccttcttagtgggataataatattgacactgtttatagtttttgaatgctcattattttgagcaatgtttttttggagtatgttattatactataccttgagtacattaagccctagaggtgtcacaggctcacagcaacaaatcaaagtataatgacagatatcctatacacctgcaggtaggtaatgcctattatattcaagttttaatgcatcagatgtaaatatataatatcccttgatatgccaaacatgcagctgctgtttttttatctaacacttctctttaaggcactatttatcaaaagcgcatgcagtttgatatatcgctattttttaggctcttagactgaggtcaagtgagttaaagcttgaaaaggaaattgagggtttgagctctgagatttcttcatacaggtgaggttttctgctatgagtgcatggtatgtgttttacaaggtggggagatcaattgataagtgaaatgggcttcaaatataaatgtgaaagaaagtttctggtttttctcacattggcattcttgaaattgttatgcgaaaaaaatatgtgagtcttgtgttaacatgcaaaaaacatgacatgagtttaagtttactgaactcacacactgatcatccgagggtactgacagtgtttcctttacgattttcttttactatgcacaggcgcaaagtttctagtctagagaaggagcgtcaacatcttcaatctactgttgaggctcttcaagaaggtagttaccgttttactctgatgtaaaacttttttgaactcgttctttatcccatgcccaactcaattatctggtgagtcctagaaaatcattagttgtgttcacatcttgcacgcacatttttgttccctattatttaagccccatactcacacatcctttagtgtcacttatttttggctgtcaaataactaaaactaaactagaaatttatctgtaatattctagttggaataagacttgcatgtgtgtgatagacttaatttatgcatgaatattgccggttgtaaacttgacttcacattgatacttttggacagaaaagaaactcctacactctaaattgaggaatacttctgtgactgagaaggtcaatattatagaaaaaccttcagctgataaaagagatgcatcaactgcaacagaagatctaggtatgaatgttgatctccccttttgtttgatatctatgaatatgtatttcaattttcaactagtagtctgcttgacacgaaatatgcatcttcagatacaggggaaagcagctcttcagaaacccttaccagtgccattgacacagtagaagatggtgaaacatctgtatcgcggtccaataatgtggctgattttacttatttagaagaggtgtcttctagcatcccacatgatcagcttagaatgatcgacaatatcaactccttgatgtcagaggtaatctctttgatgtgcaaaaatccagtgtggttggtactttatatcacttacattgatcgattgcacctaaataaccttaaaccacagcacttgagtttcatagcctacaaaatttacttccttgttaatagtaattgttgcattgcagttggcagtggagcgagaagagttgctgcgagctttgagaattgaatcatccaattgctccaagctgaaggttttgttcatttcgcagcaactttgtttctactatttttgattcattgagcctatatttcttcctgtccagagcttcgatcgacccaatataaatgcgatgcatgtataattaagcactaagcctctagggtatacaaatgcctagggtcttgtatagttgcccaagggactatcccagctggcttaacctaccgggccctttcctccggatgaaatcatgtccaaatcgagggctattgtgtactgtaactttgtcatggtgtatctatcttatgcagtccattctttgtcttaaaggaattgaacaaggatctaacgcaaaagctggagattcagactcacagacttgagctgttatcttctcaaaggatggctaacgagaatgtccttccaaagccgatcgacacacgctccatcaatgatgcaactttgtatgctgatgaaggagatgaggtaatttagtttctgttatctaagcatctaacagcaaaactcacagatcacataaaagaacatctctttttcattattgttataaagccttttcatgtgttgacagcttgattttttttaaaggttacaacttatctgatgtaacatatttgattgcctttctccattagatcattgttatgattgtctgacgaaaaatatatacaggttgttgaacgggtgcttggatggataatgaagctcttccctggtggtccaaagcgacgaaccagcaagctcctctagtggaaagtagagttttggtataccataatgttttcttttcatttatatatgatatttttttgccctgttttggtgatagcatgatgagaagttgtatattggaggagagccccttgatgtaaccattcttttttctacagaaaatgaaatgtatggtttgacttctgtggagctacacttttgtattggcaatgaacagaatagctgccagcaggaaaaatacgcccccttatatattccataattatacgtggggtggaggtgtatgttgtaattgctgtatccatttgttatttcattcacttgttatccctagctctactatctccctcgttcattttctcttctgttatttgctgcaacttgtcatccgatttcctatattgctctggctactggttacaccggaagtggaagtgtggaacacacataaggaaaattatggtcctaaatcctaatccatatttatcgttactctaattttcctatggaaccttgaacaccatagcgctctctctctctctctctggtaattgtgccttgtagtttgaagactcgttatcaatgcagtgaaaattgtggatgcgatttatacacttctactcctagcaatccgaagccaaggctaaatgacaataacaatagaaaagactcaaaattatttataaaatgaagttctcaaattataagccgtgtcacaaagaagcaggcctgacatcctgtgtagtacactataatccacttttcagccatgcagcttgtgaagtacagaaatggacaaatcaaacttgcgattcttcggtcgactaaaagactttcctgttctctaaaagaatgcgaaagtcgatttttatccgcatgggatagtatgatctgaccaacgaatagactaaaatataacaagaaataatatatgatgactatttcttgttatgggtaggaacgcttagatagaacttggtgttcctgaaatcatcaaggagtggattatatccatctttggtcctagtcttcaacggcagtccaaactcttccatgaaggcagcagaatcaagctaacgatagttgacaaataacatcatactcgtcagtgcaccgaagtttgtaaaagatgtgatgcaagatgaactaggacactaggttgcatagaaaacaaaactggcttaaatagtctgaacttacaatgatggttctcctcgtcttaactggtttaaatgcaccggggttcttttgctgttttgagaaaccagagcagtcatggtcgatcttctccaaaagccagaaatcggttgggaagaaaatatctgcgtcaccctggcaagtaacataaccgagttcttttaataatatataataacacatagcacaacaacttaattaaacacatagcataacaacttaattgctcaaagttatttagttctttttccccatggggttggacagtagggtcaactaagctacgacatgtttgcaacgaatctaatattcagatataacagaacagaaacattattcaaacctgagcctcaagatagttgcgatgatccaaagtcctcccgtccttctgcaagcaggacacaacatcaacgaggtgtcctagagaaattgccttgttggaaaaacgcaccaaaagtcagtgaaggtcttgtcacctttgaagaaaccaatggagctctatcgccaggtatactgacatcaggaagatagctgaaatctgaagctataagggacatgcttgccaaagcttgatgtaaagtatctagtattttctgcatatgtcataacacatatttcagagattctggcagtaagctgacaaactcatcagcatatgatcacatatagaataacagtttataacctacaaagtgaaagtgggttcaaaagacataccaagcatccagttggtaaccaagctctccgaggctttgggaatacttttgacacaactccttttgcagcaagtgataatttgtctctcacagacactttctcttcatttatgccagtaatctcgacacagcgggaaactagtgggtcttgtaatggtttgtatacctcagagccttgtgaactatttttcataaaaggcaaccatacaaatttaatgaagtctgtcctcattagttaccaggcaatatcaatcaatacaactgtccagattccagaagcacaagggcgatcgactatgttatactagaggggtaaggaatcagcccttcaacaataatatatcgaaaatgataaatttatctaacaagaatctagtaaaagaccagcatgagagcactataaaacaagcagaaccttcccttaatcttctgttgaagaatataccttttttcctttccaaaatataaagtatgtatactaagaataaacttatcttatgtagcactgtgcttatatatgttacaaatacaatacagtaatatatagaaaagaaatcataagatcaatagatcattagccacgaggtaacagaagagaattcagtaaaagaatttcactacagactgtcagacttccatcattttttttttacccacaagaagcataagttcattcatttcatcaaattattccaaagtccagatcatttcattgaacttgcctaaagccgcacataaataatcggtataagagcaaaaaagatactttcatatattgtctgaagcatacactctcaggaatcagaaaaaggaaaacacaaacctgccatttactttttcaatccatacttccatccatggagagacctgatctggcgaatagacaaggtcatgtggtagattgtcaagtacctgacaatacaccaaatgaatgttgctgttgaggctgctgccatcatgtctctaagatatgattgcgaagctaagaagtccatatgataatctaattcttcacttagcaaacaaaatgatactagcaaccagtgtttccctacttgccatcatcagtcagtccacactactggcatggtcatacaatggttaataagtgatggttggtagaatgtctaaagaggatcctatatctggttgttatggcaatagtgagggtacgtaaaggaacagcgcccaacgttgatacagtgttttgtttgcaatatcattggcaaagagagagtaatcaagagtttatgtctgctataactttataacctactcttacatatcctttgaaacacaaaataacacacagataaactcgacactgaaaaaaggtatatttgcagtattcacatcttgaaagcctaaataacatttgaggtgctgctacacattctgccaagctactaagttagtgcaaaccagccagaggactgcagctaagcgtcaattaataacaggaaaggtggactgtaatgatggtatattgcttctttgattcatatgagacatcaaagaaacaaccgagcagatagtcaaggcagtacctcaagcattaacacccaacaaggttgaggatccttgcggcctgtaaaatatgacaggaaagtaacccaaagtggtcaaggaataaaagtgcaacaatataaagatcagaagataaaatccgatataagtgtgatttgacatggagggattagtgggaagtctgtgtaagtgtaacccacacattttagactgagcctatcagcactacatcaaaatatggtgtaatagcattagctgaaaatttgcaagctgaattatcaaagttcatacattattttttaaatagaatgcattttagagtagattgccctacagaggagcagggacaagaagtcagcttaccccatccagctctgtcagttgcgtcacgacactcaaccatgaactttgacaaatggcttcgcacctcaccaacagtttccaattgcttctcagctagagaggaactaatttctactgagctagcaaattaagataaaagcaaggtcaaagcatattcgatcacataacagagatcataaagtgaaggaaggtttccttacatgtatttcatagtattgtatactttcggtggagcatttaacatcatgtagtcaagtatgcattttgcacatgtgccagaaccaccaccaatttcgtaaatctgatccatgcaggggaaaattcatatggtttggtgaaaaagaaaacagatgactatgtgccataatattataaggtaccttttctccaaaaaaaaaatttggcatgagaactgcagtaatattactagttgagaaggaatgaaaaaaagaaaaggaaaatggtgcagtagcacagccatcatttattaaatcatatgtgagcggttatggcgcttgtaagagcaaatgggtggatggaggtctagaactatgctgaggaggaagttaagaatgcaccttcagtgggactgaaagatttgctgtacggaggattgatgcagctattgcataggcataccatggctgcaccagagaaagaccacgcatcaagggtcaaactgacagaaaaatgacactacatgctattgaacagcttaagaaaacaccttgaagagctccactggagtgaaccaagcgatgtcatgcttcttgtacaacttatcaaggtactgcatatacgcactcctacctacataagcaaattacttccgtttctagtcaaatatccaagatattaaaacagcacaacacagaatcgtaattggcaaacaatcaatggagttcaacagtcgtggaagaaaaacagaagtcccaaatttctgcatgagaggaacagtggcacgcgcaacgtgttcgtcgaaatgccacctcggcaaacaaatgttagaaccggcctaatctgattcccgcaatgccggaacacacacaccaaactcccacatccaaatccggtccaagcaatagaatgatccaagaagcaggtagaaaggaggattaccgtcgagctggttgaagcggatgctggagtcgagcacgcccacgggtcccgaccgcttggagaagtagccatggttggggtcgtacagcgccgacctcacgaagtcacgcacctgcgcgcacgaagctcccaccaaatcatcacccgctacaaggagatctcactgcgcccctcccagcccgcgaaacctccgccccgagcgcttaccaggatgggcttgttctcggggacgatccccgacgagaacatcgccgccggataccaccgcgccagcgtcgccgctcgccggagcgccgccgggacggacgccatgtgcggcggcgccatgggggagtcggggagtgagtcgctgcggcggcggcggcggcaatgcccacgcggttccgggccttttccccgaaagaaaagaaagggaagtccgattcgtgttcgggcccaagcccaacacgagtccgagtcggagtcgtgggctgcttgggccgtacggcccgcggcctatttaagtcgcgcgagaggagacgcatctcctcgcgcacgcgcacgctcgagaaattgagagattcattcaattcgaagggcgggagagaaggaaggggagagatgatgatgacatcagcgatgccgccgggcggcggcggcggcggcggggaggctcctactccggtcaccggcgtcgccggcgacccccgccatgagcagcgcatgaggctggtgaggaaggcgagcgagctcgcgacgcggtgcgccgtccccgtcgccttgtccggcccggccatcggcggcgtgtgcgagccgctgcgctggccgtcgatggacaaggcacgggatatcaacaatcggtacaaagcgctgccggagaacggtcggaggaagatctccgtgggcgacgccgccgacatcgcgaaccaagccgcgacgcagcagccgcagggcgtccccgccggcggcgagtcggccagcgcggcgggggtggccgctgccttcggcgccatgaccgaagaggagctccgggagcttctccgatccatcgactgctccctggcggccgcgagccacgcgatccagaaggccgccgacgaggccgaacagaagctctcgctccagcgcgcgggcacgctcatggcggtggactcctcctcccaggacgccgtgccgccacatgccgcgcccatggacatgggagacgaggtgcagggcgcgcagccaccaccggatcggtggttcgaagaggaacgagagccggtaatttgctccaaaaagaaaccagagccgtgctccgccccgccgccgccgccgccgccggcgaaccggaacggcgtcgcctacgaggccgaacaaaggcgcgcgtgcgcgctcatggtggactcccaggaggatgccgcgccgccgccgccgccgccggcgagcgggaatggcgtcgccgacgacggcgagtacatcaacctgggcgggtacatgatcgagcgcaaccgattcgaagcaatctggcgcgaacacgcgatccctcctccacaaagcctcctgccggagtcgttgccggacgacgacggcgagccgctgcggctgtggtcgttcgacgccggcgagagggtaatcctttgaatgtgcccgcgttgagttggcctctagactgattttgttgttgataagagtaatgctatatttactttatggccgtgtggcttgtgacagaagtaagatgtaatctattttcattaaaaaaacactttaaaaaatctgtactagtcttaattagtagttagttaggggccgtttagattgcagtcaaaataaatctaatgctaaaattttagtagtttgacaatattataaaaattgacagaatttcttatatatttactaaagttggacaagaaactaaatgtatgcacatttttaataattttaacaaaaatgatatgatttaaaatgacatcaatctaaacaacccttcagttagaaaagaatgggcttaaaatcaagaatcaatcatattttatccacatcagcttttcaagatgctttttctagacaaataacagatttttgtacgcgtataattttccttttgagaaggttttgtatctaaaacagtttcatttatgcagagctcgagaaaacagcacaaaaaaatgaaaacggctgcgaggggaagatcaaagctcactggacacctgtgttgacgacattctgtaccggctgaagggtcttcgatcgatgatttcacttagatagcagtgcagtggtctgccttttttgtgaacttgatgtttctgtaaatttctatgtgagattcagatgttgctcgatctgtagctagttcctgtcttccagctgtaactgtaactgtaacgagaattaacaggcaaaagaactttgttatggggattctttaataaagctggataactaggtgatctgttcatctanaaagtagtcgtgggactgatcgagtttgctgtttgccgccttccgacagttgaccttcatgtcgccgccgcagttgccttttgctgaaaattggatggaaaacgtgcatcgagggatgggtatttgattgatggataattggatgtcatcaaacaacaacatggataatatggagcatgctgggtggcttaccactagcttgactctaggcattgagagacaacacaaactgtcaaagattggtggaagacactagctaatacggcatgagtttgagaggtttgcgcaccctcatcctcctcatggtttgggagatatggaagaaaaggaatcaacgaatctttcagcacaaggaggctacatcatctttcctcttcgccaagatcaaggaagaggcgcggacttggacgatggcaggagcaaaacgtttgcgggaccttctgcccctccatatataatatataaagagtacaaagtttttcatttctgatccttaagagttgttttttcttccactatattcaatgaaaagtcatgatctagtgccgttttgcttaaaaaacaacatgattgtagttaatagttattactccataaagtgcactttttttaagtgtaaataagtaaataactgatggatataattggaatatcgtcgaacaacgattggccctttttttcttttcattggcgtttagatcgtttgacgtagcgacgtccggggtcgttgcgccattcgatttgcatcggacggaaaagagggagtacagcgatagaaggggctattgctcggtccgcaacaacaaaaatcaagccacgaagattgtcctgggcccatggaaacaatacgacggtagcattgattccgaggagttcctctacatccattctacaagtgcaaccgtatatatcatgtctaacctgaccgtccgtcttatttaaaaaaattatatacttttattattaaaaaatagtcacacataaagtaccattcatgttttatcatgtaataaaaaatatttatcataaaaaatttctaataaaataaatggtcaaacattggacataaacaatataaaactacactattttgggatggagggagtaccattcttaatgcaataggggcaaatgacaatgcagtagcgaattatctatcgattacgttgaactgctcatccaccttatgtcatattctcgatcaaccgagcatcgtttttatataacgggtaatattttcaaccgctactgtttttttatatataaatgttttttctaatttctttctgcatcgtactggtgtcaacactgagtagtttaaatgatgaatatgatcaattatcgaccgatcgatcattgtttttgaaaagatgctattgattctgaatgttttcgaccgttttcacctcttttaacttccataaccatgaggatactccatacaatctctactattataaaaattaaagatgtttttgtcggtactttgacacgttatccgtgtatggttcggtttttaagttcgttcgcttttggaaatacgaatctgtatttgagtcaagttttaagatcgctcgcttttgaaaatacaaaaggagtcgtataagaaatccccttaaaagaactaccatgctaacttgagatgatcgaactcttaactacacatcatgattttctagaaatatatatatatccaagtaaattcccaccatgaatttcaccttaactaaaccatacaacaataataatattaaaatagccttcgtccgttgtaacatacgggcattttttaccgttattttcagggtagttataaaaggcacacggtcgaggacgatcttcacgggttcccgaacttccaaaaaaaaggggcaattacttatttgaccctgttttgaactgtaattgatgatttggccctactttttgaactttgcttatttgaccctccttttcgagtacgaagctccggtctgaccctattccgtttgggtgaggtgacggtgttaattttggggtaaatagtctattttgcccttgcttatttgacactgttatatcccttttgtttgcttgtttgaccctattttgttataccgtgtatatattcaacaatgttgaaatatttgtaataatttttgctcaagtaacagatttggcattaatttgacagatttgaatcattttgtgaaatttgacttaaatttgacagaattttgtgaaagtgaaaataaattaaataaaatgtgccccaattatgacagatttggcataaatttgagaaatttgattcattttgaaagatttgactaaaaattgtcaaatttgaggcaattatgatagattttgttaaaaaaaaatcgaacagcatcgacgccatcgacctcgctctctcggcagtcggcatgacagtggcgaacggcgcgcacggcggtgcggccgacggtgagcgggggcgggcggtgcggacgaggcggagaggcaagcggccggcggtggagaggcgggcgaggcgagctgcggcggacgagacgggcgaggcgagcagcggtgganaggtg

SEQ ID NO: 14255 - DNA, 80452 bp, Oryza sativa
  unsure (1)..(80452): unsure at all n locations
atacatttgtcgacaaatttttctccaaaaatttgacaaatgtaattacagtataattgtagtgtaattacactgtaacttgtatgtaattacagtacaattgtagtgtaattacactgtaacttgtatgtaattacactgtacctatagtgtaacttgtatgtaactttcaaaaatctctccgtaacatgttatttcggtaaaatggaggtcgtgggaacaaattctttcatatatgtgtgtgctatgatttgttttcttcctcaccaaaacaaatcgtgtaatagatctaacgattcaaaattatgtgacacttacatataagttacactgtagttacatgtaagttacagtgtagttacatataagttatagtgtaattacactacgattatattataattacatctgtcaattttttggtgaaaattttgtcgacaaatgtataggcagtccctttgaagacagatttaaacctcattagcacaagcattaataattataagcttgaaactaacaaaaaaaaatgaggaagttgaagtttggggttagaactgagccatagtcgcacaggcaagggtgagcctggagccgagtacagggcgccgtctgatccatatacgtgatctgcaacaaaatccaatgcggactcagattttcgccgatacgaagtccgaatcggactgggataatgcgcacgtactaccacataaaatccacccgtcgtctcctcgccatcgagatcgatcgactcccgtcttcagcgatgtctcgccggaagacatccatagccctcatcgcgaacccgcagacgcgcgctacgacctacaagaagcggaaggcggggctgatcaagaaggccggggagctcgccacgctgtgcgacatccccgtcgccgtcgtgtgcgccgggcccgacggcggcgcgccgaccgtgtgggtgtcgccggagggcggcgacgccatcgagaggtaccgcgcgctgccggcggagaagcgggcgaggcacacgcacgtggcttacctccaggaggagctcgacaaggagagggccaagctcgccaggctgcggcagaagggccgccccggcgagctcgacccgccggacgccgtgctggacgggatgtcccaggacgagctgcagcagctgctcgcgtccatcgacgccacgctgctggctacggccaagaggcgggaggcgctcgggttgctgcccggcgccgacgacgacgcggacggcggcggccggcggcgcgacgccgacgtcgccggaaccaactccgtcggcgtacacggctaccagcaccaggaggtgcatgcaccggcgacatgtgaccccttccatccgtacaacgccggcgtgacgctgatgcagccagggtacaacaacgcccagtacatgggcggccatggcgccgtggacatgagcggctaccagctgcagatgcagatgccgggcaatggcagcaacaaccacagccggctcgcgtggggaggcttccagccatgcaacgccaccttcgtccagcccgtgtacggcaacctccaatgctggtacaacaatgtcgtcgacggcaacggcgagccctgcgacgccatcgtgccatcagctggtgacccctacatggacatcgccggcaacgacgtctacggcaaccagatgcagccggcaccggcggccaacggcgggtggcacgatccgggcacgtggggctacgacggcggcgagccgtgcaaagccatcgtgccatcatttggtgacccctacatgggcattggcgtctacggcaaccaaatgcagccggcgccggcggcggcggccaacggctgctggcacaatccggccggcacatggggcaacgacggcgagccgtgcaacgccatcgtgccatcagctggtcacccctacatcgacatcgagtgcgacatcgacggcaactacatcgacacaaccgtgttcgattaccaaaccaccagcaccagcgacaacttcatggacgcgcccgtccagttcatcgccacgggcagtgacgagagcatcgtcacgaacgtggccggctgcgacgagacggagttctccattgacgatctcctccagtgctccgacgcctcccagcattcttccggcctcgaggagctgcattatctcagtgatctggccgatggcttcgactttggatgcaacttcgacgtgctattggactgagtgatctgcagtaaggtctagagtagccgtcgcaatacggtgaaacccggcaattttggacgctggatggccgccggattcaactgatgttgccaccgccgccgccaagttcccgagcaattttcctggccaacaagcgagggacatggggctatctatctataggtttgatgcaaggaaaagaccttgttgttttggaaacccggcagttcagctcggagaagacctagcagttctgtcagaccggcagctctgcttggagaagatccagcaattttgtagctctgcttcgatgacccgataatattgtaggttagattggattgatccagcagttttagtagtctggagaagatccggcaattttgtaaactctgcttggttgatccatcagatatgtagccacctggcaattttgtacctctgccttgatgtaatcctggcaattttgtaatgtacaaaataccacatgctaattttattgttaatttaactcgtatcttgtggcaacaatataatcaaccttcaatatggttttatacatcacattgacaagttaatgctctgtttaacgtctaagcagtggactcaaaactcataacatgtagtattaagtatagtaaataaaaacagcttactgtttttcctcatcgcaaccattattaagactaaagtagatttaagatatattgttactacatgcagaaataattagcttacagatattccttttggaactgcataaataacaggatgataaaaatgttacttcacttacatacaaaagaggctaattctgtacgctcaaaccagtgatgtttttgtgcttaaagaatgtacttggcccaatcccacttaatgcgtagcagcagttgtaaggccttctcctaatcctaaagctgctgaaaccaaagaagaccaaacatgaacatcaggtgtttctccatggtcgatcatctcctcaagccatagcaatgcatcatatgttctaccagcagaacataaaccttcaatgacattgttaaattcgcctgcctcaggtctatgatgacccttaaccatcctctccataatctgtgctgcgtcgatgaaccggctttctgaacacaagccgctgatcaagattgaaaatgtctctttccgagtaacacaaccaagctgtttatccatccttccaaggtatctgagtgccctcattgattgcatcgagttgcaaagtcccctcattagcaagttatatgttgtgacggtcggaatgagatcattcttgggtaattcctcctccaacaccttcacagcctcatccaacctgccttccctgcataaagaagtgatcttcgcctcatacatgtatattgttggcttgaaccccttcttgcccatctccttaaacaaattgtctgcctcattcaatcttccctcatcatagaggtcaataaccataacttcaaagcttgcaacagtacgcccacctcgaacaaccaatgcctgatcaatgatttcctgggcatcctcaatactaagcccagcaagcataggaacacggagagatcgccggctacctgaggacctcaaccctttcctaatcaccttatccaacacaatctctgcctgctcacctcggccagccgcacagagcgccaccagcaatgcccggtacaccacaacatcttcgtcgcatcccttctgcgacacgcgccacagcatggagtagagaacgtgtgtggcctcatcgagcatgccagcatcgcagagcgcaggcacgatcgcgcgataagcgtccttctctggtgcgaggcactggttagacatttcatcaagcacctgcagagcgagttcaggtctccgcgcacggcacaatccagtgatcaacgaggtgaggtcttctgacgctagagagacttccggcctccccgcgaagtccgcaaagagacgggccgcttcgggaagcaagccatcggagaggaggcggcggaggagggcggagaaggatcgtgaccaagacggggcgagggaggatgggagggaggagcggaagacggagactgcggcagcgggagggaggtgcgggatggaggcggcgaggagggagtcggcggagggggaggacgggaggatgcggcggaggagggaggggaggagatcggaggaggatgcgaaggccgcggcgaggagcgaggagtggacggcgtcgttgtggcggtaggaggagcgcgggtagcgccgcggcgcgtcggcgtagagatggacggcgtcgagggggctcttctgccggcggatggcgccggcgaggtgcgccggagtcagcacccgcggccaccgcacaggcgtggcgaccatcgccgtcccggacttccagcaactttggagtggtcgtgcacgcgatggttttcgtgctactcggcccggcccaatctggtagctgactcgactttgctcagcccacctagtacaatattgtacacgaacttggtgggcccagttgtaatatggaccgagagcctgagtaggccttaataccgtccaaactccagagtccagtctgttaacacctccccctaatgtaaaatcgatttgaatccctggagataatatgccttccaaaaaatcaattgctttcctacaataaatctgatgactacagtttccatgaagaaaacctttctaaaacattggacgcagctaggtatcgggcgtctgactagtggcgaaaaaaaaataatcaaacgtcacatgatcaaaggaaactgtctatccattttgtcgggtgatttctctctagtgaaaaaatcacttgtaagatgtatagcaaaatcgttttagtaattgcaacgtcacaataaaatatctgttgaaatatttcactgtccggtataaaacacaatattttaaccatctaaacattttttattagaatataattacatgatattttgtactagtagagatttaattgtaacaaatagggcgctgtattcggattacatattagataagtataatttaagataaaatatcatttaaagttcgttaatgaagtcgttcgttgcatgaagaggagcgaggatatggagcgcaagagagagcatgtaacatgggaaaatacgagagagagagagagagagagagagagagagagagagagagagagagagagagagagagagagggaggaagaactcgaacgcaaaaggcccgccaaccacaatagcagccaggagccaacgatcgagcaagctgctaagatcgacgagagagcgagcgatcgatcgagcggacatcccgcgcgcgcgcgccgcggaggcgccggccgcgcgcacacttggcaccctctcccgtcccgccgcggccgcgcgtttctcctgcacgccacgaccctttcctcgccccccgcgacgcacaccacgtacttaccaccaccaccgcgcgctcgatcgatcccgcggccctccacccctcgcgcccagccgctccctccccctcacccatacatacggagcgccacccaccgcagcgcgcgatcgatcggttaatctgtaggctgctacctcgctagctccgtccgccgtcgtccgtccgcgagccaccaccaaccggccggccgcgcgcgcgcgcccatggacagtaaggacaaggagaaggagcatgagcagaccgcgtcgggcaggaaccccgacgtgaacgacgtcgaggaggaggaggaggacgaggagggcaacaagcgcgccgtcgtgctcggcccccaggtccccctcaaggagcagctcgagctcgacaaggtacgtaatataatccactgcattcctccattgttgttgatctgatgctaattgagtctgaatatagttttaacttttctgcgaatgcagcatgatgagagcctgaggaggtggaaggagcaactcctcgggcaggttgatactgaacagcttggaggtatctatctacgcttgtttccaattcatcattatatatgcttctcgcctgaattcgttgacacattcttgatgtgcgatctgtaacgacattttgggcgtgcgcatggatatgcagagactgctgagccggaggtgaaggtgctgaacctgaccatcctgtcgccggataggccggaccttgtactgccgatcccgttcgtccccgacgagaagggctacgccttcgcgctcaaggacgggagcacttacagcttccgcttcagcttcatcgtctccaacaacatcgtgtcaggcctcaagtacaccaacactgtctggaagactggagtaagaggtgacacacaacgcacgacttgaacctgcgtattttattttgtagatcagataaaatggcgcttgaatttctagaaacaacggcacaaattgatcgttccattaaatttcccatatgatcttcatgtatgtgctgcaatctcttcataaatataacgacgacatgccattttagatactgatcttagatcattaggtcattttattcgaggattttcctacattcttcagtaaagaaatatgttaattaagagaaatttaattatgcatttaaggtattcttttatctatggaacaatgaactccaataatgtcatatgatgtgtcatatatgtgcattctgacttgcagttgagaaccagaaggtgatgctggggacattcagtccccagctagagccctacacatatgagggtgaagaggagaccaccccagctggcatgttcgcaagaggttcctattctgctaaactaaaggtattcaaactcatcaagttcagctctgatgtgttaatcgaggtaattaccttactaaccatggctgtaattttttctgttaaatcagtttgttgatgatgatggcaaatgctacttggagatgagttactactttgagattaggaaggagtggccaaccatccaatgatgtgtggaactaaaaaagggcttcagaaacatgttagctgctagctaagccaagtcagatgcgctgttgcttctagaaatgattcaatgtgtcgtcatcgttaaacgccttttaatttgttttgagcttgtcacactttcttttttctctttttcttcctgttcttcggtcgcataatgtttattcaaacctatataatcgattctctatacatggagacgcgctgatatatatttatgtactactgaattctgttgtttacttgtttgcctgaaacacaccagctgatcaattcctttgagctaatgattaattgtcctagacatgcactttcagatcgaattcgttgcttaattctgaatgtctcggtggttacagtgcagtggtggtagctgagttttcctttgacgaaatgatgaatgattctgcctgtcaagtcaagatttttgcgtgtgatttaagatggtttttgcacctggcattgctctcggcctctcactctggtctgctactgagtatagggtaattagtgcattaggtgcaggaacgccgttttcttgagatggatgaaagcaagcttaggaagagtgacataacagctaatgctcgttacagagaagcaacgcatctctgctacctggaggctactgtactgccggtggcaaagcaccgtacgtacagtataaactgaaagttgcgtgtcacctggtagggctagcttctagccttctactactccagttcttttgttgcagtatgtgatccttgttctttcgttgccttggatatcagccagtgtatttccgcatacgatgaattaattagcaagattgctttactcaagccgtcaagcgtccctgtgtccgtgattgttttccgtactaatttgtactccctcagttttattttatattataagttgttttgaatttttcttggtcaaactattttttaagttagatcagtatcatagaaaaatttagcaatatctaaaacaattaattttattgaatttaacattgaatatattttatatgattatgattttgttgctacaaacattgtaatatatgataaatttagagttaaaaattaattttggaaaccgtgctaaatttgaccgtgtctaattgaatgcgggggagggagtaatatgcttattttgtgttggaaatactactatatttttctataaatttacttttaactaaaaaaatcaaaacgacttataatataaaataaatagattagaatatcaaatcatattgtccaaatagaactttgtcaaacaatccacctaaaaattgcatcattcacagttttagaaatatcatatccgaatcatgcgctatagcatataactatattatatgccactccaatttggtccaatcttccgaatgtacatctagagtaggatatgtgtgtgtctttatagggtgagtctgtgtctgcttgctgctgccctgttgggcttcttttgggctatgatctacgggccggataggcataatgaggatagcagggaaaaagtatactttgactccctcaagtatggcccgagtatgattcatgaccttcaaccacaaaactgggtatatggactctaactatcaaaaccgatacaaactatatcttttggtggttttggaagcggttttggttcaagtggtgcctacgtggcggtgttgacccggtctttgtcccacgtgtgtcgacgtgtcgcttatgttgtattagaataaaaaactaaaagcaaaaaaatatgtgggacctatatgtcattcacaaataaatattatgggacacagtgacatatgtaccccacatgtcatcatatctctcattcccatcttcccccttctcgctctccttatcgttacgtcaccctacactgggatgacgctccccattgtcacctccgtagacgatgaagtggccacggcgggggtcgacgtcgtcaacgctgagtcgtctctgctgccggtggaatcgccgaatgacggcttgaggacgagcaagaagggacggcaaggccggagccaagaaaaatagagaggaaaagtggcaagttgggcgcgtaagagatgcggagggaggggaatgttggtgtggcggtggcgagcaaggaacggaggtcggcggggtcacccccggtgaggaaggcaacaacggcctccaccgccatcactccggcaccctcatgtccaccgccgacggtcgtcgccgcccgtcgccgctctagtcctcgctcgccctcccgcccgccactgccactcctgctcccgcccaccgctgccagcgtctcgttgcagaacgggtacccccttgctcgccgccgcaggaagaggaagaggaggaagaggggggaggaagaggaaggagagagaagagaggagaggaagaagggaaggaggaagaggacatgtgtcccactttttttttgtatgaatgatatgtcggtcccacatatattttttactctaatgccacataagcgacacatgagacgaaaacagggtcaacaccgccatataggcgccacgtcagccaaaaccgcttccaaaaccactcaaggatatagtttgcattggatttgatagttgaaggagtcgatatacctggttttatggttggaggtcatgaatcatactcgtgtcatagttgagggagtcaaagtatactttttccggatagcagccaaggtctgctaggattcttggtgggcttcgaaacttgagtcctcggggctcaggctatagcccacgcagccttgaggcctctttcctctcccgaccctgacgtggttcactttgagtatcgcggcgccgccgtgctcgcgattaacccaaccgtcgcagctgcagtctccgccgccgccatggcggctcgtgcgctgctctcccgcctccgcttcgctcctctcagccaccaccaccaccggcacctcggccgcgctctctacggcggcgccaccgtcgatccaccacccgacgaggtggcccctcctcctccgcatcctacaccgacaccgacgccgccctccaactcgaagctcttcgtcgccggtaaagcctctgctctcccgcctccgtttccttccccgcaatccaatccccactctgttccatggttctcaccttgttgctttgctacgctttctctctcgcgcgattgcgcgcgcgggcgtagggttgtcgtggtccgcggacgagcggtcgctgacggacgccttctcctccttcggcaccgtcaccgaaggtaatccccgaatcgcgaccttttgtcacttgaaacagtttcgtttcagggtctagagaataacctattgagtggttgtcggtgggggactgggggagggttcagatggtgtgcgcggtaggtgttcgatgaaacggctcggaggaggaagtgggtgttccgctcgcgcgcgacctcgccaaatgttcgatgaaatgcctgttagggatttggtcgcatgctcggctgcaatctaccggcatgcgaagagcgggttgtttggcgaggctgtcaggctgtttgttggtatgatgagggtgggggtgagccccaactcgttcacattggttggtgctttaatagcagctgctgggatgggcaacttggtgcttgctgagtgcatccatgggtgggctatgaagagcctgttggaatccaatccttttgttcggaccgcattgcttgattcctatgcgaaatgtggacgtcctacgaaggcctgggcattgtttggtgaaatgagggatcctggtatagttacttggaatgcattgatttctggtctagtgcacaacgatctgtttgaggaagcattgctggttttcaagaggttgctgttttcatttggaccagttcataatgttgtgactatgattagcattgctcaggcttctgctggttgtggtgaccttggattgtgtgagagtgcacatgcttattcagtcaagattgggcttgattcagatgtctcagtgacaaactcaatcttgggtatgtacttgagctttggtagtcttgcgattggaagagagattttcaaaaagatcgctgttaatgatgttgtttcttggacgatgatgatgggtttccttcttgaggaagcccaggctattgaagttatacatatgtttgttcagatgaggttgagtggcatagtgcctgatagggtagcattggttacagtggcgcaagcttgtgcacatctgggtgatggaaggataggaaagttggttcataacgagattgtaatctgtgggttcagtggtgagcttcctgcagttaactcgttaatcacaatgtattctaaatgtgaggatttaagttctgcaagactgttgtttgatggtacaatggagaaaagcttggtttcatggacggcaatggtgtcagcgtatatagaaaatggatatgccctagaagggatgtatctctttgcgaagatgaggcatgaaggttcctttatgattgattctgtgacactggtcaccttattgcttgcttgctatgaggttgctaagtttgaactatgtattcaacttcatgcatattgttacaaatcgggtttgtgtctgtacaaacctgttcttaataccctcattgcagtttatggtaagtgtggatatgcgactttagcgcataaagtgtttgatgagatgatttctcggaatgctgtctcatggaatactatgattttatcctatggtgtaaatggccaaggagagaaagcagtatcacttttcaatgaaatggagaaatctagcgaggatcaagacagtgtgacttatttgaacacattgctagcatgtagccactctggactggtggatgatgggatgctcgtctttagaagaatggttaatgacaagggaataattccatgcccagagcatgtcggatgcatagttgatatgttggcaagagctggccgcttggaggaagcagcaggagtggctagcttgactcacaataaattaggagcaaatgcttggaaggctttgatgggaggagggcatttgcatggtgacatgaaatttactaaagttgctgcaaagaaggtgctcaccacggaatcatttgattatgggcatgttgtgttactttctaatgcttatgcatcatctggcaaatatagagctgctgaatctgtcagatcctgttatgcaaagcgaattacaaggaaaactttagggcttagttccattgagatagtgccgtacagcagaagatagtagaacaactcttacctagggaagagagaagatacatcaaacaattagtattcactgtctgtctgtctcaagctattggaatctatctcaggcataagttgagtattcactttcaggttgccaagtctcctgtggaaaaagtaaagcatcaagcatgattttcaaatgcaagttgatgaaatagatgattgccttggacctttttctttaaaagaaaaatatgccttggtctatggaacatgaccaacgatatcacatctcaactcactattgctccaggaatctctaacacgtgaatatggattctaatggtactgacacactaaggtctaaggcagcttgtttagtgcatactcatttttcattacttcctttttttcatttgtctttttttttcctttttaaaagttgccttggagtttttacggtgatcctccatctgaccttatgccctcatctggattgtgcatgttgactttcctacatgctaggacaacaacatactattgatagtaaaaagaattggtgatagagcctgtaaataccagctgtggcagtttttttttttaaaaaaaaatgagcagtatattggggctgctgggtgtgcacctctacatatgtgcaagtgttgctttgcacttccatttcatttggcagcctggcagtccctattaatcagccactttaaaatttatcttggatgtttgttcaaggatctagtagcgttgtcccacttttctgccttaaaggtgttaacgtttcatgctcccaccaacagatatagttcacaaatgttgacactcgatagataatcatagaggaaagctatatttgtttcatgacatatatatctaccaagtactaacacttctcttcaatcaatgaacatttgtctgctctgtaagtctaaattatcccacatatttgtatagatgctgccattcatgtcttttcatgcgtatgccccagtgtcaatggctattgcttctgtttgaagcaggttcatatgtggcgtgattatttatcacctatcatatagttttattctgaaagatgacatctcaatatgcatatgccatggaattatctggtggaggcatattggtgtttgcctggtataagatgtgtgtggcaacatgtgttttgctattgtttattctatttaccccacaaattgcaatgcttaatcccttccttacatattcattacgctggtattagtgaacagaattatatgaagactatttgatgatgcagtgagaataatgtatgacaaaaactctggaaggtcaagaggttttgggtttgtgcacttctcaaacgagtatgaagctaagtgcgccaaggatgctatggatggaaaggtactgtttgatgaagagaaatgtctaacagattgtaatattaactgtttcagtgaaaaataaacaggaaaataaacatggtctttctttttattctacaggtaatgctaggacgaccattgcggataagttttgctcttgacaaggtccgtggtgctccagttgttgttccacgactttccacggtgagtttaacgattgacatgttcattacatttctggaatgaagatttttttggtaccataaattctttattctatataaacatttctgtgatttttatcatataacattttaagcaatcaaataagatctctccacctggcatgactttttttaataaaaaaaagttacttatattagacattaagtatacgaaggatcacccacactgtgtgagaatgtgagattaccgacagcaatagttcaaagatgacacaactattaatagagctcacttttttcttattacctgataaatggctagttactgcaaatcatgttcgtaaaagcatctataagaatttcaaatattgcacattaaaggctctaatagaaaaagatggtgtatgacctgtgcttacttgtcgcataaccattatggacttgtttaagtttcataagctatcactcacactccattacttcgaatacaacaggacaggccatttaaactctttattcatgtttgctagataacatgtcacccccttgctatggtacacttgtttttgtcacatccataagatgacacagaggtctgtttgatgttacaaacattagagcctcttctaaagtgaattcgaaattggaatttgaatatgtcaccatgtccaaaagtatattccttgtgccagatcaattagactcgcagttgcactattcatttgctaggtgcatctgtgtcaatgtcgatctctgtggcttcttcttccttggtaggtattttgatggattcttcagaatggagtgacattaccttatattggtagaagtgtgagcatataagaaaataaataaggttcaggactcccataagggcaataaaatagaagtaatagtcgagtttgccaagattaatgttgtctgttaaccagcttgagtgaccatctctggtcgtgacctttctcatgatgtttgccagagcagtactcaggtagtttgctccagctatagtacagaagaacagagatcctgctagggtttgcatgttctctggaaactgcttattgtagaattctatttgtccaactgcattgaaggcctcagcaatacccattaaaacaagttggggtgcaagccacaagactgacataggcgatattcctccattcgacaaggctgagttcctcctcttacgttcgacaagtcctgctaccaccattgaaatgggagaaatggccaatcctataccctgtctctgtagaagtgtaataccactttccactccagtgaatcctctagctattggtactaaaatccggtcataaatggggatgaatagagttagggcaataagggatatggatacaacagagcctgctgggatttcaaagtgcgtcccaaagtgacagtccattgtaaatgtttgcaagattatataggtgaattgctgagccaatgcgacaaagcataagactccagaaatacaaaccggcacaattcttattaagcatttgacctcctctatttgttggacgttgcaaagctcccaagagtttcttgcagaaccatcaacatttatatcatcacccattacaattgcacccttgttcagaaacctgaggatgagtaacatgcatcaaactatgatggcatctagcatataattctttgaaagggtcagtattttgtttgatatgaccagcatgtttcttcttaactccatttaagcatgtggtgcattctatgcatttactagaggaaaaagggtgtatatttaccaacaaatatgaatttctgcattttcttgcccagcacatagatagcaatatagcatctatcagtaaatatttatgtgtgctcgtgttgataagcatacaaaatactcgtgcaagttatgatatgcatgatctatatgagtttaatattcaactgtataaaaggtatctgagtcttacaacttggtaagaggtaatgaataaaaatcactaaattcaacaacctgattaattatttggtgttgctttgctttgaaaacttacaatgttttggcaataaaatagaacaatgtcaagaacttatgtttttcaaatttcgtttttttccacatgtacatatatacatgcaacatcataatttcaaatgtgcctcgggattgatgcagatataaatttcaagaaaaccaacccatatccgattcattgtaatgttcttgcaaaaactcctgaagcacactatacgcgtaaaagtgtgtgcacatatacatatgacaatgcatttatcacttctcagtttgttggatgttctaatactttcactatgactagtcattgttttagtttttcctccactctaagttgattacatctctagctacattagttccaattctgttcatctttagtggtaacagatgtttacctgaactgggaagtaagtggcaatctgaatacgcggttgcccttggaaggagggttgtagagcatcaatccttgttggtttatatcatgaggacaaggaagcttgagatttctctttttaaatgaagccactaaaacctgggcaattccagcaaatatgcttccctctggttgtacatggacgtacaggttggtacccagaaataacatgataatggcgagaaacatgagtaatgtgggtatgccaaatcctattggccagctgacattgttctggatgtagatgatgacaatcatagataacacaagggcagcagtacttgttccatagtaccaattataatagctgtttagtccctttcgaccttcttcgtcggtcttatcaaactggtctactccaaagggcaagctacaaggccggatcgctcctccaccgataattagaaagcctagagaaaggtatagcacacttagctggagtgttgatggactgttgcagcctccgcctagtcgggttttttcatggcagatcggtggcttgagagctggaagtgatgcatacaaagtcattcccagcatcccctgttattttagcaaataaataaattaaaatgagttcatgttgatgaactacactcctgggaagagcttaaatcaacaaaaatgttggatgtgcactatatatcagtttcttgcatcagttggggcttattgtacattcttcgtttctaatgaaaaaaaagcattaagctattgctgatctttttattcgttgggtgaagccttatttgacaatgacaagtgaccttgcatttctttctgctgccaagcaggtgaaatgaaactactaagagagatggtttggtcatcatatggacataccaggaggctggcgaagcatccataggctagtgttttgaaccttcccaagtagacgtcggagatgaaggcgcctagcaatggcgcaaagttaagcgtaccgaagaatatgttggtaatattagctgcctcaatttgcccaatgttgaagcgcttcacaagatagaccgtcaaatttgctaccactccaattgtcgcaaccttttcaaatgtctcagttgctacatagatacaatcagaaaagggcatccattcagtacattataatgagcattttgatttgatccgcttgaagtacaacataattcattcgtgaatccctttttgctttgatttgaggcagggtgtatcctgtgcagggatcaccgggttagagcacccatgttgtcatgtctaaatttagacaaagaagccaagccaagccagaccaaatcaacatatacttggtctaggctcagagtctgaaaatactcttatattgaatggatattagtatatgatttacggtagtcatgtagaagtattaatgagatgattcacgaatacgagtgattaaaagagtcttccgtacgtgctaatcgaatacgaataccatggacatatacatctatgatctatatatatggcccttctcaggatgcaatttattttctatattatcaaaggaaatgaattgatctttcacatgaaactatctataaaaaggggacttcgggcatgtttaaattgtagccaaaataaaccttgccattcaatatgtgtaggtaggtgtgcgtgtgtatacatacgtgtatttgagcgttgcgtctatcttgttattttcaagcctacggtgtagccgtgcagcatttgagaggtctaaggctgcgttcgtttcttggctaaggaactcattcccttcacacgtaaaacggagtggtccattagtgcgtgattaattaagtactagttattttttttcaaaataatagatcaatatgatttttaagtaacttttgtatagaaacttttgtaaaaacgcactgtttgaaaagcgtgtacacgaaatatgagagggggagttggtattaggtccctggaaacgaacgcagcctaagtaacatcagtgacggcagaggtattaggtctagtaacgtcagcgacggagctagaaatcattaaagagtgaacttaaactagtgagttgctttttttttcttaaagttacatggtggtttaagataatttaaccataattctgaagacaagtctaaggctcaagccctaactactctaggcctgccttcgctcctttagggcccctttgatttggaagaaaaacatagaaattttagaggatttcaattctataggaaaattttctatgaagccatttgaaacaaaagattaaatcctatccaattctttgaaattcctatggaatgcacaatcttatagagattttagagaaaatttagcatgagctttaacctcttggtaatttttctttgagtttatctctctcatccaattcctgcggttcaatcaaacggtaattcatgtgtttttcttacgttttgtaatcctctgttttacacttatatacctttttaaaatcctgcgtttttcctattcttatgttttcttaatcctacgattcaaagggccgttaacatactatacggatcgcaaaacgtagaaagaaatcactggaacgggagcctcacctatgatgaatggcatgcacttccaaccttgcggcgtcttccccctcttgcctgccacaacttcaccaccgacgacacccccgttctcaacggcgccgatctccatctccgtctccaaagcgtaccctcgctaccacagcaaccaccaccaccaccaccgcgcggaacggcggaggccaaccaaaacaccggcgaaaaacctcgctctccgcccgccggtgcgcgcgccagccagccagcaccagcggcgccgcgcgtatgtgaaagtaggcaatgctactaccaccagttggtagaagtggtacatcacgctacactgcacatatatgcgtgcgtgcgtgcgtgcgtgggtgcgtgacggcgtaggagtcttgtcacgctagagctattgggtgcaccacgcgttgtcaagcgccgcggagcggacgggacggttttttttgggtcggcgtgatgcgattgctcccgtgtgtttattgcgaaacggacacatatgcgtccgtccgccgaaacagtgagcacgtcacagcggctgggctggcggacgggcggttgggtttccgcggcctttgaggcggcatgacgcgtcggcgtgtctcatcctgaagatacacgtaggtttggatggagacagtccatggcggcatctagggatggcaattgtgcccgtttttctatttacccgtggttaaaaaccctattaggattaaatttgttctccattttatacccatagatattttattgggttaaaagctatgcctgatgggtaaatgggcatgggtatgggtaatcactacccatgcccgctttgcccgtttacccacgaaatctaacttacatgtaggctagaagcaaaatccactagaatacataagccacgttctttgttttctacggttttccttttatttcccttattatctctccctcttactctatcgccgtcagaggagagacaccacaccgagacagagaatatttgatgttttaaattcgatatcgaacttagaagcttgtagactttttattccactacttttgtagtggcgggtaaacgggcacgcctgcgggcacaaggcgcccgtgggcgatgggcatgggcaaccattcttacccgtcatgtagtaatagatatacccacggaaaaaaataatctcatgggcacgggtatggataggcactacccgtacccgtcgcacccgattgccatccctagcggcatctgatgctttttggtcatgttgattgtgtgcgcgcggtactgacagtccagtccacattctcccgtgaatgaatgaagaaagtttggtttttagtgaaaaaaattatcgtggaaattaaacatggaagctgatgagtacttcctccgtcccaatatataagaacctaaaatcggatgggatatttcctagtactacgaatctggacaggtagcctatgatgtccagattcatagtactataaaatgttttatccggttctaggttcttagagcatccccagcagctcctttatctagtcatccatccgatatttggagtatggaggagaaaaatagtgctccagcaaagtcaccatcacatactccatttttggagattctccaaacctagcccttcctatgctaaatatggaggttctctctcctcactccatcctcaactacccacttcccgagattttttttaagtggtgaaaggtgagagggatatgagtaaaaatgtgtggtagttgaaaaatattaataaaatataggatgttggtatatttaggatgtaatatggatgatctgttgaagtgaaaagttatatagagtgagaatttttttggatggctatccaaatgggagtatggaggatgaaatttagatgagctgctggggatgctcttatatattgggacggagggagtatgttgcaaataatgggccgtgactatcttggacccacaaattttgtggatgatctcctttgtagcccatgaagcctttgcacagtttattgggcccataaccagtactgggcctcgatcaaaggtcgcccattagaccctgtatttccatgtattattaaccccatgacctaattctttaataatcataagaggcatttccggccgggacgtcccgaaagctaagacaacgcatccatcatgccgcgtgttcgtacttaacgtgcccatgcatccagcagccggcacccaatcaagctcatgattaactaaaacacgtccaaaagttaaagcctttctaagatccccataaaactaaaccttttattagaccaactaatccttctttctgtagccgctagctaacaatctaaactaatgctatcaactccggctcaggtggaggggcctgcacttactagtacgtacgtgaccgataataatcatagagtgacaaagtgtaccatctgtttgtcctaatcccaaatatcccaatcctttccctttcctttcggtctctgttgcacagaatcgggaaccggttggtgagacgtaaccaaacgtgggtccagccggtgccgtttgatgacttggcctccaggctccaagtgaccgtaattatggcatgttaattcggtttagttagtaagcttattagccaataaattaacgaatttggtgtaaatatagtgccacatttctgacttgactcaatcattttttaaatatgtgattgctagtgtttctctctcaatcttatcttccaagttggtaattatttacttttatcattattctcttatataacttacagtataaatgttgtacttccctcatttcatattataagactttctaatattgttcgtatttatatatatgttaacatccataagttatttacattgtaaatgtatgttatttacaatataaataacttacttagtataagttttgaagtgtaaatgtatgctatttacattgtaacaagattttaactttttttaatatgatatcataaatatagctagtcccataaataaatacataaataaattcaaaaagagaaaataacaaatagttagaaaagttatatctaataatactgatgtacaaggttaactttggcgaaatctacttttgtaagcgcatcacagaagtattctataccaccattagcaaagaacgggtcttgtcgggcatcagggaagaagagagcgtggagcggagcgcgccaccgcgccgcgcggccggcgacggcgatgggtgcatggcccatccgttgtcctggtgacctgatccctgcattgcaatcttgcattcgactactctacatatgttttttaaaaaaaatctaaaactgaacgtgatatatactagtagaagtatgtctataatttgttgcactagaatatatgatagtatctagttttaggtttgttttttttaacggatgaagtatactctctctgtctagaaaaagacccatcctacatacgaacttgatatatatgtgtgttcagattcgtagctagcagtatttttttttaggacggagtggtactgtagtaggtcatgtgcagtggtttgtttttcgccgcccgaatcattcgcgccatctgggctccgcctcggcgcgacacgatcattgcccgcgcacacacccggcccggtacgtccccgtccttgccatcgccgttaaatcttaatccggcagcactagtagtagctttcaccaaacccttaactaactcggtgctaatcactcgccattaagatctaagcaagcacgaatgatgagtgatcagtggtactgtctcagccagccaatcatagctgctcatacgctgaaacagccgagtagttctgaaaatcatacaggctggaacagcagataattaagccaaaaaaaaaacaggctgaatatttcccgatgtaggtgacggctacgagcttgttacaggtgcatccaggttgtggtacatgatgagagctttagctcgctcttgtgcaatcaaatcattcatccatttccccttttctctccaaatcatcatccatgcatgcaggttggtgactgatgaaaggaagaaaagggaaggcaaacctggacagcacagacagagtatctgcatctctccctttctttcttctcgaggttttctctgattctttcggcagcatccaaatgcacgacaacgatgccacccatgatgcgtcgatggcgaccgaaagctcatctcagctcagcctcagctcgccacggtcgagaggctgcatttctgcagagattttcctcttcatggcgagcagaaaggagaatatgttcgcactatgcgtactggaggcgtgtgaatcccgtatgcgcgtgtggtgcctgctctgcctgccctgtgtgcgtgtttttgctcggatcaatgggttgatccccactgctatcatgctgctcccaatgatggctcgctagcttccccgacaggttgtgcccatcaggtgcagcctgaactcacacctcgcagggccaacactagttcacgagattgctaactacagctgctagctactccctccgtttcgcaatgtaagttattctagcattttccacattcatattgatattaatgaatctagatattcaatatgaatatgagaaatgttagaatgacttacattgtgaaatggagaaagtaatagctagccagctatacggacatgtcaaccatttttttttacacggaaatgctaaactactgttggtagaaaattgaggctaaaatattgtaaatttctaccattagatttgctttgcggttcctgctccggcgacctcacctctttctcctcaagctccaattaccccttcttcaccagccatgacgaccggcgtcttgccgacaagcggtggcccgacgatgcatggtggaactagtggacggcacggcgacatcggagtcacggggatggaggaagacggtggactggtgttggtggtggaggcaaagcaagtgtacagttaggagatggtggtggatccgacaatagtgagtcgctggagatgggggagacggtggggcgggggcacctcgccgccgccaccttgaggagaaatagagggggaagggtagtagggaggggaggcggctggtcgagggagcctctctggtgccattagcgtatttcgatcagctgacaaggccagggcgttggtggcaacaagaagcggaagtgttgagcacttcatgtggtgatggggaggaaaaaggaaaaaaagaaaaggttagagttttgagggctttgcatgaatctcaaaacataatttactacatgatattctatcattaatatagaccagggtttaagttttcaataaaaactggttgagaactgtagttttttttttgttttcacggaggacggaagcggattataagtaaaatttcaaatggtttttaagaattcaaaattgagacgatagatttaactgaaatttgaaaaaaaaactgtcataccgtcaagatcgggattcgtcgctcaatcggaaatgggaacactggtaattggtaaaagaccaaagcattaactttgttcagtagttttctgaaccgggaaacaaggagtatactgtttcggtgcttttgtttcgtctcctaattaatactgtacctcgttggctagcttgagctggatgcaaaatttatctcccggtcatcgcggtacaccgagatgtcagaatgatatacgagggcgcacatgccttgtaccaaccggaagcatccaaaaacccagatgcacagctaatgcattcactctatggggcattggaccaagagaagagaacacaggacatttttgtttcttgttcgtttgtgcttttgcaattctgcaaagcattaggggcgtttcaccgcgtatgtatgtacagcgtgttcgtgccacgatggttgcgtcagtgaggaaaggcagcccacgttaagttcagacttcagaggagaaagaaacaaggctttctctacactgtggctgcaacaagggccccacatgacagcagaagacactgctgctccacggtcggactggcattctcgccgtcaatgtcgtcgtcttccttcagtttacaactaaaaatatatacttggagtactaggaaaacaagcccaaatagtaggcatacatgtgaccaaaaccgaaccggtaaaaccgctcaggttttgcatcactctcaagtttcaacaaaactaaaacacattctaccatgtgggaaggaaagaacgctatgcgtgaaattaccgcctaaattaaactgttttgggggtcaccggtcacgggcaaattagcaccatcatctcgttcccgtccactccaccatcttgccctctagttgtacttaagtttgcaagtagtaggtgtgatcgtaggatagcctaccatgcaatggttctcatcctcaccattgtcttcctcgtgttacattcctttcgttcattctctcagtgaaatgtacattttcatcaccccacctcaaataacggtggtagaaatatggagggacattattatatataaaaaaaagtacggagaaatataattgaaatttagtagtggctaaatctcttttttttttcttttttggcatatttcgattgaatatgagtgatgccaacgtggatggccacatatcgattagtcaaaaaatgataaataataaagttacccctaatcaatctatcagtaaattactagtttatctttatctctaataactaatggatcaaatcatttctactagagagtaacgaaccatcgtccaaactacgaacataattacaaattcacaatagtctctagtctacaagtaaaattagggtgtgttaaaaaaactcaatttgtgtcattaagaaagaaggaaacaggcaacaaattacatttttttagaaaggtcaaattacatataattcgtgcaaagccaaactggctcaagctccgccacattggcattagcattttgagggcgcccgacattctcatcctcatcgtcgtcttacttaagtttttttttttatttttacgcaagtcttacttaagtttcatccatttgttccatgcttttacgttcaaacggctcccttatggcccggtcatatgctcctaccatacacaacacgctgttccaatgtcagtacaaatgttactaaggtaccactgattgcccacattctctaataaacagtaagaaagtgtttggcaaatgggaaacggaaatgatttcccaccatctttagattctaaccattcattctcccttttccatttaatcctaacccttcattcatttcctaatcccaatcccaccctccatttcccattatccaaacacaccgtaagggcttattaagaaataaaaattattttacaggtaaatttttatatatgtgttcttagtgatttaaaaccaatgctgaaaaaaaaacgttcaaaatatcttaaaatcaacttcaaaattatttttgaaaaatttaaattttggtttttgccgacggagctcaaactttgtatgaactgcgtttttttttaaaaaagaatcggaacaactttaagatgtagggctagcttggtttgaagtctaaattaggcttaccaatatttggtaatttcaatagtgtttagtgtctatttggtttgaagccaaattttagcatgcctaacaaaataggccattttaatagtgaacttaggctattttggcttcaatccaaacacaactttgccttaccaaaattagtagtgccaaaatttggtaaggcctatttaggccacaaaccaaaccaacccttaaactaaaattagggttaatgaacaacctttagaacacaaccaaaatcgcacactaaggtaaaggaacaaaacaacaaatcacgttacacccgcgaccaaagccaaaacggaaaacgcacacccagctaagggttgggcatcattgcagcataactaaacacaccgtagaatagaggagcgctttacgcggaactaattaactaaaattaaaccccgctttctcggtcacgggcaggtcggtcccaccaccccaagtccccatacactccaccaccccggccattccattccattccatttcttttcttttctttctccccctcaattattgccgcttctgtccatcccctccccctccaattccattccatcttcatctccatatcttctcctcctcgcgtcggcagttatctcctcgttgataatggcgtcgtcgtcgtcgtggtgggtggtgatgttgttgatggtggtggcggcggcggggtggggcggggtggcggcggcgacggcggcggaggcggcgcacgaggtgctgcgggcgcacgggctgccgcgggggctcctgccggcggggatcgcggatttcaggcacgacgaagggagcgggaggttcgaggcggcgctcggggagtcgtgcacggcgcagttcgaggtcgggctgcggtacaacgcgacggtggccggggtcatcagctacggccggatcgcgtcgctgtcgggcgtctccgcgcaggacctcttcctctggttccccgtccgcggcatccgcgtcgacgtcccttcctccggcgtcatctacttcgacgtcggcgtcgtgttcaagcacttccccctcgccgtcttcgaggccccgccgccctgcacccccgaccccctcctcctcctcacgcaggtaatctaatccttcttcctcgaaccaatcacgaagtgaaatctccacccacctagttcatctctgaattgggcgctcacgcggggcaggtgtgtgaggacggatcggtcgccggcggcggcgcggcgtcgcaatgaaggggacggactcgatggttgaaatcggcgaggcggaaaccaaaagaatgcgcagttttgaggcatgggagtggtcggccggtccgtcgccggcgggccggcatctgtgcagatagatagaatgaacattcctttcgttttctactactagttagtaacctttcattcctcatcactctgttcttcttgccgttcttgttgtccagtgcgatcaaagccggccgacggtggccggtagaggaggctgccggcctccggtcgccgccacggcgataatttttcgtggttatgatggttcggggattacaacgtgttgaatctgtttcttgccgtgggcgatgaacttggatcgttcccggatccaatccagcgtggcgatcggcaaaacacgcgtgttccgttccgttggatgatgcggttttgggtagcacagcaagcgtcgctgtctgtctctctcggcgctgctgatgatgcgtctcctccggtggctttcagtgtcctgttgctgctgctagatgctccggtggcgcgtatctgaggcgaagccgtccatgttggcatccaatgggatcgcgcatcctgcggtactgctactagtctcctcctgatgcgtcagattcggcggcattcgccttctcgatcagctagcgccagtctcgcgagagaatgggcgagcattgtgatctgtgcccatccatgaccaaattgaccatatgccttccctagcttgcagtacctctctccctccctctcgccattggctcttctctgacatgtctcgccaaaagtgagctcgctttgtgcgcgcgggggcgggggggcggcgattggataagattggaccattcaccgcgccacggagccagcgaggcatgtgtttgactgctgggtggtgtgtgacccgttcttgtctgtgaaatgtgaatactggcatactgcacgcacggtgagcgccatgtaaatgctctctgctcgcgtacacggttttcttctcgcgcacacggaattcttctcgaggtgtaaaccccgtttggtaactttggggtatcaatcaaagcggcgaaaccgtgcaccgctatgtgccacatgggcgcagcattcttcccgagctccgaattgataagttggatctggtacggcgtagcgtacgcattgcatgttgcgatcgatcgatcgatcgaagtcccggcctgggcaataattcgctgctgcacatccacacacaccgcaagctgacagcggctggctgacgtggtggaaccaccaatcggcattacgaacagctcggcaacgcccaggatgactcgtcactgacacgtggatcccatagggcacatcacgatcttttcttagagaagggtattttttatcggcctctacatccgaccggatatatgcaatatttttaaattataaatttagcctaacccaatctaaaatttgctatcatgaatatgctacttaagtcaatgcaaccgctaaactacatgtggcacgtcacaatcctgcctgcgttgcatagtgttctttgtgacaccaatgccacagttggtaacgaacgaactagtcgggggcaaggggcaagacagcatgtttcgcatagcgcttgggagtgaactggtgaagttacacaggaacagcgagcgacagagagggggagaggatcaggcgagcgattgcgtattttgcattacgggagagggagaaatgggtggattggaggagcagcggcatgtgctatgggggaaagctaatgatgggaaagagacaagcgtatcaactgcagcgccttcctgcagctgccgggttggtggagtaggtgacgaccacccgcgcctgggtgggagtgggatgccggcgcggggcaagtgatcgatcgattgaccatggtaggagccacacaggccacagccacctgggtaactagtgtcatcagctgcattttgctcagttgctgcttgccatcgtcgtcgacttgttgccctcctcttttttcactgtccgttgctgcttcttgggttcacttttggtgcgtttggaactttggatagagtattaggtgatctggataggcacgaggaggaagccatgcgatgcaatgggataatatgcaatgggtgatgaggtgtttgggtgtccacctgttgaaactgtgtcattgttggacgggtgacatgtcacatgctgatggggtggcgtcagtcaatcatgtttttgtagattaaccggagtgaagaatggggtctgatgttctatctgatctgatctgatcatctcttgtggatcatcatggttaggcttggcatgatatatgaatcttggtccagtcagcaagtgggggtttttattggtaaattgctttggtaagttaagaggtcacatcactaaacatttgctatgcaaatgtgaatgcgtatgatccctacttggcaaaaacttggaacgtgctgtttgcgtgtcttcgcattcatgcatttctatccgtcgttagacaaccaatcgccaggtcaattgtagtgccggatggctagctggttggatgacactgatcatagcttgaactttacgtatttatttttggagcagatgttcgtatggtaaaatgccttaatggtatacgatctatttgacatcagatacaactttctgatattgattccaattccattcagggaaagagccagagtgccgtacaatttgcacacagaggtgtgtccaaaagaacttttttgcagtaaaaatgtgaaatatagggagacatgaaccattaggcatttgtcacccgtgtgcctgtgtgtgtcactcttctcatgatctcatcacaccagtaaactgcatattaacgcctgaattcattggtagtgccaaattctaggtaaactccggcactatcaaaatattgtagggtaaagttatttagctaatatttggattgctaccaatataaaaccaaactcttatagtatagaggagaaacttctagaatatgaccaaataaggtaggcactaccaaatatttggtgttagtccaaactaacacacatattattcagtttgccaacaaagtggaaaggcatgttttggtatcaaaccaaaacggccctaattaaaaacaaggagggacaggtaaattaattgggccgtcaaactcaggaaaagcccagtctggttcaaaaggcccaagatacaaaaaaaaaccgcaaccccaactacacgtctccggcacagtggaagtctactttgcctcccttatttcttgctcctgactcaatcgcctccaccgaccacagctgggccacctcccatggcgtcccagcacggcggcgacccgcgcctcgaccgcctctcgcgtgccctcgcctccgaccacccgccgccggcggccgccgcggtccacgcgcatctcgtccgcgcgcacgccggcacgccgccccccgtcatccggtccctcctcaaccgcgccattcgccgcctctccaagccgcacccgcgcgccgcgctccgcctgctcctcctcatgccgcgcctccccgtctcccccgaccacttctccctccccttcgcgctcaacgccgccgcgtcgctccggttgctcccgctcggcgcctccctgcacgcgctcgccctccgcctcgcgctcctcccctgccgcctccccgtcgccaacgcgctcgttgatctctacgccaagtgcgacgatctccccgccgcacacaccgcgctcgccgacatcgcggcccccgacgccgtctcgttcaactcgctcctctgcgcgcacgcccgcctcgcctccgtgcccgacgccgagtccctctttgttgccatgccatccagaacccaggtatcgtggaacgccatggtggtcgtctacgtcaatgcaggggacgtctcttctgctcgccgcgtgttcgatcaaatgcctaccagggactccacctcgtggtcggtgctgattgttgggtactgcaagtgtggttcaatgcggagtgcacgagaggtgttcgatagaatgccggcaaagaatcttgtggcatggacagcgatgatcaatgggtatgcgcagagtggggtgccaaaggaatcacttgcgctgtttagagaaatggaggctgctgggattgagcctgatgcagcaactatggtcggcgttatatctgctgcctcgcagattggcagcacggagttggctgggtgggttggaagttatgttgacaagaagaggattgaaaggaacgataaagttcttacagcacttgtagatatgcatgctaagtgtgggaatgttgacgaggctctcagtgcttttagggagattgcacagccagatgcatacccttatactgcacttattagtgggctggcagctcatggtcatgcaaaattagcgcttcaagtgtttgaaaggatgcaagctcagtcagtttggcctgatccaatcactttcgtcggtgtgcttaccgcatgcagccatgcaggacttgtcgataaaggtttggattactgggaggcaatggtgaagtactatgggatggagcgtcgagctgatcactatgcttgtgtagttgacatgcttggccgagcggggaggcttgaggaggcttttgaaatggtgcaaacgatgccaatgggcccccacccaggggctcttggtgcattgcttagtgcctgcaagacgcatggcaatgttgagattgctgaaattgttgcaaacaaactttttgagttggaacctcacaacactgggaactatataatgttgtcaaatatatatgctgagaaagaacaatgggaggaggcagaaagaattagatcagttatgagaacaagactgcccttcaaacagccaggctctagttgggtggaggatcgacagagggagcgtggcaggtttcctttgaggagctgaaaacccgaacacatatctctctttgtttcaaatgtaaattttcagatgatgccaaacagatcttattgaactgccagaaatgcaggagctactgatgccattaaggtactttcacttctttacagttcatgttatatctgaaagatcccaatgcaaattattttgtggaagtattcagataactttattgctttagtaagtttggcatctcaatgaattgatgcggtacagcataataccaacacttgtattttaacctctatatcttagataattgtttggcaagatattttaataaatggtgtggggtaagcaaataaggcaatttgcaatccatatcttaatgcttgtaactgcaagagtttagaaagaaaattttctgtaatctagtatgcagaaaatgctcaggcaagagcatgtcgatcgcttccaaatcaataatttcagaaagtaacagtctcctcacgaagacatgaagtatggaacgattatttgcatcaccatcatgcatgattgtattttgttctgaatgtttggtaaatcatgtgcagaagaactagaacaatagttttttctccatgttcattatccactttcacgaaaggatgctaattggtgcaattattctgggtattattgatcagcctgatttcactcttgacagcgggagcatagtagtctgactacaaggaattgatagacaattctcgttgctgcaagattgttaacttttctgagatgctgcaagctaagctggttttaaacaagctaattatcaggggcggatgatctatggatcagtttgtcgttaaggtaacttcaattcttcatggttcatgtcatgtctgaaatttgccatgataaattactttgatccttttatgtgttcattgagccatgtttttttttaaaaaaatatgcttgtttatctctagaagaattgagtatagtttcatgacacttgcaatttaagctcgtcatcttaggtaggtatctgtgttatcaagaatttaagatgtgtcataaaaaaaaaccggcatccgaatgtttaaactatgatggttcagctggaaatttgttgatatattttgaaattttgctaaccatgaatacaatgttcacttgcaaatcagtaagattagaaaacagatcatcatgacgttggaaatagttatttacatggtgcattccatataaatggccgtatattgttctggatgcttgataaatcatcataggcagaagaactagattaactgtttgtctccatgtcgaatacccacttcaataactggtggttcacccataacgtacactagtgacaacaagctaactgatgcaaattttcagggcattcctcagcttgacttcaccgtctcgatcgcttggattaattcatctagtttggcacctgtgacctccttgacgaccttcccgtccttgagaatcttgaatgttggcacaacctttatgcccagctcctttgcaagagactgcgaatcgcacgcaccaaggaggcttagcacgatttattcaggaaaacagcagatacattccaatcgaataatggtgggtggagcgtagacaagagaaagaaaatcagttctaactgaccttgttgtcttgattgcagtcgagtttgaggaacacaacgtcctggtccttctcggacatctcctggaatttcggtgccatcaccttgcaagggccgcacctgcaaatcaaccagtcagttttacagttattacactgagcagtgggatgagatctgttccctttcttattcacgccgctcatttcaaaataaatccagctcgtgataagactgaagaattcatgcgaggcaacagttcatcaatggagattgacgcgaagagatcagtgagttttgtggcttttgtgaagtaccattgggtgtacatgtcgaggacgacgaccttgggccctgccgacttgacaattggccagaaggtatccttgttcacctccgtcacctgcccggtcacggccaccgcctccgcctcggccccaacagtggcggtgtccgagccgctcgacctcacggggatcaccgcccttgtctcagggccagacaccaccgtcaggctcctcctctgagaagccacaccgccgccgagcaaggcggggaagcgcccgcaggcggcggggcggcatgtggagatggccggcgaggaagccggcccgtgcgaggaggagacggagaggcgtagcgccattggatgggagaattttggaaggtaatggcctaattgggtggcgagttggtgctaggaaggaaggatgtgcgtttttcttcagcagcggcagcggcagatgagtggtgagcttgaaaggatatcttgcattgcttggcggtattcatagcctttctagtggagatagtttcttggcggggaaatgacatggctgccccaggtaattcctgcacttttgtggtggcactccacctatagctttctgtgggatggggcatttccggtatctgaaagatcgggttgtgtggtgcctgcgcatctctgaggtttcatggaggagagagcttgtctaacatttgtagatggctctttgtgtctggaactgatggcctcacgattgacggtaacatggaatcagtatcatagatgtcatagatccttttacatttacacatatgctatgttagattgctagagaccctaatgaagtaaagattagaaactgcacacaaaaggttgtgttgtatagtggttgaattggagttaggcgctatagcgttgtgaacttaccaacatgatgctgggccagtattacttggaaaccatagtaattgaattatgttgacagtgtagacttttaactagccgaattatgttaacagtgaaaccatagtattactccttttctggttgttgaaaacgggatatgtttcttatacaattttacagctccagcacatgcttgatacaatttaacagctcgagtagatgctataacagatatttatctcgttttttttgggttatttccagtctatgacaaacacatcagcaattcagcatcgttttctactatttgtatgtcttccctttgagcagtgaacaaacaagtgttccaaatgcactgtaccatcaaagaatcagtaccacgtgaaaagaaaaaaaaaatcaccagcgtctctagcgaaaagccaatccagctgcacaaacacatcagcatcatcgccacgttttgcgaattctaccctactcgacacaatctcgttagtcaaactccagccgccagatattgaacaataattgtggactgctcgtttctggcttggaaaaaaaacagaggaatattcctgagatattgtaggtaaatgccagatgtcacaatgagtagtatcatgtattacatggatattttctctttgctcattgtcggaaatgcacaggtagaaggtttagtgaaccaatgcaatcaggttcattttctttttgcactaactatcttgcttcgagagtttgagtttgagaacaaatttcacaggctcgtgaatggtagtatcaagtttctgaataacctcatctcaaaataataataataataataataataataataataataataataataataataataataaagattctaaataacctactagtcaaattcccaaaccgacacaaaatgacaacatgccaagaaggcgaagatgaggcccaaaaacatgcatccggcccaaacatagccccaaatgtagctgctaggcaaggcccaacatatacggtggaagagacggcccatgtgcagaggcggcttagagcacgcatctggcaaagcgaatgcccctgttactcgatcaggcaactaaggacctgttgaagcttattttgtcatgacacatccggtatatttatagcagctagcgctatggtttgggaggggataccgggatatctaatccaactcaattgagatcctttaggttactgcatatcgctcactgacatgtgagccggagagtgacctacatccgatccaactacattagaagctcttgcttgcaatgaaggacctgccatcgccatggactgcaacgtcctgaaggtctgtatagattcagattgtcatgaaagttatttcgagtattgctacaagatcaaaatgcagatacttggcagtccttaatgacaccaatataagaagacgtcaatttgttaaagcagaattttgtcatgaaagttgggatctaaatgtagatgcacataatttggctaagtttgcatgtactttaaattatgaggggcgttacatgtggctgttaaaatactttccctcccattaatgccttattcgattaatacaggaggatggattgaaggggattgatgggattaattccatgcaccttagtggatgtagaacaaatctccctcggaatcaaggtgtggaatgaatcaccctcgaagatcgatcaccttgagattaaccgaaaaaaaccttaagaaataacgtgttttttttcgtaaatttcttaacccattcatgatttcaaatgtttagtaaaccctagtaattctatgtggcatgctgtgagatggatctatctcctaccatgcatgaaaccagttagtttcatagaactacctcataggagaaaaaaagcatctcctttactggaaaacctcacctgttttgtcaactgtgtggggaaattgaatcaattaaccatattatctttgattgccccattgtttttttttttgtttggtgtgcctggagagatgccatgagttgggggcagactgccaggagttttgatgacatttttttactggtagagatgaactcaattgctaagagcaaatctgttaagatgtgtttnnnnnnnnnnnnnnnnnnnncactttggttgacaagaaatgcaatgatttttagagaaaaaatcgtttactatcctctaaacattccttttcaaatcatttcccttatgctgcagttgaaacctctgcttcaccctgatcagaaacaaagtctggagatgctgatgacccaccttagggagacgagatcaggcctacgctcaagaactgggattggttaacactgtgtccttctgaacctgattttctatttagctgtcctcgttaggtgatgtttagagctagtttcatgagagtttttggttggagttagcctggagttgtttctgtttggttcattgatacttgcaatccctatcaagccggggtgtggcccattaatgttttttttttttctgcttttgtgctgaacctctgtcaagctggcatccccagcagactcgtggcccgtgatggttttcaatagaagccgggtccttggacctttttctaaaaaaaaaaactcacatgctggatatatatatggtaatgtggaactgaaattgggcatatatggctaacaaagtttctggtcaaaaaatacacatatatgaaactgaaattgaaattgggcaaatgtatagtcaacaattttctctttttacaaaccagaacacataagtacgtacatgttttgaggtcgccgtattttgatcttaacgacttaaccaattgctagatcagtggtgatcgaattcttgtacaacacatgcgtccttgttcctacaaggttaaaaagaaattagaaataccgacggggttaccggtgatgacagcaccaacggtgcagatggtccacagcaacgctttcacgaccgggctgtccatcgtccacggcgacggcgacgactcctccggcacgccggtcggcagctgagggaggatcatgacgccgccgccgccgccggtcgccgctcctctcagcatattcaccagacgcgccttgagcctttccacccttgtgcgctgctgctgctgcaggcgcgcgccctcgtactcctcgcggaagaggtcgttggcgcaggcgacatggatctggacgacaccggcgccgccgccgccgtcggagacgtacccccaggtgtgcctcctgtcgccgagcttgacgtgcctgcacttgcagcacggcgacctgagcttccgcgtgagccgcagcttcgtcacgctgccctcggcttcgatcaccttcggcagcgccgcgcagcaggggtgcaggaccctgccgcgtttgagcagggtgcgcaaccttccgatgtcccgcacgtacgcataaccattcacctgcaagcgtgcacaactgattacacgtacgtatactagcttagagttttctgcgatgtagccaaaatcttttatatttggggacggaagatcttccgaatcatacatatataaaacaacatgcccctctcaaaaaaaaaaacatgccaagtatcgtatatttcgagaattgcatgtaggtattgagaaaaaagaaacacctaaaaccaactaagacacgatcgacaacatccgtgtttcaaaagtttttatttggacgaagctaattaaggtagtagatgaaaaataagaaaacatcgatcgatgacaagaaacatgatcaagagaaggagagatataatgggaaactattttaatttcttaaggggatatcctctcgttttgtgcatgtcactcaaatgtttatgaaaaatgtgaaaaaaaaaatctgagaatatgtattaacacgtggtctatcactccacaaacatgcaagtttaaattcaacttctacatctcgcaacggaaaaccaaattaaactataactagttaacgtatattcacagttaaatttgtttttttcgttgcgagatatagaaattgaatttgaacttgcatatttgtggagtgatgtaccacatgttaatatatcttttcagattattttttcataattatttgagtgacatgcaattaacgaggggatatcgcacgagatataatctagaaagaggtgacttacgttgcctccgcatccatcgcagcgaacgtcgtcctgcactgtacctgggaagagatttatggaacacgaggctgtaacgcttgaagggatcctggtaagaatccccgaacctgtgctgcgcgcacgcctcgtggagatggaaccccgcgcgacaccctcccagcttgcacacgtatctcatgtggtacccgtgctccttgcagccatcgcaccggaatgactccttcccggccgtcagtgtgagctcatggtcgtggtgctcgggagctcgaagcttactgtgccccgtcatctcgcaaaaacaatgaaatcaagtgaagcggccggctagctatgatatctacgtgcaggtgcatatgcatcacatatatgcaacaatataatcggattgggaactctaaaagcaagcgttatacttggagagcaagaacgtagagcatgctgctatcatgctactccgtgatcccctctttatatactatataagacctggccttttggtttgttttaagtcgcactttttaaagttgatcaacttaatttatagaatgaatgtagcaacgacatttcttaaaaaaaacaaataggctgtaaaaaattcaatggtggtgatgaaactaattttatgttgtagatttcgatttttttttataaaccttatgtacttaaagaagtttaactcagaataaactcaaaatatcttatacttcctccatttcacaatgtaagtctaacattttccacatttatattagtggtaatgaatctagataaatatatatgtctagattcattaacatcaactagctgggtggcccgcgcaattgcgcggctagtacccaaacaaaatcatatatttttttagtatgattttacttaaaatttattaaatagctatctcattgtcttaagattttgaaagatcaaaccttatcatcctcgtgtttctaattatatagtttttaaaagtcacaccagttgctaccccttatgtcatctacttctttatttgcttgctcgatctaccaatatttctattcattcttcttggaacctttaaaaattggattttatagtttttagagtttattgtcacattgggtttcatttttataatttctagatgttccgtcaaacgttaccattatactcctgtgtgacatgtccactgtctcttctctttattgtcattgagattttaaaaattgaacataattatcgtttgggttcattttttactttctagtagtcccgccaaaccgtcagcggctttgctattgtactcctctacggcttgcccgttgccttccttctttattgtcattgagattttaaaatcgaacatgataataattgttttttttttactttttagaagttctgaaccttaaaaaattgaacttgtagttttattttttataatttttagaagtcccatcaaacgatgccactatgctcctgtacagtccgtccgccacctactctttattgtcattgtgattctaaaaatcgaatataactatcgttggaattcattttttattttctagaagtcccgtcaaccgtcgacagctctgcaactatactcttatgcaccccgcccgctgcttctcctttttattgtcattgagattttaaaaatcaaatatgattatcaatgggttttttttactttctagaagtcccggcaaccgccttacttgtttacttcacggtctgcctgatatcccttcttttaatcattattaggattcaatttggtgttttattaacaatttttatatgtcgtaccaaccgccaccactctactcctttataggcctgttaattaatttatctcgtcatgtgttttagatggtcttttcttaacaaccgacaccttgtaagcttcgatgcctcgtgagcatggactcgtttcaatgatattttttccgtattgaaaatccaatttgaaatttatttcatattttattataaatataattaatctcattttgaattttagatggtctgtgtaaaacttataacctataagccttatattttaggcttaactacattaattaacactaaattatgctccgaggtgaatacagctccgagctgaatacgtttaaaataaatttacacgattatgattataatttgttgtcagttgccaatgtggccggacgcttctgggtgggttgcatgcattgctggtctggaatgctggttgcagctttgctttgtttgctttacctattgggggcgatggtaatcaactttgcttgtcacttgttctgccgcagcagcccaagtatatctacttcatatatctgcgttttatatgtgcggtaacaatgcatatatacttgcgttttggaatcataacaaattctgtaccgtattgtatcccgcttgaatttttgataccgtatagtaatccaattggatttttctaaacggacaggactttttaatctatatcaaagctctataattctttattttttctatagcaaatctaaaccgttgtaatctaaatctattataatccaacggtgtataattttctctttttctccgattaatgtgagaatttctagcccccacagtgaacgtggtgccttcttttcgagctgtcttaataatataatagaagatatgaatgtgggaaatgctagaatgactaatattgtgaaatagagggagtaatatggaacgaaggggattgtgtgatgttgccttaagacaagttggaccactaccttgagttatgtgagaaaaatcacacctctctacgcgtggtattaactaagtacgcgtaatcaaaaaataatataaatttcttagggatatatatctatcgtgagaaagtactatttgtgtccctactaaagatatcatcatcgcaaatgggtgataatataatcctcatttgtaatgggtatccactagagtataagtttggatgtccatgaaaatgaccttgactcgagactttaagctattttcacagcttatgcgagaaaaatcaagctcttctccgtgtggcatcaactacatacgcgcaatcgaaaaatcaatggaattaaatttctgggtgatgtgtctatcgtgagacgagttataattaatattggtgtgtagtgtggtcttgaaatttgagtgcatcatttgatccagtagagtttaagtatgtgtgaatatgacttagcttcaagacaagttgggctattttctcagcttgtgtgagaaaaatcacacctttctccatatagcactaaccatatggatgcacaatcgaaaaaaaaaatattgatactattcggtcaacgtatatggtgagaagaagtatcataggtgttgagttaagtttaagtatgtacatcacttcatccattagagtttaaataataaatatataagaatatgcgttggctcatatgacataagtaatacttctagaataaaatacgtcatgtaataatatttaattttaagtgtgatttctcaattacatggaattcaactagtttaaataaaatataacagggaaacttttaagtttctgctaacaaatgagttactgaatttctaccttgcgagtttgcgaggacaatgtatagaagaattatatggatagcgccacacaagaaaactcatctaatttccttagtgtacgtactagcacctgtttatatataacgtacgaatccgggactagagagtcccaggactgccgtaagatagggagcggcagtcccggttggtccatttttctttttttttttcccttccaaattgagtgagatgtatatacctaaatcaaacaccagatccccaaatcgtgtgctatgcatatacctaaatcaaaccccaaatcaacgtaccatcccaaatcattcacatcacaaatacaaatcttaagttacttacacacaaatcaactacatcacaaatcttaaaaaaaattacacacaaatcaaatgcatcatagatcgattatacatatcagatccatgcaataaatcacaaattgtaataaaagaaattatacatctcttaatcacaaattattaaaaaaacggagaggagaaccggcgcgttgcctcccgcctgctgccgctcaccacggccggcacgctgtcgccccgtgcgcggccccgctggccgccgccgcgtgctgccccaccacccgctagccgcttgctcgccgacgctgcccgccagatgtgaggaggagaggggaagaggaggaaggggggaggagagggtaggggaggaagtaaatacgagggatagaaggaggatatgatcttatctaaatattttggtgaggaggaaatatcatctgggacttagccgatcagatatggagagaaatatttacttccggttggtagtatcaaccgggactactttagtgccgattgatacctcagcctcctgacatgcctctgacaggggtttgtgttactaaccgggactaaagatcaaaatttttataaccgggactaccggttcttattggaaccggtattattgtggaaaacagccgatccagcaaagatcatttttctagtagtgtagttttatctcatgtcaaatttatattcgactttattcagttaacgcgttgttaattcgtggtcgatcgatctagtttgtaggtgtagctgccgcaagataatatgcacaagcacatggatcagattaatagctgtcgttttaggcactacgccatttatgtggatcaggacacatgttgcaacttgcaagtgacatgaccgcaagtatatgcattgaactagtctaaaaataataataataaaaatagtctaaaaaagtagtatatgcattgacccagtcaagtaaacgcaagtaaactaggtactttgatagtctgattgacacagacatatgtagcaactaaccggagtgtgtatggggcacaacgtacgcattcaaaacgttgggcattcaggcatttcagggttatgggtcgtaagtgaaaaaaaaatgtgaccactaatggaaaaacgcagttaatttacagcaagacttttatacccttacctttagttagtggaccaaaagatatagctaagtgataaaacgatgaaaaattcccaataaatcctaagagtacgctttaaaactcaacattattaattgtctttgaaacaagcaagcctaatcaacaattctgattttttttttggtggatggcacatggagcagtgttgatatgcttagatcgaggtcgtgcgtttggcggcgaccttcgtgagcgtggttagcggacgggaaccgcggcaggatgtggtgtgtactttgtggcagtatccttgcctagtcggctttgatgactttggaggtggtaatatctaggtcaacgactgatattctccgatgttactccagttctatttaggttcgatgtcagatgtgagcaaaattcgattagcacaataatcagccgctgatttcacagaagataaggacttcatacaacacaaaattcgattagcacaataatcaaccactgatttcatagaagataaagacttcatgcaacttataagccattgagcagaaacaacgaatggctatgtagattctcgccaaacatagattaaagtttagcaatacctattatctttatcttaaggttggtatttttaattcgtagccattcgatccagccacaacctacgtaataattggttatagcttctttgtagcatatgttgggatgaatttcattttaaaaaatgtgtattgctagattccaagagcataaaaatttgcgaaaattaggtcacctaaaaattacacattcataagcctaaaactgcatcggtatgcaatatacaattttacttatttttaactataatattattcttatatatagttttgatttattaatttgtatctgagcttgagtacttctaaaaaaaaattaaatctttatctttcatgtagtttggtaatatttattttttaggttagaatagtttacaaagtagcgtgcctcgctataagacatgtcacgtgtgtttgtcatctttatatatgatatccttataacatgctttaaggcatgttatacttgagtatgaagtatgaatcttttcactcccccccccctctcttcttattcccctttcccttttaaaagttgccaactatgcaaggtcaattagcagcacttctctcacgcatatgcaagtagctagtagtgcatgtgcatgggcgactgacaaggagcattctcgtaagaataatcaacaccttatccctatcgatgcctatcgatgtactcgtttacttggaagtttggaagttcacttgccggttcttacattctaaaccccgcgtggtacgcgacgttattagatactacatatactgtgtacctatatgtttctcccactagctagctaattaattaatctctcgtacgtttctatatatataagtgaccgcgagatcgatccaagccacggtatgctatgagctactgaaacctacctagctactcaaaagatcgatctagcttggcgagcgtgaggtggtgaggtacgtttacgtacgtacgtatactcagcatggccgggtacaccgaaattttggacaccaaccatcacgagcacaaggtgtgcttggttcgcaaggacgaacctttcatttgctctggctgcaaagagctcggcttcgagctccggtacgcttgccacactgcgggctgcaaccatcagtaccacaggtcctgtacactgcagcctctcaacactcgcgtgccagctcccttctacaagcacgacttcttcttcttcaagtcggtcagtacagctggtgcccgttgcgaggcatgcgctgctgaggtctccgctctcttattcttaattactaattcctcctggcaaggtttatgattagatatacttaagtctggcttgtatatatttatatttgcacgtatttcgaataacataaatacatatttaaaaaccaaagtaattttgaataagataaatgcatatttaaaaaaaatcaaaggagtcatccatcataaaattaagccggtgataatacctccgaaacatgagaaactatttttatcccttgagggatgttccctcattgtttatatgttacttatgttacttaaatagttatgaaaaaaattgagaagatatattaacatgtgatataccactctacaaacatgtaagtttaaattcaacttatgcatctcgcaaaaaaattaaattatagctagttaacatatattcacagtcaattttattttttttctttgctagatatagaaattgaatttgaacttgcatgttcgtggagtgatatatcacatgttaatatatcttctctttttttttaaatttttttcataattatttaagtgacatacaaacaacgatgagacatctcctcgagttatcagaatccactcccccgaaacatatgttgatgtttctttccttggatggcgaggcatgcgctactgaggtcctcgctctctccattcttaatacttccttccggcaaggttgaccttgactgcaaattaatactctctatgactttttagtaaagaacgtcgttttgattttttacatagatttcatcatttgacttattaaaattttatataattatgatttctttattatggtttggtttatgattacagttacttaagtatgacttgtatttttacatatttgtacatattttgaataaggtaaatgcatattaaaaaaagagacgtcatccgatccattgtaaaagccggcgataatacctccaaaacatatggagttgtttcttttctttggatgtccctcgtttcttacatatcatccaaacaatataaattatttttgacaacattaatcaatatgtaatatatatatatatatcattatgtaaacatgtaagtttaaatttgactcatacaagttgaaaaaaagataatgaaactaactagcaagctagtgtattgttcacatattcacagtcatatttattatttctattccaacttaatttgtatataggttgaatttaactttaatgtttctgaaataacataccacctttgatctatattattagatatatttttttatttaagatggcatcgaagaaacgatgccttaaggagaaaaatgactttccatgaaatatatatgtattcacgaaaatagtattagtagattttttttcctcaaaactactccttcaatttaatcttttagaagaataaagattaaaaggtgctagccatatacattgagaataaaaaagttgagaagatatattaatatgtgatatatcactccacaaacatgcaagttcaaattcaatatagaagttgaatttgaacttacatggtttaatttgtttttttcgttgcgaggtgtagaagttgaatttgaacttacatatttgtagagtgatatatatatcacatgttaatacatcttctcaaattttttcaattttttatagctatttgggtaatatataaataacgagaggatatcctctcgatgaaaatagtttcccagtagaaaaccctttcccgccgttaatttacaccatgctttaggaagctcgcaggtgcgaggttacgtgtactactgcccggacaagaaggtcagcctgcacccttgctgcgcagatctcccccgcgtgataaccaccgagacggtgcagctgaaactggagaggaagatcaccaagaaatgcggcatgtgccacgagcggaatcaggggagcttcagcaacccatgggcctacgcctccagcgagaagatgatccagctgcacgtcgcctgcgtccggaaagctctcgtttcgcagttcgagtcgaggctttacggcgtgcaaaagccgaagatgctgctgccgccgccgcctgctgctggagcaagcgctgcttcttcaactagtagttcgactgccattgtggaatgcaacagcttccccgtgctcgaggtggataagtaccggaggaaatcggccgggttcctcgatacgttcaggcggatcgtcagggcagtcatggccatggtctcggcggtgatcaccgggaaccatttggagatatacatggctttcatagaattcttcaaaccgaactgagctgacaacatttgcatctttgcggtttggagctcgtgtgtttgtgcgcagcaccagtttctccctttaaattatagatttgctttcagaacttgaaaatgggtttgggtggtgtgtggtggttcttgcaagttgtaataagggggaaaaaaaggaacacatttgttcgtacaattttcaacatatatgtataagacgatcagtttaactggataaggtggttgtttaagctgcagagatgtttttggattttgagttatgacaacatgcaaatgattttccgaatgtaaattataattaaattttctttcagaacttgaaaatgggtggtgtaaaaaaaaacatattcttcatgcaagggaaccgtgaatagttcaaagtatagctcaggtgacatggtgcgagggtgttcgcccagtcaacctgggtcctggttttgaatcctaaatcagacttgtcgggcctgttcactttaatgtcattttcaaccttaccaagttttaataaagttgccaaaaaaatggctacatttagtttgtagctaaattttggtaactatataaaaaatcctgccaaaattttggcaagttaccaaaattttcgcaatgccaaaatttggtaaggttttttttttatcaaagtgaataggcccgtcatctcatggtgtttcttgtaccccttattcttaatacaaagatagccagctccgttattcctcttttttttttttgaccaaacgttattcctcttttgtttccaaaaaaaaaaggaagcgcaatctggcatacatgcatgcaaacacgaaccacttaacagttggaacatctgaaaaccccggccagccagatgctgaatcaactgtcgatcatgccgctgataggatttcgttagaaatagatacacacacatatatgcatacactgatacacaaaagcttgacctggagaatcaggccagagtatcaggttgagttgggactgtgggagctagtacaatcacagagtcgttctcaaaaactgtacaatgaagtagagaacggccaggaaaagcgcaatctggtacacatcttggttcaatccatcatccggcctttggaagaactgcaatattgaacacaaaagctcaaaaagttgaaaacactatcactggatagctacagataagtgggtgggtttatataaagtgacatcaatttttgcaatgtatgattcatgtaccttagtaggatcccctgagggatctggataaacctccaagttctcatctttctttgatgatagccgagatgctgtaccctttgcagcttcgattgtgtcctttccggcttcaacagtggagaaggccctcctggacaaccaaaagtaggcctgggcaggaggagacgaggcagagaggtcccatgagtcgacctgttcgagcacttggccgctaatctggttcaatacgaactgtgaggtaacagagacgatcaggtctcctccgatggttgcgaagattggattcttaggtttgcctctgaatgtccatttgatggtcaggttgcttgtcgattgcattgacatttcctggactgtctgacgcaataacacgaatgctgattagatagtcagactggaatcaatccaaactcatgagcatgccaatgtgaaataaggagagaggcattctttgtttgaatttgaactgacaaagtcctttttcttttggacagtatgttatgcaacttgtttgggttagatatcttacaacagagttctaacttcatggatatggtatagaattgcagcaatccttaccactgtagggttttcgagtgccttggtgatccacaatggcctcttgtacttctcccgtccaacaaatgttctgaccgggtcctgaaaaaaaaagaaaggcacgaaaccacaaggtgatgtcaagtagctcatcagttattgtatctgcatctggacatcctaatctgtcactagttcagtagtttgtttcttgctgttgtttgagtggtactttcgttgctattcttcttaatataaaatcagcatcagcctggctaaaacttctgaaaatggaggcatgttacctacttaaacattcatcagatttcctcggggaaaaaaaacattcatcagctaacagcagtattttgtgttggttcatagagcttttgcaagagcttctcggggtctactctgtgcctgaaactattcttgttggtgttgctaaaccttcggagcgaatacgcaaaagcgttactcgctgattgaaatggcatagctctatttttcccttccaagaaaaaaaaaacagatagtactgttaaaaaaaaaactacagatagtgtttgccacagttcatggaatcccatgatcatatcagactcgtagcttacatgtttgctagattaacttgaaaggagatgcaaagcattggtgcgagattggtaccaaattaatgtctgaattactgataacacatagtacggagtagcagtaaagtggtaattggtggtacaagggtgatgcgcacaccttgtatttgacggagacggcgtagcaggtgaaggcgcggttgtcgtcgcggaggtcgaggatgtcgcgggcgagctgcctcgcggtggcctccacgtaggggctgcttatgcactcgaagtcgttgcagagctccccgaagtccatcccgtccaccagcttgtccgtctgcgacctctcctccgcaccatctccggcagccgtctctacctccttggaatcatccacaactgcaatcacgcacagagccgggagttaattagatcacgtacgtgcgagctggaccgcacggcgagatcgcattggtgagatgagatcttcaccgtgcaggggggcgaggcggcgttggagcgcgggagcatggcggcgggagaggaagccggtgacggcggcggggatgcctcgccgtcgccgtcgccggggggaggaggagggggaaagggtgcgggaggagaagagagcggcggcggtggcggtggcggtggccattggtggcccatggcgcggtcggcgtggcgggacgtgaaaaggcgggaggataaggcgcggcgctccacggcctctcgttgccacatgtggcctccgctccattagccctggcccaacaactgctagtccattccatttctcatttctcttctatttttcctcaatttttttaagggaaaacaaaattggcccgtgccaactactataggtctagtattttctagtggactgccttcttctaggcccaacgaggaagatgtatcccaggatgggcatgactttcctgagctttcacgtgcctctagcttcgtgttttgttgaagaacacaatgttttcttatagaaactgttctagaaaatcatgcgtcacttatgtaattcttgtattctgccctctctgtttcatattcattttacgagttactttgattaagtatataaaaaatatcatagtattttcaacacaaaacaaacgtattattgtaacatattgaatattagatttgataaaactaatttaatgtattagatattgctgaatttatttataaatttgatcaaacttaaaaagtcaaaggtacatgtaatatgaaacagagaaagcagatgggactgcaaatgggagatgattttgtggatgaagtataggtcctgtttgggggagcttttagcagctgcagcttctcctagaatcttcagttgccagaagctcccccaaacagttcatcttttaatctagattttgagaatctgtagttgtagaatctgaaaaatgaactagaagctagaagctgggacccagcttctccagattctcactagctagcttctcagcagctcattctcagaatcttaagctccccaaacaggcccatagacacgaagaatacctctgttgctccaaaactgcccagtttacggacaacaaatcgaaagatgcacctgtgatccgggctacatgcaacagataaaatatacttgcatcgaagagtactttactcctggaggtaatcatatacagtatggtgataaagtagtgagttgtcctctttgtagtggaggaggtagtagcatttgtcgcagaaataacagggattgttcagagtccacttgtcgtccaccgtcatcttcgtggcatggaagatctggcacaccgaacacttctgtagccgcctctgcatctggaatgtcatgagagggtattccgcttggttctgtgtgtcctccgggtggatcaacctcatgtccctgatcacaatcatgtgtttgcagtttccctgaaaacgtatgtgcagggtattgtcagaaacatgggggaaagggttgtagatctctacctcaaccatcatacattactacagcttcaagttaatcgattttagatttcatcacaaaacatagataacaaacaacacaaggtttgattgtgactaaatgacgatttgatttccacaaaaaaagtgatgcagaaacatcacaacaataaaggcataaggagaatagataagaacctgatgacagtagaggtacccagcaccgagacggaagttcagatcagaaaagcgagtcttttccatttttgcagatttaaaatcaggaacatttgaaacattcaaacccatcagtaaatccttttgtcgtttcttcagcacaccagaagtaatggcatcccacttctcttccgcctcatttctggaatttttaatccagtcaagtataggtttactataatcaacagtagaacgccttgtgtcattatagaatgtgtcctgacaatagagagcgttgattaatacagttgcaattctttaagaacacacagcaaatttctgttcacagatgcatacctcaataagaaaataaccagaatgaacgtgttgctttgccacattcatcagcttgtctttgaaacagtaaatattgtctctaagatctgtaaggagctggcttcccaacactagaaattcctggctctgcaaggaaaggagatcaccaaaaaatttattccccacatatttcaccctacaaataagtataccaaaaaatatatgtatataagtcattactttcacagagccatatctcttctcataaacttccacacacagaagtacttctggatagactacaggtctgtgctccccaggtttgaaagttttgttctgggataacaaaaatggttagtgtgaaatttgagacaaatgagccacttgtgtaaaagagcaaatgaaataggctatagtttttaatgcaaaccttccaagttgtgctgatgtacctaagagattttgcaacatcaactttctcagctgatggcttagaaactttggccaacacagaatcaccactgcgttcaaaaaaatatgtttatagaaggctgtaatgaaaacaatataacagataaaatcaaatcatctagttatggccataagtgcatagcctggacagctgtattttatacttatcttattctctagtggctcagttataaaaaggaagcaaactattcctaccgggcataccatatatgatttacataaatgggctaataaataggatacatgagtaaatgtatgggctaatcaaaatccagtattaaggggaggtaaatttctatacctagttagttcagccagcacagaagtaccaattttttactgaaacatgaatctagccaaactgggctgcatcctgctatcatctgaaccacaaagaacgatttacattacttttacactgttatttgccacagcccatcagtaaaagttcaaattacttatcaacagaaattccacagctcttcagcaaagctgtgataacaccatcccattcggtagaaaattaaataatatatatctatgagcttatggcacaatcagaaaatggaattactaacaatacatacccacaaatcaaggtcaaataaatacatgcccacaaagttaactgttttacctgaatgagtgcaagctggctgcatgtttgtcttcctcttgtttggccttaatttctgccatcttcactgctttagtaagatagctcccctagttatagccatgccacaacatatgatgacgcaaaaccatggtcagattttccagagattaacaatagatgcaagaagaagagggaaatatgtatatatatttttttagagaaaactactatacaagataaattcatcagaaaatgcatgcaattaagcagagatgcaacattagggtaaggcatacttgtaaaatatgtgctcgaacttctctatcaaaatgcctgcctctctttttgccctttccgcattttgtatctccatctgcgcctgcagcataatgtggaacaacttccagatcctcgacaggtggtacagactcatgtgaaacaacttccagattctcgcctaatgaatttgaagtggtatttccaccttttttcattcttcctctggatttccccttcatgccacctgttttcccttcgatgccttgttgtggtacgtatggtacaactgccgtgtcaacagatggtccaggtatctccgtttcaactgacgaatttaaggtcggagtgacattttttcgcttcctgcctctagtttccccttttacccctcttgttttaccgttgtttccatgcacatgtggtatgcttgccgtatcctcagtaggtgatctggaagtctctctctcacctgatgagcttgatgtgatagcaccatttccaaaggtggaactagctgacattctgcatgtgatagttcgaaagaacatcagaccctatcattttgtgagccacataagacatgaatattaaatataataatatgaaaagaaaatttagatgccaggaattcagctacaagccataaaaattgaaaagagatgatttggtgcataaagtgcaaaccgctgttccatgctaccaattcacaatagaactttctttatgagttggcatggaatgacgctatccaacaattaaccgtccgtgttgcatctaattccaactcgcataaaagaagcaccaatcaagcaaaaatagcttaccctccatcaatcctctgatcctccagctgtgacaaagcagtggaatcccagccctcctaaaaacaccaaataacagagacatcacatcaaaatattgttcacaaaactagaactacaattaagcacattagcataagctcgataggaacggtcacctccatagcctcccggagagcgcgctccaccagctcctcctctgagaggaccctcaactcatctacgctgcagaatccacaaaatgtacaaaccagaacacgaataagcatatgaacaacatgacagacactgggggatttctccacctgatacggcggaatttggggggcttaccagagctcttcgtcgaattcatcaccaggatcgcccaattcatctttcagcgactgctcgcaaagtaacacagaacgcgattacaccaaagcaagggcacggattgaagagctagggtttggcggtgtgctcaaggggattcgaacctgcagctcgtggagcgcggaggacatgaactcggggaccgtggagacgggtccgaccatgaaggggacgaacacgggcccgccacgagcgaagggcatgcgccgctgctcgccggcggcagagctctccgcctcctcccccgccgccgccgccgccatcgccgtgtgtccgcctctttcgctggttgggggggttttcggcgccaatgcggtgggaagaaggctaaaagctactgggcccagtataaagcccaatatgaagaatcactactgggccgtcgtcgtctccgtcgagtatcgtctcgctccagagcactcggctggcgggcgaattttttttttaatatttacagaaataatctatcgaccaaaaaaattgcagaaatagcccctgccgccccaatggtgggcggcaagctgacgtggcagacggtgggtcgaccacgccgtctgccgccgtcggccaaaattgcgattagaccctagggcggcaaggggctaattgcaattttggccgcccataaagagcttgcggccgtaattttttcatctgggtcccttgccgccccaatagagagcgacaagggacccaaatgaaaaaagtacggccaaaagatatttctatgttatgttaataataaataaagaagtatttattggtaaaacttgttaatattgttataaaaatgtattgaagttggttgttgcgcaatttcatatgttaagtgaggtattattttgtaccttattcgatgtattagtactcagataatttatataggcctatcgcagtctgggtcatagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatatagtaatgggacaaggaagcatgacagtagaaatttcaatatgctaagttgtccgataatagctaacccctacgtgaggatccctctcctctctcaaaccgcgctttagtaaccctgtattgctctggtagttcaagctgcacaacacggctaggtggagttagaacccttctggtatctatccattctctgtattgacatctccttggtggttcctgggaggaaagattaaatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacaaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcaaccttcttgtaaacaagtggttaggtcgagaacgggattttctgtatcgacccactcgatgtatgcacaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattaattggcatcgatcaccgcataggcagagaggacgctggcaccaaggtggtagtaggtatacacaaggatcgctacgccagtttggatcctcaacaccccggcgtctagccattgacgaaagccggttggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagttacatgcatgatcggcgccgaaagttacattggtcgtatgcgccaaatggcgggcaaatatcgtatcgcacgcgaataaaggaggctgcatcggtgcggcagaaagtagtcatgcatgcgccgaaaggtatcgtgcatgcgccgaaaggtatcgtgcacatataacaacaacgtagtcattacacaagcatacagtactgaaaagtgaagcaaataaacaaagagaagattgctctactggccctgccccgcgccgcgaccacgcttggtcctccgggcctgtgctcgcacgtagtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacatcctctgtcgagcctgaagcgaagtcgaagtcaaagtcagtgatgtcgaagagcaaggtggaaggcagcaagcggtccgacgaggtcccagcatggtccagtggtggaccctgactcgacgtgccggctgcctgtgatgaagtcccggtgtactgccagaactgcgctaagtgcgaggtcgacgcagctgcctgagacgctgaccttgcagcctgggagaagtgggcggcctgcgtcatagcgaactgggcgaaacctacacatcgacaacgggacccttgtaagctaagacataatgcatgtaaattgattgtcgaagtaatgttgtttttttaagtacctgtggggggcacaacagaaggcctagccgaggaaggcggggtgctgaacggtgcacgaaaccctgaagcaatcggcaggtgaaacggctcacttatatgtgcgaggcatgtacagaaatagtaataaaaatacttacctccgtgcggagggggagtcggcctaggaacgtgcgcagctggacggggaccagtcagtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaatgttggatcgtcgttgaaccatcaacgacgacccggttgatgtcgtcgacctgcatggttaatttgttcgtaaatattcgtaaaatttgatgaagagaaagacatgaaaacataaaggaatggtgcgatgcagggtactcacagcacgagcgaagtcctggtcgtggtgcctggcgtagaggtctctagtgctcgcaacgtggggctgctgctccaagggagcgaaggtgaccctagtacgggtgcgtggctggtaccagcgtaggtaggcctggtacgcctcctcagtgtgtggctctccctcgtggtccacgacctcctcggttgcgaggaaccagtcctcaacaaaagtcgccaacgttactagtgcgaaacgtgccgtcagatcgtcctaccagtccacagccgtggtcactggcccaacagcgtctcccgcgagcggtagccccaacaagtacgatacgtcctgcagggtaggggctacctcaccgcacggcaagtgaaaagtgtgtgactctggcctccatcggtcgaccaaagctgctaggagggacctgtccacagtctattgtctggccgggtccgcgtcgccggcggcagcctccaccagccgacacatcggtaggaggccggcctcacgcagcctgcaataacaaattaatatgtcattataaaaaatattacagcgcaactaacttatagtaatacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatactgacgtgccatctctgaaaaatatagtgtttcgtgttagaacaattcagaaagtagtaatgtaaaacaaaagataatttgcaaaattatgaaatagtaataaaatcatgagaataattatgtacaacaagagtacaggctatttaaatatagcaaacgttactaatggtacactccgatgacgtgcaatttaacatatatgtagagctcgataatataacataacattacgtgtcgaagtccgacatacatcagcatacctaaagacgttaggcgccttagtccgacgttacatcacgagaccaaaagacatgacatgccgaagtctgacattacacgacgaaacatagaacataagaactacaccacggagccagacgtggcacgacgacgcctaggacgtggtcgagtggaggtagtgccttcacccgtagggcgagctccatctgctgttgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactatgacacatatattgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatactcatgcctgccttatcttgacatagtatctcaaacctgtgctgttgggtaccttgcactagagctcgatgtttcatggcctttttatgcaactcctctagctttttctgcatgaaagctccaaacaaaatgctgttattcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagctgctgcacgctgatcactgcatttggctgtcaactcatctaatctcttccaaagctcattgaattttttctcctggttatgattgcacagcctcttgaacatgttcatgagctccttgttcttgaattgcttgaagaaatcagcccccatatgacgcatgccccacctactctatacatcttcccaaacaccggggtatcctcgttccatactcccaaactgcaactcttctatcgctcgcagaatgccaacgtgcctatcatgtatcatgctcacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgctatcttgcatgcatgtagagctaagaacgccctttgcagcacactcttgccaggatgttcaattgaggggaatttcttcacttcgtaagagctctcagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatatgcgtgcactctccagggacaaccatcttttttcttaacacaccgaacttcatattgcgaccggttcgacttggcaacccaaaactctctatgaagtgacactgcaaaatgttttactgcttccttcatatcttcttctctactataaatcgctccctgaataacctcattttctttgtgctcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccacttcacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaactatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaatgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatctggcagggcttcgccccttcttctcttctcctcccctctcttcttttttttttcactggaattgaggagggaagaatgagggctgggggctaggcggcaggccttttataggcagcgaggcctgccgcccggctagagggcggcaaggggccgcctgcaaaatggccggccccgactggcttttttgcattcgggccccttgccgccccaccagagggcggcaagggttttcctgcaaaaaaaccctccctccgtcaccgcccgttcctcccccgtttgccacgtcaacttgccgccctagaggtgggcggtatggtctatttttgtaatttttttggccgatagattatttctgtaaatattttaaaaaaaatctaaaaccgaaaaaaattcgctggcgggctgggtgctctccaccgccgacccgtgactcggcccggtcgcaacgccgccaagctactccactatatccagtattatggttcattgataccgattagatttagctactagatgttaagagagttacagtaaacttattcctatttttattgaaattgaattattcttttatgaaattgaataaagactgttaaattcgcatacccaagggtactaaggccctgtttgttttagtttaaaattattgtaatctagattattgagtcagattattataagttggattataaaaagcctacatagaataagctgttagctgtttgtttctctgaatcattagctctacatagaataagttgttagctgtttgtttctctgaattattagctagttgttaggtgttagccacccagtatagctgtttgtttctcggaattattagctagttgttaggtgttagccacccagtaatctaaaaaaacacctttagagtggataactagattatagtaatctagcttatagattataataatctatcaaaataagctatctgtttgtttcatcttacttctattaatctatattataatagaagtaagatgaaacaaacatatagcttattatgatagattattacaatctataaatccactctaaatgtgtttttcttagattattgagtgactaacagctaacaaacagttaataatcaagagaaagagaaacaaacaatcaggtttggaaattccagtcatttcggacctcctttgatacgatattatttcggccaaaattttattttttttaacttttcatgaatttcagtaatatttgttcaaaatttcggactaaaatttcagaaaatttggtctatcggtgacctncgatacagtcgggcaatccaatataatcaaaccgtgcaaacaagttattctatatcagcttgttataatacagcttatagtaatctagatcaataatctagattacaattaagttgtaacaaatagagcctgaatcaataagcatgtaaaatggatctcagccataatagattaccaaagtcatgtttatgcgtcacttacaaagttatgcttatgcgtcatgtccaaatacgtgctcattcaaataattggtttccataagcaggtttcaggtgctacagagaaataagaaatatctatcaggtttccgttgcacaaagagaaaagaagttcccatgagtcatcgcttgtcaaacgttgtttgacgatatccttctcccaattattatccatgagcgccaattatcatccataagtcatcgcttgttgtttgacgatatcttctcctaattattatctcgttttcaatctaagataattttccgtgaaaactcgataaaaaagaggaaactcggtaaaaaaaaaaagagtactgggattgctggttctcgttctagttcgttgaacatcaatttcacaaataagataatccaattcatgaacatcaatttcacaaaaaagataatccttacactgctatctaatcaaagtataaccctccagtctctccaggattgctatctaatcagtctctccaggtttgctatctaatcaaagtatcgatcgaaaatccatcagtttatccaggatttcatcaacacagaagtccagcgagctctgatcgtcccctcctcgcagcggctttttccatctctgcataaatcaaactactatatacacaaaacattctcaaaaacaaaatctttagtcaaaaaaacactcacggttcaaatgactaccgtttcgccgtcgtcgaacgaccacagccgcagcggttcgccgccgtcgtcgtccggcaagactaccgtttcgccgtcgtcgaacgaccacagccgcagcggttcgccgccgtcgtcgtccggcaggaggctttgtggaggagggatcgcgtgttcgcgccagattgcttcgaatcggttgtgctcgatcatgtacccgcccaagttgatgtgctcgccgtcgtacgcgacgccgttcccgctcgccgccggcggcggcgcggcatcctcctgggagtccaccatgagcgcgcccgcgtgagcgtgcgcgtgcgcgcgctcgagcgagacactttgttcagcctcgtcggcggccttctggatcgtgtcgctcgcggcggccagggagacgtcgatggatcggagaagctccagtagctccacgtcgggcatggcggcgatgccgtccacctgcgccgccgccatggccaactcgccgccgccgccgccgggtccttgctttgcggcggcttggttctcgcagtaggaggcgttgtccacggagtgcttccgccgatccttctccggcagcgatttgtaccgagtggcgatcgcccagacctcctccttcgacggccaccacgtcggctcgcccccggcgccgacgcccgggcagatcacggcgacggggacgtcgcaccgcgtcgcgagcgagctcgccttcctcaccagcctctccttcctcatctccaacgccgcgcgccgctgctcgccggcgacggcgggggtgacacgagcctctccgccgccgccgccgccgcgcggcatcggtgctcccatcatctcaaacgtgtgcgtgtgctagcagatgaatcttgtgctagcagatgaatctcctctcgcgcgagttttgtaggctgctccccttccgggcccaagaagcgcacggggttgggcctgaacacgacccggagttcccttcttttttttttttttggaaaaagtccacttagactcccttaattgtttaccaaatctaattggtgaccattaactgaaacaccggataggatgactccccgaattattgaaactagtgcaatttgactcctccaacggttttacaggacggttttgctgacgtggcggtgctaacccgattttcattctacgtggcgctttcgtgtcattagaattaaaaaattgtttgtgggacccatttgtcacacacaagaatattatgggacccaccgacatgtggggcccacatgtcatcctttctccttcccttcttcctcctccctctgtctcccttctctctcttttctctcccccttctctgatctgatctcccgggggcgcctcttcggcctcactcgacagcaactcggcgagatcggcgagcgtggtgaccgacgggcggcggcatccatgagagcaggctcccgggggcgcctcttcggcctccctcgacagcaactcggcgagaccggcgtgcgtggtgaccgacgggcggcggcatccatgagagcaggccgggcggcgcacatggagtcggcggcgacgcggcgtggatctctggtggtggtggaagcggggcggagcccgaaccgtcctggctcgcggaggatggccggcggccggtcggcaacgggcgcaaacacccggctctggcggcgaggccctccagggcgggcgccggtcggcgacgggcgctcatccccctggtctccggcgaatggccgttttctctcagatcaatcagcaccatcttttcacaagatggccggatcgagtcaaactagaaagcaacattgtatcaccggggagattccacgccatttgcagctcgacgacatagacacgggcacacggccgatattacgcgtacagcaatctgacaaacgcgttgttattcccctctccaaccttcctcgatcgtatatatggcagcagcgcagcacgtcgtcatccggccatggacgtcacgggagctggtcgcctggtcaggccatggcggagcagggagcggaggggtcgatggcggcgttgagacgaggcgatgcgctcggagccgaggacgccgtgggagcaacgcggcggagggggcccgacgacgccggccgtggacctcggcgcagagggcggaggagatccggcggagaccgaataagggaaggagatcagatcagagaaaagggggagagaaaagagagaggagggagagagagggaggaggaagaaggggaggagaaaggatgatacgtgggtcccacatgtcggtgggtcccataatatattcttgtgtatgaatgacagatgggtcccacaaataattttttaattttaatgccacataagcgccacgtggaatgaaaaccgggttagcaccgccacgtcagcgccacataagccaaaccacactctaaaaccgctggaggagtcaaattgtactggttttaataattcagggagtcatcctacccggttttctagttaagggtcacaaattagattcaatgaactattaagggagtctaaggggactttttcctttttttttttggcaattgcttatttgaccctgttttgccgatttgaccctaccttttgaactttgcttatttgaccctccttttcgagtacgaaggttccgtctgaccctctttcgctgactccgttagggttcaatttttttttaaaaaagaaaatgtttccagagttcctaatggcaaaaataccctccaaagccaaaccctattctgactctctctctctcactcgtgcgtacctctctctcacttgtgtgtgcggcggcggctagctaagggggcggcggcgacggcgagctgagggggcggcggcggcgtcaagcacagccccgccggcgcccgctcgttgtggtggagggcagcggcggcggcgagctgaggcggtggcgacgacgtgatgtacagccacgccggcgccctgtcacgccccgaactagtcccgactggaactagcccgtgacgctccaaattaacctgttaatcgataccagtcccagaaaacagtgctggtatcacaggaagacagaatatcacagcaacagaggtctctttattatagagtagtagtacagttatgttgggctgcggacagaccccgagctcacaactgcattacaaaaggaaaacggaagcaggacttggaccaaacaatacaggcgcgacttgggaactaggccgaaaccctaaaactcatcgtagccggcttgctcctgaaagaactcctcatcagcaggatccgcttcatcttcttcagcaactaggggggaattatttatatagggcaagggtgagtacgggagtactcagcaagccaggggaaataagtgtttaatgcaggcttcaaggagagactggtgtttttgcaattgattttatttgaactcttttctgaaacaactaagtgagtgcttctcaaacgacacggatgagacagtgcgtctcgtccggtcggagtatgtgccatgtatcagtctttagaaatgaaaacaaggttggcacccggccaacagcttttcaacggtcacccgggccaacaacttttcaaacggccacccgggcctagctgatcccatcagctacagattttcaaacgtcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaagatatttccaaagccgacacaggtttaccatatgccgacgagaggggtcccagaccaacaacaggttaggtcccagaccatactgtgccaggaagcccaggggtcctcccagacaccaccccggtgaatccacatgtctcccattccacccatgtggtcgtacttgtcttatgtttggatgaaattccaaggaaacagtccttaagtgcaagagcgggaaaccgtacacccggtacgttccccggtccgcggttttggaaattcatttagttcgcaagcaccgacccaggtgtcgggttttccaagtcttttgcaaaacccaagttttacccaagttgttactcagattttaagtttgaaggcatccgttgatactcgcgcagggtgcacgaatatcgagacgcaactagatggttacaaggggacatggtatcgcaattaacaaagggaggatcaaatgcaacaaaattaggtaggtctgccaatctgccttgcagacgggacaagcagatcaagtgcgatcctatcaatgcataatattttgcaagcaatataattaaatttcaaatataggctcaagatgttcaaaggtggcttgccttgctcgagagctgaagcttgatcctcgaaatcctcgcactgcgggtcttagggctccgaaactacacgcgaaacgggacaactcaacaaacggcgaaaataaagccctattaatgacctctaagcgtgctattagatagatctcgagatttgaggaattttggaagttgaacggagtcaaacggatctacggttgggaggatattgaatttctaagattcttggatttttcgtctaaaggaaaaggatttaattaaatccttattggaaaagaaaagaaaagaaaagaaaagagggatggaaattagacttccctcgggcggctagggcgcggcccgagagaaaaggggcggctcggccgagcttaacgggccggccggcccaagaaggcggctcagaacggcccaagacgcgcgcgcgcgggagggaggagagagagagccggtggaccgggctcaccacgcgcggtcccgggtgggacccgcttgtcagcggcttggctcaccgtgcggagggagcacgcgacgcggcgctagggtggggggaaggacgcgggtgcggcgggcccacgcgtagcctcacggctcgtggtggagcgcgcgcacgggaagggactgaccggggtcggctcgacccggtctaggctgagctggcgccgacgtggcgcctacgtggctgccacgcgggccggcgggaggtagacgacgacgccgaccggaacggacggcggtcgacagcggcgagcggcggagcgaaccacggcgataccggcgaaagcgagcacaccgggtggttgcacgagacgaggggagacgagccaacggctcagattcgccggaggaagcttgacggcggcgaatcgcggcggcggcaaccggcggggagggaagaggggaaacggcgacgaggtcacgaggggccaattcccggcggcgagagcatctatgcggctacgggaatccgatgctagcgtcggattgggcggagctacgccgagcgaggctggcgacgagcgggtgctacggagctcgggcggcgacggcggcgggcacacggtgagcgacggcaacggtcggggcggcgccggctagctacggggaggctactcgtgctaccaccgaaaactaagggggggagatggagcgaggaggaagaacggagggaggcactaccatgaagaggaggggcgctgagacgagaggccgacggcgcgggagtaatctctccggcctcgggccggggaagaggaaggagagggcgcggccaaagtccccttccgcgtcctagtgcgcaccggctcctccggcacacacgtgacggctgcggtcggcgagagggacgacaatggcgcgggcgagaaacagagaagattgggaggggaaaaaggggaagggcgggcgcctgggtttatagggggcggcaatgtcggtttggaaaccgactttggcggtcaaggcgcgggctggcgctccggctagcggccaaaacggcgacaggagggagggaggatgacgccggcgggaggaaaaagggaaaaaggagggggagaaagggggcttgcccccttgccgatttaggaaaaaggaggagggaggcggaggcgtcgcggcagagggaggagggctcggcctccgtcccttggcggcttgcgcgcggagtggcggggccgaggcgatgacggcggcgatgacggcggggcggtttggagcggcgcgacgacacgggcgacaggcgcgggctggcgcggcagagggtgacggcggcggcgaccagacggtcggccactcggcacgcgcgcgcggcttgcagcgggagggcgcggcggatggataggcgcggctcgagcacgcgcgctggctgcggggccgaacggctgctggcgcggcagggtatcggggccgggcggcgcatacgcgatgcgggcgaggaccacgcgggcgcgcgcgcgcgacctacgcgcggggagcgaaaaggagggccggaaaggagggctcggctcggcgcgggcggctcacgcacgcgcggacagaacggtgggagcgcaggaggggcgttctgcgcggcttgcgcgctcgcgcacgcagcgcgcgcggcgcgcgggcggggcggaacggagggagagagagagagggcgccggggagggagggggagatggcccgagagggattcggcccatcgaacccgggggaggcaaacttgacttttgtggaggaatttgatttggagggatttggattcggaattgaactcgatgatagatcggggattgagatcttgagatggcacggacactagacgacaagcgaagaaacaaatttcacaattagggtttttaagagataattttcccgctaggcgccacgacggaacgggcgatacagaccaaccccctaacaagaatctcgaccccgagattcagcacctaagggagcagctccgggaactcggcgtggagaagatcttctcgctcccaggtcgcctcatcttcagaatggttgctccattggactttgtagaacttgatggtcttccttcgagtttgacgttctgcctcttcaagaaccttgattggtctttccttgtaggtcagattcttttccagctcgatattacccagggggacttgctcttctggaactcgaagacatttctttaactgagatacgtggaacacgttgtgcacatctgcgagaccttcaggtaactcaagctgataagccacttcgcctcgtctggcagttatgaggtaggggccgatgtagcggggtgctaacttgccggacatcccaaacctcctcataccacggaggggtgatacccgcaggtacacatgatctcctttttcgaacttaaggtcacgcctccgattgtcagcgtaattcttctgacggttctgcgctgtctttaaatgttctcggattagcttaacttgttcttctgctgccttgagtatgtcaggaccgaataccagcgcttcgcccacctcattccagcacaagggggtgcggcactttcttccgaacattgcctcattcggcgacatctaaatactggcctggtaactgttgttgtataagaactcagcatacggcaaacaacgatcccaagtgccttcgaaatccagggcacacgcacgtagcatgtcttctaggatttggtttactctttctgtctgaccatcggtctgcggatggtaagctgtactaaagtttagatcggttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagccggtttcgtgagctggtccacgattacccaaatggagtcgtacccgctaggggttcttggcaaaccggtgatgaaatccattccgatttcttcccatttccactcgggaattggtaggggctgtagcagaccagcgggcctctgatgctctgccttgactctttggcaaatgtcacacaaggctacgtattctgcgacgtctcgcttcattccagcccaccagaaatatgccttgatatcttggtacatcttcgtacttcctggatgaatggagtaggcggactcatgagcttcttttaggatgagatctcttaattccttcttggccggtacacagatgcgtggaccgcaccaaactgtgccttggtcgtctatggagaaattggtgtctttcttctcctgtattctttttattaactcttttatcccttcgtcgtttttctgagcttcccggatttgcgactctagggtaggctgtactgtcaagctggcagggacacctgactgcaccacggtcagcctcaacttctccaattctctgcacaggcgatcttggtcaggccgtattcgagctacattgcaataggccttgcgacttagcgcatcagcgaccacgttggctttacaggggtggtaatgaattccaagatcgtaatccttgattagttccaaccatcttctctgcctcatatttaactccgtctgtgtgaagatgtacttaaggcttttgtgatcggtgtatacttcacatctgttcccgattaaatagtgcctccagatcttaagagcatgaaccacggctgccaattcgagatcatgggtgggataattgacttcatgaggtctgagctgcctggatgcataggccacaacctttcgttcttgcattaggacacattctaagccttgtcttgatgcatcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcatgggtctggctaacttagagaatccttcgatgaatcttcgataatatccggctaagccaaggaagctgcgaatctctgacacattcttgggcgggttccaagcaagtacagcttcaaccttgctgggatctacttcgacaccgttggaggagatcacgtgtccaaggaatgctactcggtctaaccagaattcgcatttcaaaaatttagcgaatagttgatgatccctgagcttttccattattagcctcaggtgttcagcatgttcttcctcattcttggagtatattaggatgtcatcgatgaacaccacgacaaactagtccaggtattccataaagattttgttcattaagttcatgaagaacactggagcattggtgagtccgaaggacatcactgtgaactcgtatagaccataacgcgttgagaaagcggtcttcgggatatcttcagatctgattttcaattggtggtaacctgatctcaagtcaattttagagaaaactcttgctcctttaagttgatcgagcaaatcgtcaatccgtggcaacgggtacttgttctttatagttacttcattcagggctctatagtcgattaccattctttcagagccatcctttttcttaaccagaagcactggggctccccaaggggatgagctaggtcgcacataacctttactctccaattcttcgatttgtcttttgacttctgctaactcattagctgccattcggtagggtctttttgcaattggtgcggtgcctggtgccagttctatggcgaactcaatctctcggtctggtggcatactcgttaattcttctggaaatacgtcgggatattcacagactatgggcaccgactccaaggaggtgacttgtaaacaggttaagatagaccgacttgcggtaggactgttagaggtaaagcggacttgctttcctccaggtccttgcaaagtgatggacttttcggcacaatctatctgtcctttgtgctttgccaaccaatccatccctaggatgatgtccaagctttgcgagtctaggactatcggtttggctaggaagtcaacttcctcaattctaaggttaacttccgggcatatttgagttgcccttatatccctcccaggggaatgtactatcatcggtacacgtaaattttgggttttccaaccatttcttttcacaaaagcttgtgatatgaaggagtgggaagctcctgaatcaaacagaactattgcgggtatggagttgacagagaacatacccatcacaacgtctggagcatcctgagcagtctcggcttgaatgtggttcactcggcctcgaccaaagttgttggacgcatgagaaccttgtccacttgcctgggagctaggacgagactgagctgccgctggagtaggagttctagcagtgctgccattagcatgccctgagctggtgttggtaggattctgagggcactgtctagcatagtgacccatctggttgcaccggaaacactgaactgctgacggtccctgcggtgacttgaaagaggtaacactgtttggcgcagtattgccactaggggcacgctgctgtggctggggtgccggacggttcatctgaggacgaggggcgtagcctggctggcggttagcttgagtgaccgactgatggtattgcatgggttgaccgtagcgagggcgaggtgcgcctcaggaagaatttccctgatggttagacttgcgtttcttgtattcttcggtagcctcttttctggcatcctcaagtagaagtgccttgttgatcatatgttgaaaagtagggaagtcatgagcaagcaactggagtctcattccaactgcgattcccttcaagaacttcctgatcttcttcttgtctgtgtccacttcctcaggggcataccgagccaacttgttgaactgacttaggtactcattgacattgctgttgccttgcttaagtctgttgaattcctctttcttcatgtcaatggtgctttcaggtacatgagctgcacggaaagctgtagcaaactcatcccaagcaatgttagtgggttcagggtgtgcattgcagtaattctcccaccaatctgcagcaggtcctcttagctggtgagaggcgtagagcgtcttctcaacaggggtacactgcactaagttgaattttctatcaacatctttcagccaatcgtcagcctcgacgggctcgacggtctgagagaactctggcggacgagacctcagaaaatctgtcagcttggatctattgttgctcatgtgagggtggccatttccatgcgcattatgctgaaaaccggctacggctgcggctaatccttgcaagatttgtgtctgaactgccattaagtgctgcatgttgttttccacatgaggtggggaagggaggcgttcttctccagaattgtgactggcagtgtggtgagagcggtgagactgttccatctctgcatcacaggaagccgtgcgatgcgagcggttgctgcggcggggttgctcaacttctgcgttgcgggaagcagtacggtgcgaacggttgctgtggggagactgctcatgatttacttctggctcggctctaccatcttcaaaaccaaagcgggctggcgcacgagctgcacggcgggggcggctagccatctaaactcccagaagagggcggggtaagaatcagataagcacttaggagggcaaggagcaaagtaaatagcaactcagatagcacacactaggcataaactggatttttcaaatcataaaaacacctgatacaacgggtgtggacaagtcacagagctacaccgagcttgactgtgcgcacaccacctaggagaaccagactaccaaacaacacccacaacaaacacacgcacgcactacctcgccacgactccaaaagagttggcggcggaacaaaagggcctagcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtaggggagctgggtagtggaaatggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtgacaggggcggcctgagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcccccgagacggtggctgtagtcgtgggccaggcgacgaagcgcagtccaggagaggtcctggtacgcgatctggagagtgggcctggccaaagtgaagtggtgtgggcaaggccagctccgtgtatacctccacgggggtagaggtacacagagagctcacagtgagggggaacacggcccacggagtaccccgtgtactcgggacacgagaagccaaggaaacgggcgaggtcacgaagctgagcgacgtggtgaccctcaccaaaaccatgggaactgaagctggcgttcactgccatctacaattttgaaagagggagaaagatcagtaaccattttagaaacaaactattgaaaataaggaaaccaaaagaagccttagcttttcgcaagtagttttgaacttagtatccttagggtcgtcctaaacatcgggtttcgccctagggccaagcctgtgctctgataccatctcttgtcacaccccgaactagtcccgactggaactagcccgtgacgctccaaattaacctgttaatcgataccagtcccaggaaacagtgctggtatcacaggaagacagaatatcacagcaacagaggtctctttattatagagtagtagtacagtcatgttgggctgcggacagaccccgagctcacaactgcattacaaaaggaaaacggaagcaggacttggaccaaacaatacaggcgcgacttgggaactaggccgaaaccctaaaactcatcgtagccggcttgctcctgaaagaactcctcatcagcaggatccgcttcatcttcttcagcaactgggggggaattatttatatagagcaagggtgagtacgggagtactcagcaagccaggggaaataagtgtttaatgcaggcttcaaggagagactggtgtttttgcaattgattttatttgaactcttttctgaaacaactaagtgagtgcttctcaaacgacacggatgagacagtgcgtctcgtccggtcggagtatgtgccatgtatcaatctttagaaatgaaaacaaggttggcacccggccaacagcttttcaacggccacccgggcctacaacttttcaaacggccacccgggcctagctgatcccatcagctacagattttcaaacgtcgaaccccttttcacaacagcaatttcacaagcagtagtcaaacaaaactacgctatgaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggtatttccaaagctgacacaggtttaccatatgccgacgagaggggtcccagaccaacaacaggttaggtcccagaccatactgtgccaggaagcccaggggtcctccccgacaccaccccggcgaatccacatgtctctcggcatcaaggcacccctgataagctagttactcagccaggggtgtcccattccacccatatggtcgtacttgtcttatgtttggatgaaattccaaggaaacggtccttaagtgcaagaacgggaaaccgtacacccggtatgttccccggtccgcggttttggaaattcatttagttcgcaagcaccgacccaggtgtcgggttttccaagtcttttgcaaaacccaagtttttacccaagttgttactcagattttaagtttgaaggcgtccgtcgatactcgcgcagggtgcacgaatatcgagacgcaactagatggttacaaggggacatggtatcgcaattaacaaagggaggatcaaatgcaacaaaattaggtaggtccgccaatctgccttgcagacgggacaagcagatcaagtgcgatcctatcagtgcataatattttgcaagcaatataattaaatttcaaatataggctcaagatggtcaaaggtggcttgccttgctcgagagctgaagcttgatcctcgaaatcctcgcactgcgggtcttcgggctccgaaactacacgcgaaacgggacaactcaacaaacggcgaaaataaagccctattaatgacctctaagcgtgccattagattgat

SEQ ID NO: 14256 - DNA, 4191 bp, Oryza sativa
gaactcctctctttaccaagaatgtattattatacccaagtactaccgagtaccaccatcatgtaacttcagcatcataccatagtaccaccatacatgctctggcgaactgactagtagtggcacaccgaatgactttcagaaaagggtcatgacacacatcatacacaagagtacaagacctcacgcacctgactcatactcaacgtacgacgactatacacacacgagctaatcagcagcaattcgtaacttgttttccgtaataagtaatgtactagttcttccatctactagtactactaagtacagaactttctcctttcctatcgaaatgacagcccagagccacaggtaagtaggcagttaggcactgcttgagatagctgaaattgatgatttttctatagttatctgagagtataaacaaattaataattaactcttataaacgtaaaagatattctaaaaagtatttaaagaatattttatataactttctttttaggaaaatcaccgtttacaagctttggagttaggaagcgccaaatgccacggtaatactgtgttcgtatagtggattataaactaatccttcacacttgtaaaaaagaaacagatcagtatataattaattaagtactaattaaaaaaattaaaatagattactatgatttcaaagcaattataataatatttaatagtttgaaaagcgtacgcacaaaaagcaagctagtactatagaaattaggaaagggagaaagaacacacccaaaagtacacaagattacgcaggtttcgtcacggctgtaatcaaagcctggacctggtcaccgtaatggcgaagtggtgaaaaaggcaggggggtgggaaattaaaggcgcatggcgcgggcaaagcgtgcagagggggggccggccaaccaaggaatcattgtgatttggccatggttggaaagaaaagcggccacctttcgctgctttctcgctaaacatgcgtgtcctcgagtccagccgcagcccggccgcgggcaggcgctgccgaccgggcggccggccgggacgaccaccgccccggccctccatcgactatcacccggtcagtgcgtgacaaaagcatcggacacgcacactcattgtttgccatcatcatacagccccaggacttgctcccaaaagccaccacctttactgccactctccctctcagaggttgacaggtggtaacagatagagaggtgtttacacagagtgctgctctttttaggtaaaataatgcagatgggatgagaaactagtggataatctacttgcttatctgtaggaaagaattaaatattatgggtctgttgggataacgggacatgaaaaaaagagagtaaatttcagaaaactatagatagtatgactaaattatcacaaaactacacatttaacactaaatttatcacaaaactacacatttaagatgaagtatcacaaaactacatgtttagtaactaaattatcacaaaactacaggtttagaaccaatttaatcacaaagtaataatgtttatagctccaccataacaagggtgctaaggatttaaactccaaaagttgtagttttgtgataagttcaatattaaatatgcatttttgtgatatttaacctaaaatatgtagttttgtgataaatttggtgttaaatatgtagttttgtgatataactccttaaatctgtagttttgtgataatttggtcaaaatacctgtagttttgtgaaatttactcaaaaaaaaaaagagagaaatgagggcttggatgaaatgatgtggtaaaattggatggctagaacttaaagttatcttttaatggcgggaaatcatttttattttccatcgtccaaacaaaccatatatcttataaatataacaaatggcctataataattggtataaataatgcttgcatagaaagttttcagaagaaaccgtgttttatatgcatggcatgaataatctgtaatgatatcgggctgataagctgaaaatactctttatttagaaaaaagttttacacaaatataagtatagccttctatttagatttatgtgtaaaagttaatttattttgaaacgaagtaagcatgggccttgacaagagtgagcgagcaagatgggacaggatgaacagtattatgactgcactaaagacactaaactcgtaaagcaagggccaaggggtaatacctccgtcccatattaattgtcttttcgagtttttgtttatcaatgtttgatcattcatcttatttaaaaaattttgaaattattatttattttgtttgtcatttgctttattatcaaaagtactttacatatgacttatctttttttatatttgcactaatttttcaaataaaatgaatggtcaaacattgcaaataaaaagtcaaaaacgtcacctattatgtgggagtaataggtaatagggtggtgcgtgagatgagagcgtacgagcgtgaagcaagcagcagtagcagactggcagtgcagcactcattgcctcggttcagtaacagctaaacacactgccctgcttggctgctttgggcgcttgctttcttgtgggctttctgcaaagtttcggtacgtgtgtgcccccacattctctttaccccctctcctcctcgagctttttcgcgtggctatgtatacatgcacacagccaccagctcccttgctcatctgcatgcggccgtgttgctactgaccaatgcctagctagcaagctccactacagctttgaccactgagccgttgctgctgctcacctgtctcctgaaatcgttgggagtcatcgatcgtcttcttcgtctcctcctcctcttcgcgatctgattcttttctgtcactgcgttatggaggtgagccatggagaaatgctttgcatttcgttgcctttctcttcttcactaatctctatctcagttcttggcttcttgtggcaaaactagcttgtgttctactatctagccttggatccttttttttgccatgtagagatgtggtgtttgtactgctcttaatagtagagccttttctaggaagaaaagaacgggtgatgttctgctgcattggcatatactgttctgattttctgaatctcctgatcacctcaaagttttctttatccaatgagaggttgactcaaagattcagttctcagatgcctctttatcaacgtccctgcttcctgcatatcttttctgtttttcacaaacatatatgtaggatgagttgctacaaaagataagttaacagtaaagattgttccattctctgacaggcgctcgatgactgcaagtggcgccaaatcccggcgttcggcgactggaatatatggaatgatatgcccgtcacccaatacttcgagtcagggactttcttcttcacagcacaagcagagaaagatgaggacctcttcaaggtgccccagttccctgccaacccctacaactacaagaaggtctgacaaaaaaaaaacttgaacttttcttcagtcttcttcacctaactattatcatatcagtttagttcagttttaagtcatagcgttgctgcaaaagaacaaacggttagactgatgatttcgtgaccaaaatgcagtgcgttgttcgagtgaaaggggagaaagaaaacgcgaatgcgaatgcgaatgctgtgcgtgtgagaaagggaggaaggaagcagcagtatctgaatgagcagcagaagtggaagccaaagacggcagtggatgaggacctgtacaagatctcaccaaagctaatctgcagggtgaagaaggcaagtagtagtacactgtaattgtgttttgttccaaaatctgtgcatctttgctgggcccttgtgtgtgatgaccaagtggcttttactttagttaccttctagtactatcatgtgattgacacaaaccttttttgagataagctgagcctttgcaattagcttttcttaggataatagcaacactcacacactaccctttttgttcaaaaagcttaagtagtgcatttgtagaacacttggagcttattaatcgagattaaagttggactgtaaatttcagggagatctagttgaacttgactgcgatttttttcctaatctaattataatcttttgtttgtgctgcagaagaagtt

SEQ ID NO: 14257 - DNA, 222 bp, Oryza sativa
gtagcccccacagctcgcggccctcgccccctcagatcggcgccgccccgcgcccgatcaaaccgtcgccgccgccggcctctatctccacgagcgggcgtgtagcgcccgttccgtcgtggcgcctagcgggaaaattatctcttaaaaaccctaattgtgaaatttgtttcttcgcttgtcgtctagtgtccgtgccatctcaagatctgaatccccgat

SEQ ID NO: 14258 - DNA, 353 bp, Oryza sativa
tgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatcaaaggctacatcggtatctgaaagatggagggaatacaaatagagaataagatgatgctggccgataaggtacgaccttaaatggaatttagataggaacaaatgcttcaaagcaaccgaaccgccgccagccattcaccatccatccagccagccatccagccagccatccagccagccaac

SEQ ID NO: 14259 - DNA, 1474 bp, Oryza sativa
ctgcaagtagttcatcactgatcttatttttttagtgcagcatctattataaaatttctcattataattaataaactctgctaggaatttaaaattagattcaccaaaaaaatatcatggcagaaatagtggctcagctcacataaggtcaagatataaacataatggctggcttgcagcttatggatgctaaacatgtcttgaatcttaaaactaatgatacaaatttaatattaggtcaaacaaaacagcaacctctggattttggggcttatactgtttgtgctttgcatgtgtccgaaacaaaaagaaaaggtttgcactttgcatagcattatcagcagttttaacaaacaactttcaaattgtcaatgattagcaagctgaactatttaataactacaaccccccaaccccccccccccaccaaaaaaaaaagaccacattttataagaaaagatagctcaaacacacaaaaaaaaaagttttcactttgcataacattatcagctgattttaacaaacaactttcaaatcgtccatgattagcaggctgatcaaatttattaaccagcacccccaattattccatttctgcgcacaaaaatgaattagcaagcaactcaattgtggagtactggcagtgaaccactccaccaaaacagcaaagaaagataacgcaacactccgtgcattacctcgccatcagccgcgggctccggctgggagtgccgcagcaccggcggcgcagcccgaagcgctagcgtggtctcatcgtcctcaagctcacgcgcggacttgacgatggggagcttcttgtgaatgtcgagcgggcgcggcctgaaggagagcctactcatggccgcaacttcatcagcgaggcctcaatggagagccttcccttcccgcggggggcacgggagagcgcccgcgcgggacgagccccccgcactacgccgaaccccgtgggcgagggggtgaggggtggtcgagggcacggccgcgggcggcgcggggagcgggcgggagcggaggaggcggcggagatggcggagaggggattccggggcggtggggtgccggaacgggcggattggggagctagggttagggtttcgggggtggaggacgtgccctagggtttgaaacggggagatggagggaagaagcgggggatgaagcagcgagagagaaagagtcgaggggaaggggaaggacagagaggcttggttcggttgacggcgtattccacgagtacgtttccctcgtgtggttacgtatccgtctcaacggtccatatcctatggacacataggcttcccatgtatgcgaactatcaaataaaattcgaaaataaattggacgcatactttcaatagtattacacctacatgtgaaatcttaccttcaaattcaatatattttagccgtagcaaaaacgacaaaattctgatagaaaattacccttaaaact

SEQ ID NO: 14260 - DNA, 7862 bp, Oryza sativa
aaaatataatgaaaaagaatatgaaatatgtgtaaaaaatatatattttgtagaatttttcgtgatactttctaattggtgtgcacgggaagatatgttcccctttccagacaggtggtgaaaatccttttcgcgtgttattttggtaacatttggtttgggggagtttgagaatgctaatggaagcataggagattagagcattttaatctttgaagaacatgggaatttgagagagattgaaatgggaaattgatcgaactcccatcgattccatcccaaccgttcatcataaattatgataataatttcttatctcaaaacccacaaccgaacaaataacataaattcccttttaaacatcccctattatttctctctagcaactaaataaggaattgacagcatgtttggttagggggaattgttaacagggatggaactttgagaggtacaacctactgtttggttggtggatgtggaagcttgtgagggatttgagaaggagtttaaagagcaaactcccaattgggtaagggcatgtaatttctagggaatttcttttctaagtatgacgagataaatctgagctttacatcatcacttaaaattcaattatcatccatactacccatgattctcatctctactaccaaataaaagactgggaataaaaaaatgaaactcccataactcactcctctaaaacttccaatcccctttcattctcttggcaaacaaaccatgggactaaaaattaaattctgatattaattctctttgtcaacttccatagttatttttcatgcccttcctgatcgttgccatacaagctgaaacttggatattgacaggaagaaatccaaataaccccatgagcttacaccctagagttttatatgagcatacccccaaaatgaaaccaatcccaacattttggatttcctttttttttttgaaaaatcggctccaacagttcccctctacagatatgcaaaaatttaatttgcaactccatatttctcgctcttcacaagctggatgtggtttctcactcccaatccgtcgatctaagggtgttagacatgtgcaggaggggatcagggactcgcaacgcacggaaagaggccaccgatcacaccatacgcgaggaggacagtgaaccaatgattctcttggtatgggatggacctatttttttattactgggagttaacatttatttatcttcttacagggatgaatctattcacacctaaaaatctgattacggattcaagaatataattttgggatgtatttttgggctttcttttggcaattatctagaccattgactcttgaactaccttatttgatctaataactcttctttttaactcataaaattttattgtatattaagcagtgtacattggaagcgaagaacattccctaaaacatcaccatgcaaaaaattaacaacagcaaacattaaggaccatatttctgaaagaaggtaaagagattgaatggtggaagcaaactctcatactatctgatacaacagtagtggatacaatcatcgggggcccatggcattgctgcgatgattgcacccaagggcctcttcaaacatgattcccgcttgacctgccagcaatccctccgactgcctccacagatttggcactaattgaggtttggggttgagtcgtagatatgttggtggcttcaccgaactcaaccgatgattgccatggaggtcaacgtcaaatctaaggaacactatcagcattcctgctgaccaaaatcttaagcttttgaaatagaaatcatatattttacattttccctgtttttgttttcatacatgaaggccttgctatcgttccatgtggagaatgccccccttatggcacggtttagtctgttattttcttttgtcagaatggattcggaccgccacttctctaaaagcatggttcttacctccctctctcccccctccttcagggtcgtccattcggtgggtgatcccttgctctcaccttcggattttgatagttctgatgatatggcgaattgcagttatcttggtgaattgacttacatgagagtcgaccatgtagacaaactgcttataccaccaataaaataaaagttatataccaagagcggatgtttactcattgactattctttttaagccatatgtgacaattttatgttctccttaatattgcgtcgtggcccaatgagtgcgttggcatgacaaaaatgttgagtcacatgttgtgcgggcaaaaccacttcgcaaaaccctagagggtcatttggaccaaatgagaaagttcaaggaacttaatacccactttaacagttcatgatgatacatgcctccaagataaacgtttagggggtatatggactttttccatattgatatgtatcgatgttgtaaatttgcttccaccgctaactaagggcctattctaagctttaactccaaacgacagcttcctcgttttctgttagcatgcttccaaactactaaacaaagtattttatgaaaaaaaaattatatatagaagtttttaaaataatcaaataaatctatttttattttataatacttaactaattatgtgctaattagctttctcctttcgcgtacactgaaaatctccctccatcgtcaataaacaaacacatcctaaataattgaagttgtgtaagaataaaacatatatataacagttaataagaagtaggttacttgaactattatatgtttctttttttaaaaaaagaagaaataacgtactcagcgcataattcaatttgaatatctggctacaaaacacaagcattttaaactctaatgaaacaacatgttatcgtacaaacaaatctaaccctcagaatataataacaaaaccatttccttaaaactaaacatttttggtgaacttagtactactaataaagttggatatcatagcattcacaaaataacttcatcctccatttcacattataagatgttttgggttttgaatagattctttcatagatccatgtatatgcttcacatatgtgtctaaatgtatatggatgttagtaaatctagacaagagatgaagagataaaaatgtcttataatatgaaacggagaaaataatacttagttaacaatgcgtctcattttgcatgcaacttataagctccctaactcagtttcgaactaagcctaagccaagagcatttacaacgctccactcttgcatgtggccttaagtatccacctcagagccgagcgatcatcttagtggcaaaagtggtcttacccaccttcatgtgccttacagaagacacaacgccctggccccaaaaggactaggatgagaggggagagaggtggctggtgacatagatgaagaaggacgcatgacttagctagatcgacgatatcagctcctagatcgaagtgaccatgatggattgatgactagacctggtggattaaggcaaccgcacctgattgagggacccaataaccacctgggattggaaagagagagcttcatgattgtgagttgcaaggggagagatggtggtggtagtgactgaggatgctgaggagatgacgtcgttgatatttggttgtggaagaggtgagggcaacacccggggatcatggaacggtaaaaggtgaatacgaataaagagaatatgatgaaggggtaagttgctccataaaatggatcattacaaaccaacatgatgttccgatatgttttttttttcaagttcttataactacctatatatctgtacctgcttaccaagtttatcatcagcataatctaatctttctttgtatgcagctagtatacgctttagatcaccgcaactacggcccacaagaccattcaattccaaccgggataagtctatttttcctccctcaactcatggccgtgtatgaatagcatccctcaaccgcaaaatcgggtataacccatcccccaactctgaaaaccattgcaaatcaactccccgggcggttttggaggtggttttgtcctacgtggcacctttgaccctattgacttactgagtcagcagggggccatatgtcagtgacaaggataaaagaaaaaggtggggcccactgtcaaccacacttatcttcttctctacgcccttctctcgctcctccggccgatcccggcggtgatgtgccaccccaccccgccgacagtcgtcgaggctgcgccccgctcttgctcggacgccttcagcgccacgctccgcttcgacttcttcttcccacccccatcccaccctatcgcctccaccgctgccgccatccccctcctcagatccagagcggaggagggcgaacgagatgagggagctggccggcaacccttggacgtggagtggcttctcactgcaggtggaccagcgcagcccgtcttcgccgctgcgtccatgtgcatgacgggctcccccctaggcttcgccgcctacactagtgcgtgccatatgggtttgcaaatatttgcaaatcgattggggattctctggtgacggtgttttgcgtgctttggcagagtgatttagtgctgatcataagcatcatagtatcatacacgcttgaaaaatcatgatacagtcgaccaaattgctgatcgatagcttagtaaatttggtcagcatggtatgccacccggcaattttctgattgatactattgttggggtacctggctatctgcagctttgttgatggataaccattgatcttgcattgttttatatccgactgcttgcttcctggagccgtttgtagatgtaactggagatggaattttgcagcaattggtcttgccactgccgtctcacgtgctgccccagccaagtctcccccgaggccggccgcacgaatcacgctatgccgcgggccgccgccggcaatccatgtgcactgatgtgcagacataggtgcaggaggaggaggggaaagagcggcggggagaagttgtcgtacatgacggtggtacgggcggcgctgctcctcctcgtggcactcagcgcactctcgctgctcgccgcggggtctcggaacgaccgccatgccggcctcggtctcgccacgcttctgcccatccacagctgtccccggcaagcctcccccagcaacatcgtcgcggtggctaggcactgtgatggcggcgagctcctagccgtcaggatcggccggaggagcgagaaaagggtagaagaagaagtgtggttgacagtgggcccaccgtttttcttttatcagtcactgacaggtgggtcccacctgctgactcagccagtcaacagagtcaaagatgccatgtaggacaaaaccgcctccaaaaccgcccggagagttgatttgcaatggttttcagagttgggggatgggttatacccggttttgcggttgagggatgctattcatacacggccatgagttgagggagagaatgtggacttattccattccaaccagacaacgaagggcccacggcgcagtcagacttgttgttcgatttcgcctcccctgcaagccagcccgcatggccagatcgccggcgccgacgcgcaaacaccctgtacgtacgcacgcccattgttcgtgacctccccaactttcccacgggcggccacccagtcccagccaccccaccaacaccaagctttcgcgtctgccgaccaagacgaacccaatttgactgccgctgacctgtgggccccacaaccaccccataaataaagcaacacaacaacgacgccgtaacgaaggagcagcagttgcagcagcagcagtgtcttcttgcagagaaagaaggaaggaacacgaaggaaggaaggcggcgacgtcgagatggtggtgctggtggtcgccacgacgtccgacgccgcgtcggccactccggccgccgcgttcctcgccatgcccggctggacccccggcccctccatcccggtacgaatgcctcgccctcgccctcgccaccgccttcttccctgcctaactcttcgcgcggccggcgcaggacggcgtggagagcttcgcgaacggcgcgggggtgcggctgctgcggcacgcgcgcgggatcgtggaggaggacgacctggacctgcggtgggaggccgccacgggggagcgcgtctccgaggtggtcctcctcagccgccacaccgccgtctccaaccgacccgcgctcaccgtccaccccatcggcgtcccgcacctcagggacggcgtggacgtgccgccgcagggcgggcgccccgggtgggccgcgccgcccaacccgcggatcgggccctggctccgcctgctccgccggatcgccgccgaccgcggcctcgtgccggagtttgaggtgattactttacttgtgttttttttttaattttgcttttttaatttcctttgtggaattggggatcgcggttgtttgcattggttgattgattgattggttctcgtttctgcagattacgctggagggcactcaccatgggccagtgaccaacacgccgacgctgtttgttgagattggtacgaaattctccacaccttttctttctggggtttaatccactgtgtttacttaattattgctcgacagccagacatatctcacaaattagattattcatagtgatttctggataatgttttgtaacttcatcttagttgatcaacttaagttcattaagtttattctttgttttttctgttcccctgattcatttttggacaggacagtttatctgtaagttgcataggctaggaattaatgcctgcaccccgtcattgatgaacgttgtattgaatcctaaaattatagggtgagatcttggattttatactgacggccgaaaggtcctctttgttctgacaccccaaagtatgaactagttcaatggttctcttcctgaatctactatatttgaaatgctatccagcagttccctgaataaaaataatataaataagtatgatatttataatagtagaaagagaaaataatcttcaaattgattcttcaggcacacagatagtttgaagtacaagtaattatgtcctctctctcaaaagaagtaatgttgtcctgtaaatgaacagtttgaatgataggtcacataaaaggatatatctgggcaacttgcgaaagaaatgtgaaaatacaattcagatgacaataaatttcaggtgatattgcacatatagcaatagtacataaacatcaacgatttgatacttaactcattatatcatgaaccattgagttatcactttttctattgttaaacaatatattttccttgcatgcccacgtgacattgatcaccaaatacgtttaacaaatttatttctttaacttgtgtgttgtaggaagcactgaagaatactggggtagacaggatgctgctgacgcagtcgctctggttagttttcccgtttgtgttccatttcagcatctgggcgtggacaatgtagatgtttgtatggtctaccatgattttcatgttctttttccttagatatctggaattggttccaactttatggtgatattattgttcattttgcatctttgtgatgctaaggaaaggacatgcatttctgatccttagtgtcctctgtgattttgagttcgtgaacacattgtatttatggtgaaaaacacaatggaactcagtcttataatacttgcagctgctatggaaaggacttggtcttggagaagaagaatctgttggaaattggcatgggtatgtttgcatcccctctcttgctctccctctctattttcgtgtgcttta

SEQ ID NO: 14261 - DNA, 1570 bp, Oryza sativa
  unsure (1)..(1570): unsure at all n locations
catgcgaagaactctcgttatattttccaataattagcatatttgataatccaccacaactgatattattccttggaaggtaggagaccaatgtatcaccgtttaatgctaaaagaactaatttttggcacttttttgatagtataatgcacacaccgaacgctttgagattgtttctgttagaatcaaaatcagctctctgttgagaactatacataaaatcactcgcccaagcatgctcccagcatgggtactcttgactatcttgcttgtatatgtttttttaagtgaactgtttatctattataatgatggtttttgctatgaatttgagctgcattaagtctgctatattttcatgtaatgcaggaatggtgaaaaagtccttctaggcataggaggtggtcattatgctcctcgtcatatggatattgtaacgtaagcgccattttctttcattgattatgacacaactttcttagcaggatctaagagcattgatttaagggagtatatttcttcaatttttgaaagcattttcgtcaatgttatatcttgaaaatgtttcaggaaagatggtgtatgggtgggccacttgctctctgggtattctttgccaatggaggaaccgaagcagatgaatggtaaaaatgtggctgacgttggcggtatgtggaagcattccattaaagtttcatatgaagcaacaaaagcggctttcccaggaggagagattattgcacatattgatcaaaagtaagatggcttaatctatagctaacttgtgttccattagaatacactatcttttaatgaacattattctatttcatgttttgggtacacattatttaaaaattggccatcctgattcatcagtaaagattacaaaacaaccatttcaaattttgccttgacggtacacatatataattgtatccagcaatctagaaaatcatcaaatgcatcagttgagggcattcttatcactggaattttataaattgacatttcagtaaaaaggggcttccttctaagggtatggacttcttcaattgtctgactgttctgttatgttccatctgtctgcttctctgattaaaacatttgaattctaatcatcatatctgctgatagtatgcattcttttgagaaatttggcagaattttttcatttcatttttattttgcacgttgctaaataaaatcttgtttagctgcagagcacacatgcatagtgtttatcatagtaggttcaactaaaatatgcagtgtatggttgcatccaatcatttcaaacgatgcatcatgcattgatttgaattttggatagaatatgaaaattgtggtttgtacgatagaaaacttacatataaataattgatactgctgcaaaaaaatcaattaatcataagacaagtctacttacggatatttaattacatgcaaacagtgttctaacaccaccagatcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14262 - DNA, 295 bp, Oryza sativa
tcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagca

SEQ ID NO: 14263 - DNA, 432 bp, Oryza sativa
gctcgggcatgcagctgtggacggcggcacggggggaggacgcggagcggcgggtggcgccctctcgtgctccgtgtcaacagcgatgggggcggcagcacagcgcgggaggacgcggcggcggcgggcaacgccctgtcgagctccgtgtcaacggcgccgcgtccacccccgatggctgcggctgtgtctgcaccatgacgtgcgcgttaacggctcctcgttgtcgaactccatcccctcaaatgggtcaacgccgtcgtagacgacggcccgcgccacatacgccgccgccgccgccgaccttgccgagccgttcccggcggcgtcagcctccatctccgcagcgtagtcgacgttgtcgttgtcgttgtcggcggcggcggtggcggcggcggtggtccgacaagggggtggaggaagtgggggcat

SEQ ID NO: 14264 - DNA, 406 bp, Oryza sativa
ataaaatggagaaacaatcggagaagagaagagacgattgagctcggagcgaatttgggtctctgggcttccgttgctgaacagcttcgtgccgagcccaggctaagctcctcgccagcggcggctatgcttgaccgagaagtggtgcagtgctcaccccatcttcgccagcggaggctacgaattacccccccccccccccccgacccaatctaggacggttttgttctacgtacatttcagtcagcattttcttttttaaatgataggccccacccgtcatatatactctatcccctcctctttctcctcttcctctctctctcgcgttatcgccttattggcgagcaaggcagcacgcggcggggcgagcggaggcggctgcgggtgcggccggccacgcccc

SEQ ID NO: 14265 - DNA, 21346 bp, Oryza sativa
gccgacccaatgggctaagcccaacgtgcgcgtggtggtgagggggagggttctgtcaggtggaggtggggctctagccccaacgatacatccgccactgggcggggatgagtggccgcaagggtaattcagccaaaccttgttcggccgaccccctagcaccgccattccccctctcttttggcctggtcattgtccagtgggcccttatgacggtgcatagttttgacctattttgaggtgatttggtcagcttgtgggccctccaatccgtgtatttgcgtttgattggccggaggtgtgtttcttcgcctggcgggtggttttcatacaaatatttcaccaatacttgtgaaaataattagtaataaccactaccactaagtttgattttttttatttcaattgattttatgcaaggtttgacgatcggatttggtaccttaaagacagtcaacaaaatctccacacttagccattactggtccctgagtaatgatcatggattacaacaaagccattaatccttttgtaatgatacttgcatacaaattattccaagccatacatgtacttgtgaaccttaaagtgtctacatgtcatcttgaatgattgaagaatgaaacagccttgactcaagttacctccattccttttaatgaattccttgaggtttttctttttctcataaaagtataactttactttactccttaattgattctctcggatcgctcaatgtgtatgattcctcaccaaggcattgattttgcattttcttatcctacttctaataagacttatgtagagctcaaggtagggaataagaatgacatacttgcatcgcatatattgtaaagtcaaaaatggatccaagaatgcttattggcttcttggaaattcattcttctaaacaggaggactaatgatacaattatgatcaagatgtgcatgtgtgtggaaaaggaatatgtgtgcgtgaaagaatgaaaggttgaatattgactcctttttgtacaatcctcctccttgcacttatttgtaaaacatggccttttctctctctctttttttctttttttttcatgctcgagaatattttatctctttctccacgtgagcatttctatttttttcaacatcttttttagctcatgtctcattttgcatggatggttggagggaggatcataggtatgtggagactttatttggtggatggatgacatatgcttactttcagtgtataagtatagtatattgtggtagatgggtggtacatttttgctaaactctagttgtagagggtgagaaaatatgggtgtgtgtgtgtgtgagagagagagagagagagagagatcttaatcatgaaagcatgaaaataatctaactcaatatgatcgatatatgtataaggtttgcaatatgtccgacaaatgactttagtaggaataagacgtcaatgtggagtgtgtaaagttataccatttttttctcatgaaaattcccaaggatcgaatggagaagagtaaagttcctttcattatgctttctctcattcatcaattacttagattacatatgttcctataatttatatataaattcctggtcaatatatttgtcttaatgattcaccattttttaaaagtaagtttcataaaatggcactcattatgatacaagttgcacaaaatcataggagttttggcaaagcacataaccctagttaggctgagttcgttctagggtgatagtgagtttgtttgtttcgttttccgcgcgcacgcttcacaaactactaaacggtgtgttttttgcaaaaaaattatatacgaaagttgctttaaaaaatcatattaatccatttttgaagtttaaaatagttaatacttaattaatcatgcgctaatggctcacctcgttttgcgtatctttccaatcttctctatctcctcctcaaacacaaccttattatggtcttaaagtttcacaaaaccatatcattaactaagttaatatattccaatataaaaaaataaaaaagctttatttacacatatgatggataaacaactcataaatttaagatgtgattgcaaaacataaaagtgtgatacgtacatcaaagtcaaatgaccaataatgtgattttgtgaaactttatggtgataatacccagggttatgtgtcatgtgccaaaactccccctgtaggtttttgcaatttagaccataatacttggggccacatcaagcaccaacatgcagttttaaatcaacatgtaaacaagatggtcgtcgttgtctcacgcagtgtagtgccacaccatcgtgttcaccatctcattttgccccattgatagcggagcatgcagatccagccttcccgctggcggatttgggccatgccaccgacaattgcccctcgtgttggtgtcaagtaggaggcccgcgccatccagatctgacctccccagcggcggatctaaggccactactgccgtagtaggggtactgctcatcctcgccacccccttctggacatcttgctaagccacaaccagacagggcatgatggctccggagttcccaagtgccatcgatgaaagatccatctctcctgagttgcgccgctcacgtatcaattgttcactaccgcagtctcctcttaactgccaccgcttccaccgcaccaaggcccgccacccagtggcgaatccaggatgtaaactgagggtgtgctagtgtaaaaatatagtatgattgaaacaaattagagatatatcaactaaagatgaaaaaccagatacgaatataatcaaaagaactttctccatttcaatttgtggctatgtgaaaatatacaataatatgtgtgaatatattgttatggtatacttagagtaagctgtattttctcttagctgtattcatcagtttaggccatgaaagcaaggagtagaagcagtgatgcagcctgcatccctaccgtatggacagtctcctcatcaattctaattagacttgttaatgactaatcaggggctggttgtgactaattagacttgttaatgactaatcaggggcagggattagaggtggggctggcgccccaaccagccccaacagtggatccgccactgccgtcacctctggatctgcagcccccctcctccagccccacttcattgtcgccgctagatttgaggtgaggtgcagagaaagggtggttgcgaggtgaggggtagagaggtgaggtgactagactgagaggaagagatgaaccagagccagcattggtggtgccctcctggagtaagaaattggtgggagagggaggactcgattgtgacagccaattttattagtgctttgatattttcgtaagcgggcctctttagatcctatctgtgatagtgatcttagcatgcgaccgtccgtttgaacccctagccccctgttttcgcagcccaaaatcgtttcttaagcagtgttatactccgtatattgtagatttctatcacagctactaccataggatcacttggctcatgctattgctaacttccagaataaatgttgcacacgcccttagaaacgagcccaagttgagcagctatgtcatattgtgctaaaggcttaaacggagcaggccaacctccctactctctgttgtccattctctcccattccgtagctgaccacaagccaaaaatctccaccgaacacatctattgtcgagaggaaggacaagcatatcactttgagtctaatatacaggtgcatccgactcaagactagtggagaaaatttgacaagggggaagctggaagaggatgcgaatatggggatagctttactccaaatctgtttatttgatagtagcaattctcgtctcgtataagataaaataattttaacattttctgccttgtccaacgccagctggggagtggggatacatccaaatcactagattttggtccgcgagactgtgactgtgagccatattaattggtctgatttctgaatcccctaggctctgttcttctctgtcgcaaaaactagcggacacatgggatcaaagacagctaacacttggcttttccaaccatcgctagatcgcgtaggaagtaggaacggaaagttctaaattgtacgtactctagctggctagagattccaaccagatttttgtccggtaccggtaccaaccaggtactcagattggtcctgactctgcagagatgaacctgtactactagtagttgttagtactaacaaaattagtgtcaaagtggttgtccacctctgcaaccgtcggcttagtttgcttactgctccattacgtaagtacactaggccgtgttctgtttagattatcgaactgattattacagcgaattatctactcaactataatgttaaatatttcataaataaatttaactagtattttaaaatgaatggtctaattaattcagtagaagaaaaaaaatttaaaagaaaacttgcactacttaaaaaaacctttaaagggaccagtcttataggtgccggttcatttaaaaccagcacctatggatcttttcccaccttcacacgctgaaaaaaaataaagaaccgacacatttaaacactgtaagtgctagttctacatgtaaaaccggtacaaatactatatgtgacggttttttaaaagaaccgacacctatacttatattataggtgtcggttccagagaaaaaccagtaccaatataggtgttgattttttaaaagaactaacacctatctatctatctatcttctatcttctatctatctatctatctattatatactaaaagtccattaatcttcctataaacgctcctaaaccgccatgtggcgttcctagaaacgctcttaagtcgccacatggcattttataatctcaccgttgattttcatttaaattggtggacccataattttagaccgttagattagatctatttccttcctcttagtatcacgtgcatatgagtaaaaactagcgtaagtacttatgatgaaaaaaagataacgtactgttcacttaaaaaccaaacacacgtatgtaagtacgagaagaaaaactataaaaaaaacctttagatactgtttactaaaaaacaatacaaacatacgtacgtatgcacgagtaaaaaaactataacacccttaaaatatgtatgcacatcagtagaaaaaattagaccgtcattttaaaataagattttctatactataaaaacacgcaatatgttacatcattagattagtccgctttctcttaataaatattacaaaatttggtaacccggattatattattgaattattggatgaaggaccataatttaataatttaataatattagataatttaataattttgttttatattaatggttgaatactacaagtccattaaactttcttaaaacgctctcacgctgccacatgccaatccttaaaacgccctcatgctaccatgtgacgctaataaaatccatccctttttacttaaatcagtgggtccaatatttatagccgcccaacttaattgagattaaaataacctagcgccgcggtatataatctgcacaatgaaagcaagtagttggttcaaaatttatatttgctattacaacatttaaactttaggacttatgttgaatacgtatttaaataaatactatagatcacatatataataaggaaacaagatatttagatcactcctctttattcaaatatatatgtaagtatataacaaattgtgtgagcatgtatgaaccaattagaaggaggggtaacttgatggcacaaataaaacaaatttattagtaataataattttctaggagttgtttaaaaatagagcaccttatttttaatatacacttaatttgttcgacatttgttttaaactaattaagtcaatctcctttcaagataatgaaaaagattataattgatttcttaccggtataaattaaatattgtatagtttaaagctaacagataggttgaaacaattatccaagcaacaccgttgaagaaaatttatagagaaatagtacttttaaagtgtgataggtgtcatccagttgatatacattctgtcactataagttttttaaaaaatacgaatccacgtaaatacccgtgcgatacatgcccgcgcgaatgcgcgggctaccttcctagttatataaatataggtactggttctgaaaaaaaccggcacccattaaataaacccgagcgggtcgacatccttatccgatcgcatctcaccccgctttctcaactccttgatcctcctccactcgtatcggtccccttccctcttgccccctctcgcctcctcctgctcctcctctccttgtagcagtggcggctcccttggccgacagcagcagcggcggctcccttcgaggtggcggtcgtcggatacctcaacgacaactctctctcctggggatggcggtgctggggaaggccgacacgagcgaggtggcggttgccagatcccacgacgacggctctctctcctggggtcccttgttgatattttttaacaacatgactagaaatataattcctagcaatggtgccaaaatattctcggtgtactttacggttacatatacaatccgtaagcgtacggatatactgtggtagcatttcacccgggagtattccaatgtatcgtatttatttaattataagggaagatatgataagagaatactatgataataatttatatcacttgtatagatcaaagtctaatgcaggggttaattaattcaagggtagagtaagttgacacacagaaggaactcactagactactctcattaaaatataatttaggctaagtggagaaagaataagaaaagaataatttatgtacttatagtatatagtcattttagtccgcacttgctagtatacaatcatgcagccaatatcctctaactataccctcctggtgtattgagaaaccacccttacttgcagagttcattacgacatcctgtcatggccatccaaccggtaatgaatatggaggagtaaccacaccaggaaattctcttagtattatacccgtattgagctgtcaccatcagcagcctacctttagagacccgtggcatataaaaccatttaatggtatctaataatctaagcaccatgcttatattactaaatattactctacatctctgcatgtgacatagagcaatcatataaatgaacattaaaccaacaccattgcatatctccagttagctacctacataattattacgagacaaatatgaactaaagtcggcactccaataattatatgagtgaagtaaaagaccgaaactatataaagaagaatatttcattaatgagcaaagtcttacaaaagaataacaaagctactagagccatacccaaaatctcctgaagacatgaagaactaagaaaaatattctattactactccactagtactagaacaatgtaaataaactagagagcttcttagatttgatccttcatggtgcactttggaatggacaaggtgatgcccatttataggctgccaatgacggttgtggcggttggaattgtaggaaatgccctgcaaccgtcattagggagtgatcagggacgtccacgtggaaggctaagatggttggcgccagtggtggttcggccgaaccctgggccccacctctggacctctgctttggctaggagactgcctggtggacccttatgacagttaggatggatttggctcattttaggacggtttcatctgacttgtgggccctctgatccttttactcacgtctaattggccggaactgcttccctgactgttatttccattattccttctccatttatgtgaagatctcatatatacaaataaagttccaaacaagtggaaatagattattcttaaacaaatatgcatgcaagaattgctagttctcctttattctagatatattgacggtcgaaattggtctataacgaccgtcaacatcccgatgaccccttcgagattaaactagtgtcctcacctacgatgctgctcgcaccactagtatgattacttccactctggttcaagcaaaaccaagtgcaacagcgttatgttgggatacgcgtaggctacgatagcataaatcaaaattttctatcgcgtaaaccaggaaccatgcaagtattatatcatagatcgttaccactcgacgcgctgcgcagcgaaagaagacgctgagaagtcgaaggaactctcgcgaagtagcgcgcgtcgatgtagagtaagtagtcgatcgcaccggctcgaccttctcctcctcgtgcgttctcctcgccgtactcccacgccgatcagcaccgcaaaccagcggcgcctctaccggtatccacacgtacaggaacggaacgccacgcgcagatgtgctagcactcacgcacggctagggttttgctcggggaggcaagtgacggctagggttgctcacgtgatgcaatacctccgccggtcacacccctcatgaatatataggatccatcactcgggcctccaaggcctgtaggactcctattcggatccttatccgaattaagctcatattggatctctatccaatccccttattccggcccattaagcgtgtgaccctgtaggttcatatatactcggctgtaccccgaaaactcattttcggtccacgcgtcaacagcggcccctagcaaaacgtattgacccatcggtcatacataaagatcatatcggctgaacctctagtatatacttgtatgaacccctttgcctcacaatatcgattaagctcaaggctagatatgtgccatcctctaatagctcaatcattcactcgaacctgttgatagattatataacttgtgattgactcctcaatcacctttggcatgggcatgcacttccataatctacaacatcgaggggcccagagatatctctccataggagggtgtcacaccctgaaaatttaaaatatataaattgttgtttaattggaatttttagaattaattttaaaagcctagaaaagaagatctaattttaattaataaattccaatataaaatggggccagataaaatttcattaaatactttgcttaattctataattcctagatttttctgggatttttttgagctaagaaagtatttttaataaatggaattgcatttaagaaataatttaaattgaaaaaggttttaaaaagtcttcttttggctttgggccgaaagtcggcccaaaacctctcttctctctctcctcggcccagtccggcccagtccgcagccgccgcgcgcgcgcgcgttcggccgctgacaggtggggtccacctgtcaggcccgtcgtcttcctccggccgaaaccctagcgcgccgccggcgccgttcctttccaaattcggccggtcctttccttctctggccgaatcaaaagaggggaaatgatcctcgggatctcctctaccttttcttctttggaagcttcggctaaaacgttttggaagttcgtggaatcgagttcgattcggatcggcctccttccttcaagccacgaactttccttctcatcgccggccgccgtgggcctttgccaccgcctccgagcccctttaaaagcttccccggtgtctcctctacccgtcgccaccctcgccttcgcctctcgtcgccggaagagccctagcgccgtgcaacctagcgccgccgtcgccgccgtcgctccagccgtgcgccgccgccgtctcggtcgtcgccgtcgctcgggaagaccgccgtcgtggtcgccaagtcgtcgccgtcctcgtccgccccttcgccgtcgccgaagatcgccggagcgtcgtcgccgtcgtcaagccgaagagcgccgccgcttcttcttcgtcgtcgtcgccgtccgttggtcttccgccgtcgctttggtcgccggtgagttcgccgtgccgtccgctacccgttggtgccctccgtttgcgtcctagtgccgccgttcgccggcgagcgtgcgccgcccgagccgttcgctccgccgagccgccgccgctgtcggtgacgtcaccgctgacgtcatcagggtcgtccgccgtgagccggtcgtggaccgttcgatctcggccgtccgttttggattggatcgatctcggcagtccgttcgcgtgaaccgccgcccgtgcgcccggtccaccgaaaccctagcccgctgacgcaataaatcttcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgccggagaagagtttgaagagttccaaggccaacaaggcaagtcacacagatcccaaacaaccctttgagcatgttgatcctatttaaagctattatttctattcaactattgcatttattttcgaatgtcattgggtggaattaacctattcattgttatagcccttttgttcttgattactttattccttgataccttgggttactataatttgactagttgagctttatttatattggttcaactagatattagaaataattgcttagccctgcttagaaacattagcacactattgggataacttatgattcactattatttcatgatggcttaattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcattgcggggcaccagactgagaagtggcagagataagcccacgggggtcgctggggagtccatgccttgtttataagggggtgattatgatccaggaaggtgcgctgcagtggattatgttgtataaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggtgggtctaacaatgtctttcgtgattagtctcacacttctcatcatagtaaaagatgctttaattggtaataatttgattagctcctggtttggaatggtacattcctggtttggagatagaactgcgcagccagggtggttgttcagaatggttgggcctatacaacagggtatgttgtatagcgttggattaatattgtttaattattacttaactgttttattaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacagtgaagctgatggagtggaggattaggtgtagccttggtcaagctgcttgtggagtggagccgtctgcgccgtttatcttattttccgctgcttagatttttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagaggggcaaatcccatcttcattattcatatcccactacatgtttcatagcatacccgaaaactacttttataactacccaattatggagtagcgtttagcagtccctaagtaagctactacatatgttgggaatcatgataatctcaggtctaaggattcatcaccaacactaaatgagatcactgatgacacaacatatatgtctcttgcagtgtctcatgttgggtctatccaacaacatgttcactaacatgtgtccactcttcttgttgttgggcttgcgcttatgcataaccatcacatggttggagtttttcttaatgctttcctcagcagtctttagcatccgatgcaattctgccaaggtcctgttcagattgttcatgttgaaattcattatgaacggctcaaagctgggagggagcgactggagaatcaaatcagtagctagctctcggctaaggggaaagccaagcttatccagactctcggtgtaaccaatcattttgatcacatgtgggctcactggattaccttctgcaagcctacacgcaaacaaggactttgaggtattaaacctctcagctcttgcttggtcctcaaacatgttacgtagtcccgtgattatcgtatgagcatccaatgcctcatattacctttgaagctcaggggacatagtagcaagcatgagacagcttatatcaagataatcattgcatcgcttttcatgctccctacgttgagcagcaggagcattgttgggcaagttagctggaaaaggctctgtaagcacaaactctttgtgctcttgcttgagaacaattctcaggttgcgataccagtccatgaagtttgttccagtcaacttctctttctcaagaatagaccgcaagttaaaactggatggtgcaagagctgccatgatctataatagaaatatatgtatgcaaaatcagcaccatgtttacagttaacctttcattaaacaatttaacaaaagatactcccactatgtattgtgaaacaaaattccctccagtatcatagtgagtcaagatccttattttgttagtgtctagtgagctttggcatcacagctagacaactatcaaaataggtaagcaacaccttgcaatcacatcatatgtgactcttgtgctattggagtgacatctccatgtccaacccaacctatgccccaaggtccaaaaccgttttgataaccttgtcaagtaaaccaataatctccgcatatagatgtccgacatctatcctattttatcatgataaaaagtgacacttggctatggcaaacccatcacttatgatcacaaccgtaataggtgcaattattggaagagcataaattacacttaatttttctgagggagtctatcctaccatgtcatatcaaatatataacagcaataaagtaagatagatataaaaaccccaagcgaaatctaaggggcaacgcacacggtggtcccgctagatctcatctacgattcgccatgtgaaaaccttaacgacgtaatcaaattatgccgagaccgagtcaatctcattggctcatttttctcattggcatgcggttccagtggacatcgaactatccgatgaacacaatcgcgctcggccttggtgagtactagatattccagtgaagtcaccaacacacataccgattgatctcatcaacccatgcagctatcggttcatctcatgttccgatcacctaagaactcatatacaatataatagatctcatctactacatccgcgtatcaattatatgcaatgatctagatcataaactatacaaggcggctcaaataccactgttgggatacgcataggctacgatagcataaatcaaaattttctatcgcgtaaaccaggaacgatgcaagtattatatcatagatcgttaccactcgacgcgttgcgcagcgaaagaagacgctgagaagtcgaaggaactctcgcgaagtagtgcgcgtcgatgtagagtaagtagtcgatcgcaccggctcgaccttctcctcctcgtgcgttctcctcgccatactcccacgccgatcagcaccgcaaaccagcggcgcctctaccggtatccacacgtacaggaacggaacgccacgcgcagatgtgctagcactcacgcacggctagggttttgctcggggaggcaagtgacggctagggttgctcacgtgatgcaatacctccgccggtcacacccctcatgaatatataggatccatcactcgggcctccaaggcctgtaggactcctattcggatccttatccgaattaagctcatattggatctctatccaatccccttattccggcccattaagcgtgcgaccctgtaggttcatatatactcggctgtaacccgaaaactccttttcggtccacgcgtcaacagcggcccctagcagaacgtattgacccatcgggcatacataaagatcatatcggctgaacctctagtgtatacttgtatgaacccctttgcctcacgatatcgattaagctcaaggctagatatgtgccatcctctaatagctcaatcattcactcgaacctgttgatagattatataacttgtgatcgactcctcaatcacctttggcatggccatgcacttccataatctacaacatcgaggggcctagagatatctctccataggaggggcaaatcccatcttcattattcatatcccactacatatttcgtagcataaccgaaaactacttttataactacccaattacggagtagcgcttagcagtccctaagtaagctactacatatgttgggaaccatgataatctcaggtctaaggattcaataccaacactaaatgagatcactgataacacaacacatatggctcttgcagtgtctcatgttgggtctatccaacaacatgttcactaacatgtgtctatattattaatttggtatctctataccatgatccatgagacatgatcatcaattaatacatgtgctgatcatctaaacatatttgttccacatatgatttttgatcagggatcctttcgaaatagcaacaaacaacataaagagtctcatgaaagaatcacatattcattaaccaataaggagttatctatttcaaggaacaatgtcggacaaatatgtaaacatagtatgtgatacaatcatctctatgattgtctctagggcatatcactaacactttaaacaacagttagttaatcccaaattccgtattagggtgatttataggcttagctcattacgaattagtagcttacaaaatctacaaaccccctttgctcatcagccctagcatacgaaagtgtttgaccgtctaacaagagtactagaccctcgcaccagacctcgctcccaatgcgacaacaaattggaacaccaacgtcctttacgctacaccgcatttagaacatcaacgtcagatcataacaccacatccgaatgctaaactgttagagaatcatgatgaagcataagtaaaagctaaggccccttttgaaaatttccttacaaggtctttccaaacaaaggattgaattatataccgtccttcgaaaatcctaaagatattttgaaggaaggtatcaagagcttaaacctcttagaaaatccaatgtgttttctgtggttcctatggttttcctacgatctattcaaacgaccattcatatatttatatttttcctgtgttttgcactcgcatttctttcaaaatcttacgtttttcataatcctcctttgtcaatcacgtgtttcaaagaagctccctaaaaagttagtttttcataatcctcctttgtcaatcacgtgtttcaaagaagctccctaaaaagttagtttccgttcttggcaatgccctgaagcggtgtgttaccgcgtcgacggccataccatgctattgcgatgatataataaactcgaatattcgatttagctgctaatcaacatgcgtttggctgcagaccgatgacatggtgaataacttgcactactacagaaaccctaatcggtgccagttaggaaccccctaggtgccggttttcccaaccggcaccacggaggcggcactgatgacttcggtcatcaatgctagttctagagccggcatctatataggtaaagatgtcagttttttaggttttagaaccggcacctttaaggtttgaggaataaaaaaaaaagctggctcgatgcatcggctcgattcatcgaggtgagcagctccctttcacctcgaacaatcaagaacacaccaattcagaacaagaataggaacaagatgagccctccaaaaaaattaccaggtctctattgatgcgaaaaacacacactggcctgaaagatctgcttaactcctatgcatgtccaaaatcttgcttttagattcgtgagagtgcctgttgatttgatcctgcaatcaacaagagtaaagacaagaaaaaccgcagttaaatccataaacgatagccgatcggctagttgccgatgacatatcatttatatatctttgagctgatgtcatgtttgaatcgatcggcagcaatgaatgaataagataaaaccaaatctactcgatcgactgtagatattaacaacatatagtctttacttcggtatatacttaaactaagtgattgggatagatcggtcaccatgccgagacagtataaatcacttaagccgaaatatatattaaagcgaagattatatattagtttatagcatagccaatcaaatagatctagcatgtatcggctaatacttcgataccactctataccaagatatcaaaacaagcaagatatatcaaacaagaagcctaatataactttagtgcaacaagatcttaatataaagggcagatttagcatgacaagcaagcatatgagataagaatagctaaagcagttagcatcggctaaaactccgatactatctctattgataatcataaaacaggctagatatcacaattatagatataacttaatagatcgaactcaaccgatgcagcattaagcataaagataactgtaagatctaagcaagataatgaaaatctctaagagatggtagatacacaatataatctagattaataacaagatctaactctatcggctactttctagtagtaaaaaccagccgatggcaagttatataacgcaattaacagagattataaagtatatatgataacttgacgaattacataaataagattagagtatcataaagatggaagcactgatcccgagaacgcaaaccgccattacaagtttacctctagttgaagatcgaatcgatgcagctcaacccgaaagcaagaactcgtcaaaatagaatgaaagtaaaaaagggtggcgatgtgccaaaagtgttattgaactgatgttatcgattacattgggttcgggtcatatttatacctgagatacaaaacatgtccttgtcggacacgactcttatctctaagaggctctaatataccataagtctttaccgcagacttttgcccagatatatctctaacaaaatatcctaattaatagatacaattgcttttctgagagctttatctccatcgcggcaatccttgtgaatcacgttgatcgattctagaaacagcttcggagccatccccatcggaatcggctgtattggctctatcggctgcatcaaccatcccctatccaatccatctcagccgatgcatactccagccgatgccttcgcagccgatgcatactctgttcttcgaatctttgccgaatccgcttcgattccaatatcgaacttggttcatatcttaccaaatttggtcgttaatagtctccccaaatttatcaacagaaatagttcaaccggttcagttcaacacataccagtaaattatcaggtctctctaaaattttgcatgcaaattcaacaagttgtaggcaagaaaaaaggagagacgaaatcagatcgtaccgccgccgaagtggtacgaagttgcataggagaaggggctgggcgaggaggatgatgagccccgccgctgctgcctctgcctcccctcccaccggatctggcagaggggagggcgtcgcccgccactgctgcctctcctcccgccacctcccgcctctaccgccgccacctcccgccgctgccgctatcgttgcctcccctctcgctggatttggcggaggggagggtgctcccgccgccgaccgctgccgcctctcctcctgccgccgaccgctgccgccacctcccacctctactgccgccaactcccaccactgccgctgccacctctcctctcgctgcccccgcctcccgccactgcggccgccacctccctcagccgccggggaggagaaggtgagagaggaggcgcaaaaaagagagagagttcgagagaggcgaagagacgcgcgcgcgtgagagagagagagagatacgagtcagttgactctgatggatggataagaatgtgggggctccccgtgtggctcgcctcggtgtcggtttttttaaaaaaaaccggcacctatttctttaaccacaaagatgccggttcttaggtgggccctacgcctactattccgatgggatggatactaaaaggtgccggattttcaataaaaaccggcatctttctctgacaccagtaataggtgccggttctttttaaaaactggcacctatttgaggataaaggtgctgattctttggattttggcgggttgatagacgcatggatagggaaaggagctataggtaccggttttacctactctagcatctgtaatagcggtatctatttgatgttttgtagtagtgatggtactgagcttcgtgtcaatgatccctgacccaccagcgatgagcggcagcagcggcctagcgctccaccctctcgaacgtctgccatgagagatggaactctcttacatggtacaggagtatcagtttgctgctttggactttggagtcttcagggcctgaaacatgttggaccaggttgttgttgtgctgttcgaaattggaatcatggctgatagataactgccccagggagcgagcgtcatgctgcatccttgttctatggttcccatgataccaccacggtgtggaggctcacacgggtcatgagaaattgagcaaacgagaaaagtaatgagtgaaaactggatgtgtggggaggaagttagaagaaaaattgagtagtggacttgtggggggtcctttgtacctaattgagttgaagagggggatgatgaaagtataagtgactcgtgcaaaaagaatagttccaaaatttcaaaatttcggtggaaaacgaaagtgaaaacattgcatgggagtggacccaaatggccacttccctgtagatacgaggacagcgatgtaatgttgtactttctcacatacacaatgaccgtatgtattaacaagtcattaagccccttttaaattttgacttgtcgaacattgccgaaagtaaatgaattttttgttgttcgagtgacaaagtagaccacgttatggcagtagcaatggctggacggtgcctaaaaaatattgtttgctctgtaatctcgatttagagtagtatatttttttttttgcgggggatttagagtagtagtatattattactcaaaatttcccccaacctttgacgcgacaagcaacatcaagaaatctcaccaaatggaaggcgaggagcagcagagggtgaagacgacgagccaatgggtgtcccacgtcgagcacctgctcgacgccggcggcaacccatcggaggaggaggcgaggcggtggcggaggcagtcggtgtaccgcgtgccggcgtacatcaagcatcgcacctcctacggcgcaccgcagctggtgtcgctcggccccttccaccacggcgtccccgagctccggccggccgaggagcacaaggagagggcgctcctgcacctgctccgccgcggcggcggcggcggcgatgggcggcggctgcggctgggtagcctcgtggcgtcgatggaggaggtggtggtggagctgcaggacgcgtaccaggggctgggcgccaccaagtggagggacgaccgcgacgggttcttgaagatgatggtcttggatgggtgcttcctgctcgaggtgatgcgcgcggcggccgaggcggcgcagggcgacggtgacggcgagggcgtgggcggaggctacgcggcgaacgaccccgtgttcagccgccacggcgagctgtacgtgttcccgtacgtccgccgcgacatgctcatgatcgagaaccagctgccgctcctcgtgctccagcggatcgtcgccttcgtccacggcggcgccgcccctgaagcggtgcgtgcgtcgtggtatgctgctgctctgatcaactcgagtgttcgattagttgctgattaactcgccggcgtttggttgcagagcgacgacgcgatcaacaacatggtgctcagcttcgtgtcgatgatccctgacccgccggcgatgagaggcggcggcggcctggcgctccacccgctcgacgtctgccaccggagcctgctccatggctcgccgccaaggccgtgccatacggggaggcgagaggagttcgtgccgtcggcgacggagctcgaccaggcgggcgtccggttccgtcccagccggacgcgcagcctccacgacatcagcttccgccacggcgcgctccgcatcccgcgcctcgccgtggacgacacgacggagcacaagctgttcagcctgatggcattcgagcagctgcacggcgccggcgccaacgaggtgacggcgtacgtgttcttcatggacaacgtgatcaagtccggcgacgacgcgcggctgctgggcgcgagcggcgtggtgtccaacgggctgggcagcgacgaggcggtggcggagatgttcaaccggctggcgagcgaggcggagctggaccggcggagcgcgctgcacggcgtgcacggggaggtgaacgcgtacagggagaagcggtggaaccagtggcgcgccagcctcgtccgcaaccacgccggcaacccgtgggcgatcgtctcgctcgtcgtcgccttcgtgctcctcgtcctcaccgtcttgcagaccgtgtacaccgtgctgccctactaccaggagcaggcggcagccggcgaggctgctctccgcgaactctgacggcatgatctagtgggaaatgat

SEQ ID NO: 14266 - DNA, 13991 bp, Oryza sativa
tgcatgcccgagcccgtccgccggctgcagccgcctatctgagagggagagagaggggccgggcagagaaaaagagggacctaggagagagagggggagggagagatatgacaagtgggcccaaggagtctttttctgactggattgccacgttagcaccacgtgtgcaagctcaagccaaaaccactttgaacagtgtcgaggggggtaattcgttcggtattaatagtttaaggtgagctatgtctggtttctgagttcgggggtaattcagtcgactgcgatagttcagcggggtaattcgtactttttccgttacaaaatgtatgcatgtacaaaatcagtgtagtgcatttttccattgttctacagtaggtgaggatgcaacatggttattcaattttcaagtaaaaaaaagaataaagaaaggacaagtagatctatatgaaatgactagccgactgatacaaatttatatgataaagtagcaaagcaaataaggtcataatgcataacataagagtatgccaaggtcaaacaaccgattacataatgccacgtcgtgttggcgatgggtatatacaatcaaacaccgtgtgcgacaactaagcatggactggtatcactttttcctagcattgtcccaagtccatcggagccatgctttacgattctctgcagggtaaatacacctaaaagctgcccatcgtgcagctgacctaaataggtcagtagctatgaaatacaactcagatccttgagccacaccatcctcttctacaagttgcagcaattcttttatctcatcttgctctcccctgagcacactgctttcattcctgcttctttcgagcatactctctgatacgcaccctacatagtactccatatttttactcttcttgggtggtgggcggtcaaccacctgctccttccctgccctttaagccacacggccagcactagacaagccgacattgtcgttagacatcggagtaaggttgtcatcgcttccactgcttggtgttctcttgccaataccacctacgcacaacattgtaccttcttcggtgtccatgcaaccaaaatgagtagtcagctcatcctcatgttcaagcggctttccacggaactgtctggcatccctattctcctacaagtcagatatggacaatgtaagtttgacgagacaataacaaaaactcaatattagttttgtagtaaaatcaatattcacatgtagttacctcaatacggtcttcccaccaatcatcatcgcaccttatggtgctagaattgttgtcccacccacctccgctcttattctttaggctcttccatagcttgtattgtctcttaaaggtgctaaatttgttttgaagctgtttactgtcatagttcttgcctgattgttctctgaaattgcgatataaattctgccaacctatgttggtacgacccttcttgttgtgattgcgctttgtcttctcagcaatgcataagtcgaggaatatctttgtgagggctttgtcccaataggtgcgaccaccagccatctatgtgtaattttgcattacatgtagtccaacttaggagtttttgagatcttaaacacagtactaacatcaagttgcaggtatgcaaaacatttttcgcactgataactaatatgagaaagcaatgcttgccttgagttagttctgccgtgcaggagttgtacgcagattgtatcatgcggcttcaggtggagaccatgacgatgtcgaccggcggagggaaatcgtttgttcagattgaggattcctacgtacaagtcgctcttgtgaccttacaagtgccaaccgctccgtggtgccatatcgtctcaggttatgtgccagcgcttctggttgcggtcctacaaatgtccaagaatcaaatcagcagttcgtatgcctgcacaaggtgcccttcggccgagttgacatggcgaatggtgccatacacaaatacccctaaaaatgcaagatcaaaaatcacaaaagggagatgattcttacctcctaactgccggacctggacggatctgggggagaagacgtcgccagcgacacagcgtgggtcttgcccgacgggatgtttcccttggctgcactctatcccctcaacaaccacaccctaatgaggttaactccagccgactgtcgagcttcccctcccctcaacccccacagctgaatcaagatgaacttcacatcctattggatttaatcgatcatatcgggagtggtgagaggaaaaaaggaaggggatgggaaggggtggcgtcgggcgcgaccggaaggcacggcacggctcggagggatgaggatgggagagaacgtggaggagatcgggaaggcacggcgtggctcggcaggaggaggacgggagagaaggcggaggggatcgagacgcgctcggcagagtgtgggccgtggcgatggaagagaaggcgcgatagggtggagtgtgggctacgcgataggactgggagatgggaactagaagaggggcgtcattttttttggatttcgctatatctcactcgaaagatttttttcttatctctcactcgattttctaactcaaacttacagtgcattttcttgtaagttacagtgtaatttatgaaacttacactataacttttgtaagttacactgtaatttttgaatcttcgcatgtaaattttaaattttatatttgatttggtctttttcttgaggatatggtaatttagtgtccattatggtgtttcttaattgctttttgctttttattatatctatcagattttaatataaagattaaaaatctgtgtgatacgattataaaaatctttcgaaagatgtataggtactttcttttttttcgcgagaaaccaactttttttttgcggggagtgggttgcagccgtttccacaaccgaacgactgggctatgcaacacagcctagaccactgcagccgaacggctgggttgtgcggcacagcccaaacagttgcgaaaataggctaccgaacaggcccactatcgttgactaaggaaattccatttttccttaaaacaagatccacctcacttgttagttttctaatcctatcttactataacgtttaacccactcaatcttaaaactcaatatgcaaagatgtcacattatcattcaccaacaattattacatcttaaacatcatgcaagcatgctatattatttataattctataatttattaaattttagaattttatgcaagcatattaaatcatcccacataattcacataatattttaaaatatatctttatcattttttataatatcttgtatacctatatagttcattcttccttagttaatattattttttcttctctcattaattcatatcatgttaattgcttttagacattagatgattaattcatactccaaattatctctctgtcgaagcaaaggaacagaagaacgaattcttacatttagttaaagctggaccccacagcaacaaagcgcccatggcctaatggataaggcgtctgacttctaatcaggcgattgtgggttcgagtcccactgggcgtgcaattattttttttttccttttcatttcgtttttttcggccttctttttccatttcttttggttttctctttgggccttcttcccgtggactgcagatcgctccggtcggagatgccttttgctcacggtgaacgttacatgctttaaccagcggtcaccagaaaactagcaacaatcctgcagtttcattctgtttgccatactgcaagcttgcaacacagcaagagtgaaccattgtccatgcataaactcgaccatatcaaaattgtcgtctacaacttgcacgaacaatgcagaatgacgggtaaggaacgcagcatcaacgcgtgctcattttttttccttctttccaaagtgtacacaaaattttggttctacctggaactgtgatgaacacaaaccatcccagagtatgcctggaatgaatcaggcactgaaaaattggggcgtttagtaagcacgttatgcccaccactataaagctcaggtaaatatacatgagaatcaaggctcaaggaggtaacccctccagaactgcaagtagccctcttgctctagcagtaaatcaatccctaatccgtcgccgaagctagtcttctcggctaaagttaaaacccattgggcttattcccggatttcgatgatttttgctgctgctccaagtcatggttgaaggcagcatccaaagcctggaaagtaaatataaccagattgatggcatttcagcagttgaagaagatcatcaatatgcaaatgaaagaagacatgctgatacgtgtacaaagacagcaagtgagcaccgctgaacagttaataggtagtagtagttaaaatatcaactgtcaagcaatgctaatacagataagctgcaacacaatgagcataaagaaatgctaaacaaagggtagctcgaaaagaatgtggaaactcatgcagtacagtagcatgattgagtcgtcataatgaagctgaaataaatctattttgcatatggaaaattggaaatgggacaaaaaaggatatagataagaccgtgggtcatgggctttacaagttaagatatttcgtgtctcacatcaggttgtgctgattcctttatatcctgcaggtggaagttatgcatatgaataggggtccagtgagaatttcatcaccaaaacaaggtacagttccataacatcataagaaagtttgaagtcaatttcaatacaaacccatttctgtaacatgtttgagggaaactatagtttaaggaagagcaattccagctagctatcatcttatcagtaactcatgctcaaaaggtaaaaactaaggtactccacatgatgaactcgaagaagataaagaggcaattgtgatggagattacctgcaacttttgatatatctgggtcattgcatccttaattctttgaacctgccacagaagtacaaaaacataaacactgaattcttaatcttgcaaatatagttcaaggcttagtcttggttgtacagctattccacccacatgactgcattccccttttgtttctttttataaggcagaatttttcaaaatttgttgcaaaatataaggcatgcattggaagttattggtggttttccttatttgcctttacatattctcctacatttctcagaacatctcattaacattccctatcctgtttcaaagatatttcatttaagtagcaatagagtagtcattttatcttctcttcctcagtttcataccctacttgatttcatgtatcaactcaaaataagccttatattttcagatgaatgaagtataaaattacttagtctgctttcagtaatattttttttcttacagaattcagtgcaatatgcagaaaaaacaaaaagagctgttgtacagccaaaacaaacataaaaactaggctatgatgaatttctcatgatgttgcatttacttttacaaataaattcgcaacagtgaacagataaccatgctgctaccacctgaatccacaattgaaactgttcactttgggaaccctttttttcttctgagtgccagacttaatatttagttaacttaccgctcataattaatgggcaaaattttcctttcactctaggaaaggaaaactacattgacaaaatcactataggaaccaaatttattgtgacccagtaatctactgatactgattaccatccaaatgctacacataaattacgtaatggtgcagaaaagtctgggactgataatataccttattataaagaactgaagttgttattggatatgatgaccaaaaatgctgcaataattcctggatagctgcccagtgctaagaaacagagtttacaataagtaattctgtaatacaggaactaaaaaacataaaacaaataaatgcagaaaatattcagtacagaaaatgaagtcagcatctcacatccataagttcatctcgtgtgcgtcgagggatttgaccaagcagactatcttgaggattcttaagattaagtcttcttgaacgtgaaattccttcattcaattcattcagaacctaagcccataccatgcaggtagttaggttttcctgctcatgcaatttaatagcttaagaatagagaagccacagtaacagtagtgcaacgtcatgcagaacatgtgtggatggaaaaatcagatgtgcagaggctttctcatagctacatactgcacagttaactaaaactttgttggtcaacatagtaaatttcttaaaatgtttgtacaatctgaaatgctacatcacccaaaatccaaacaagtttcaagaattaccctccagtcacaagtaatttggatatcaacatggtcctcaaatgcagctttcatcatcaacttctggtctagtacatgtaagaaaactaacaagacagttatttcaaaagtttgtgctattcaaactagtttctaaacccttgttctatatttccccttgatcttagtatccaacaattatgtttagcaataatttcctaagccacaaaagtgcttttgggacattggttgttatgggttagggcatagagggtaaataccactgggaggatagctaggcggcgacggctgaaagggatgagagagggacttagggttgggggagactaattctgattcattgcttaattagaataacgatacaatccatccttatatagatggagggaaggatccagtctagactatccaagtgagctaccgtaagacaagggaaccgttccctagggacactagggcctcaacctctcggccactacccatgacattggtagtttacaaaacatgactttgaccaatgaattataaattttagaacaatcaaattattgtacaatacttataaaatgcatagtaaaaaaatgcccaatatgcaaagtatgatgtttgactgcatcctgaaacatcacttttttcactggaggtagtagactattagcaataatgtaccagcttaaggaggttgcctatttcagggagatatggcctactccacaaagatggcttaacataattaaatatccatattagtgtactgtgtaaaatcatttaccttaagagccacatcagactgaataaccggatagttcaacccattaacttttatagaagatatttggcccaacaaatgatcaaatgcatcatctgtactcagcctgcaattacgagcatgtcttccatcattgttgccacctaaagatctcagagcatttgcttgttgggaatcaaaatattctggaggatcctaataagacaaataagagatgataatctacaagttaaaatatattattccgattcatcgatctacgatgaagccatgaaatattttttacctttatacaaagtggtgcgtatgaaaggctccgtgaagcttgtagatcctctatcacagtcatgcgggccactttaacaaacctctcatgattggtatcatcagaaatagaacttgaaggtggttctgcagctaataatatttcatcagcataaatacagaagtgtgactaccaaaaaaaacacgttgaaacataatttgtaacctttgttgaaccttgcaattgcttcagcaacagtcttcgtatcagttaattccacgtctgcaaaaacacacaggcacccatccaatttagtcacatactggactgcgcatatatgttaaagatgcaaaagttaacaggcatatgcagagcaagaaaatgcagcatagcatcaacgtatgaactccactgtggagaaagtacaggaacagcacagtgaaattacaagtggctagtagcttagggtagttgtttatataattattatcaggaaattaattctttaagactcagttccaaagaatagtcagaagacttcaatcaacagggtagcacgaaaaaaatgtctattcagttgcaaacaaataaaagcaccctcaaatacctgagggcagttctcttataacagatgaaaatatttgcacaattatttagtatcaaatgatcgtagaaaggatgaaatatttctgacagatccaaaacttttacctgaagatcttccttcaagcacaacagcagcatggcgattcagatcctgcgaaagtgttctcctggccaattcaccatcattatcaatcgtctctttactgccatcacgaataatgccatggtcctacatgcccaacaaaatattatcaaaacaggataagcaactcatgatttcgataaaaagaacagatatccttgctcaataaagatatatcactttcgtcttcatcaagttgcatatgcaacagaagtagagaatacagacgcaccggaagatggatgtagtcatctccagcatctgcctccatatctaatgttggatcgactcgttttatctgcagggaagaacagaaccgcttaagaggaatgaagaaatccaactcccaagcaatagcacaaatgaattggaataatataagcagtatttcaagacatcgaaaactgtaccttcaaccttgcctcctttgctagtatatcgtcattcttcagaaaaatggctaactcttcatcttcagcagcctcagcagttgctgccacagtattttttgtcctaagaagatactcagctctaaaatattttgtccaaaaatctttttctgacatctgttttgagggagatgattgcatggaggatcaagggaaaaggacgcaaaaaaaaaatccatttacatcaatacagaaatagtataaactcaacaccatcataccgaaatttctaaagtacatgcgaaacaaagaatgaaggtataatacaaatgggtaagatcttgccttttttggaacaaaatctaaaaacgctcgatgcacagctggcttttctgcaaatatctgcagaacattaaggtatattcagaacatttgaattgttcaacaatttgaagtcatacccattatataatgcatgccaaacataagcaagtattatattgagcaaacatagccaagcccaatgacctagacaaagccctgatttaggagcattacagacttgtaagcctaggcatggatgcaagaatgctttcaagtggtacaaccgtacaagccctttggcctgatctagctgacatgctggatgtatactccagacaacaaaatcatatagtttcatgaataaaaaatggcttaagtagggatcaaaccattctatatggggactaaaaatacagcaaattgcaagcctgtttagatataaaagctaagaagcttgaaccactttgttttagcttgaatcaatatatgcaagaatacaggagttggagccctgccaaataggtgtagagtctattgtgcaatgagaaagattctagtaattctgaaattccatcccacaaagtagatctgtagatataacttatttcttatagcatagaactgcacctacaacagttgaggaaacagtaaaacaatactaagatggcctgtcctaaagaatcatcaaagtcaaatgaacgtacctgatgaattatctcggtagtgagactaaaagtaaccttatttgtctgtgagaggagtaggaaaaagaaagaaataacatcaatatcaccagctatcaccaaagtgaatgtctggcaagataagatacaacagactagaacataataaaccataatttacgcaaaataaataacgtacccgaccatcagccgatggcctaacatcagctagcatggcacttttgaaacctggcctttgttttgatcctttatttgcttcgtcctcaagtaaattctgtaaaagttcataaagacatgatagtttcatgagaataaattaaacaagcatatcaggaagaaacatattttgcttgagtgagtgaattttacctttcttgttgcccaaaattcagattcttgcagaatattgccaagaacaaacttcatatgtaacttctgcaattcactgtgaagacccaaaaaaaagctcaagattgtaatacaccatgtaaatttttgtgggtgcgacagtttgcataattttgcatcactttctcttgtaagatatatgagaactacaatttcatccatatagtaaaacttaatcaatatagctgcataaccatgttctcaaaaagaagaaatcaaaaatatatatatttatatcacactaacatcagatgacaagcaaaagccattaaatggaaatggatgcacaatgctattccaatgccacagatttcaagccaactataattcaatataaaataaactggatagaaggcatatattatctctattatttcgttttgccaatctggcaggtatctaccgtttaattgcagcaaagctcatgaaacagaccaatagatgcagttaagacatgaaaaatctaatgctgccttaacctaacaaaatctgaataaaccaaatacttgtttagttattcccgctcaaggctgttgccaaggttatattcctaagcctggatattactgtctgtgttccgcatacaatttgagattttcagtggatagcttacattttgaattgtccattatagtgttggcaaatttttttacattatagacgcataagagttttaagggaagtttcatctgagatcatatttttgcaaaaaacaagtaaccactggccttgcactggattatcataactacatcatgttgctgtaactaaaaaatacaatagtgatgttccacataatcacattacctatcttcttgcagcaatttcatccgacgttgcatttctgcagcactaagctgttcttcaccagttgaagtaactgaattttcagggggcacatttggtttaggcggtatcgtaccttgttgcttacctaaaactttagctgaaaagagaaagccattggttatttgtatgctgtgtcagggtataaatgtactgttggactcaaattcagaatcttcaagtcaatcggtaaaaaggactcagctggtggattggtttacactaagtggacaatttcccacttgatgcttacacaataatcaatactcaggcaaataacaaaatactgttatttctaactttcataacctacatttgacatcaaactgaaataaaagaagctattttaggttccattcactttacctacaaagtcacgagataggtcgcggttagtaacattgtcaaactcaaacatgtagcctccaccctaaagaaaaaacacatagaaatttcaatttttctcaatgacagaaacaaatgtagatcatgaatagaaattcaacaagataaagtttaaggtagaattgcctataccttgtcagagtcttttgaaagattcagtaatggtggagctggtttgctaccatctactttgttgaacttgtggcctgaatcagaagtgcatgtgcacagaaagtacaaagttgacatcagacaagttggtcacaagcatcaaatcaatccatctgttttactatgcatggtctaccttagaatagctatatattatcttgatttcccgttaattaatgcctttgcagaaaacatatttcaaattatccacaaaaggaatcagatataagaaatatggagcctggtctgacaaatggcaatcacgaattggtcagtttgttatttactaaaccactgggacggtcatagtactcccactgtacccaactataaatagaccaaatgaaattacctttgatgctccggaaatcaacattgagcttcatcgctgaccgtggatcatggggagtgaaggtgaacttatcctcgttctacaattaaaagtatcaaacgatagatgccatttagacccagcaagctgtgcatgaaattaagcaggtagaaatactcaagcaaaatttacaacgcaactacgcaaaactcatcagcgaatcaaacagatatgcaactcattgcatctgatccacagaaactaggcacaaaacgctccactacatgaacccaacataaataactaaccaccaagctagctaaaccaatgtctccagaagctcatccctcttatacatccgactaccgcagatcggttcgattcctttccaccacaaacccctccgaaagcatcagaagccctagcatacccaatcaaacactaccgcgaccaacacccgatcaaaaccctcccgtcaagcgacatccctccacagaatcagcacacccaccgcacctcccgcggagtgtgtatccagtagggcacggccgcaagggttaaacccgaccaatcggagctggagggagagaggcgacgctatgcgggagagagagagggagggaggaacagaggggggatcgcgacgcaccatgcgcaggacgccggtggtgccggggtccttgagcgtggtcttgtacttggcgccgatcgtcatggaccccatcgccgtcgccccccacgccttcacgccgcaggcagacgcgcgggggagaacgcggctatggcccgcggccgccgggagggagggtggggtacggcggctgcggcggcggtggcttggtttcccccaagtcggtgcccggccgtcgactcggggaggaagagagtgagaaggatcgcaagagcaggtctcttctctgttctttagcctaggccttcgcttagaaaggagtaatttttccccttttttttcttgggataagatgggcttggcctgttggtccgtctgggcttcttatcaatactgggccggtgtttcttttcttttacgaacaagtacaccaaaggtccctcaacttgtcgtcgaattacaaaatcgtccttgaaccgcaaaaccagatacaacgcgttcctcaacttataaaaccagtgctaactaggtcacttagcggttttgtccgatgtggcagctgactcaacgtgggatccacatgggtcccacatatcagcctcttcttcccctcccctcaccacctctcttcctctctcctcccctctccacgggcggctggcagagagcagatgagtacggcgggcaagggcggtggctagcgagggaggagctgccaccggcagcagcggcgtcaccgcgatcccgcacctcacccctccacctccacctccgccgttgatgcaacaaacacacgcacgccgcactcccccacacaccccgcacgcggcgcccgacgccaccgacatgacgcagcccatgaccgtgaaccgcccacggcagcgcggccctccgctcctcgtccgcccgagactgcctgctagccccagcccgcggtaacaagccgccagatgacgacgacagtttcgaggattaggagggcgcacacctcaccattgcgaccctcgcccccatctctgccatcctctgcaccgcccttcgacctcgacggtgttcgcgccatggccgacggcggattgctacctttccgcccgttgccgccccgctcctgctgttgccccactccccccgccactgtcccaccggctttcgacatgtcgcccttccgcccgccgttgcactgcttctcccacccgcgacatcgccccactccacccgccttgcctcgcttcgcccgcctgctccgccgttctcctcatcgcccaacgtcgcggcacccgcccgcgcgggatcgcttcgccgccaccgacgacacagcaccatcaacgccattcacgaccgggcgccgcccttgccttctcccgtgtcgtagccgccgccgcctcgtcgcccgccatcgcctcctctcccgcctcaccccaatggcctcctcccagcagcgtcggccggcttacctaaagaagagaagagaagagtgagagagaggaggaaggaagaggagggggaagagggagggtgttgatgtggcatcctgacatgtagggcccacgtgggttccttgctgattcagcaaccatataggac

SEQ ID NO: 14267 - DNA, 40432 bp, Oryza sativa
ttttttagagagaaaaatgggctggtatttcagctgccagatagtcagatactccctccataaaaaaaatcaaccttgtactacgatgtgacacatcatagtacaacgaatctggacgtctataatgtgtcgcatcttgtcttttttgggacggagggagtagaccaaggatacaacttagctacacaaacacaaaattcatttgcacgaaccccactccatgtgatccaaacggtgtgattttgcgaagttggtgtagcttttctggttagtttgtttttgtggtgaaacttgtttactggatcaaacagatgctcaagtttacggctaatcatttttttagtgttaagactatgtgccgttgataacgatgtgatttcgtcaatatcaacatatgacggcctaatcttgccgagatacttgtaaaaataggatgttcatgtgtgcgtgttcacataggtgagtgtacgtgcgtctgtgtatgtgagtctttgggtttgtattgtttgggtttgtattgtgtttctcacataagaacagtgtgattttaaaattcattttgcctaattcactaaaaatgatccatgaatatcaattttcagaaaagaaataatattatgagtttgttggaattaaagggacctcaagtaagaacaaaacaccataaaaacaattctataaactttagatacgaaaactgaagcgtaccagtcaccacttgaaagcaagagctatgttttgatcttccgaaacaataggcagatctaatttcttcagctactaacagtggattggtgtgtacactgttttgaaacctggccttgtatttgtataggcaaacatgacgtgttggattcgtgttctaacttctaaatcatagtactccctccgtattttaattttaatgtatgacaccgttgactttttaaccaacgtttgatcattcgttttatttaaattttttatgcaaatacaaaaatacttatgtcatgcttaaagaacatttgatgataaatcaagtcacaataaaataaacgataattacataatttttattttttgaataagacgaaaggtcaaatgtttgttaaaaattcaacagcgttatatattaaaatacggagggagtggaaaataagcaggcagccggtctacaaatacatgcatccatgctcctgtaatacaactcttgatcgccttattttttggcctattaacgtaacagccaggaaattattctaacgccaacccctccgcggctccgcctgttaggacaactagataaaacccgcgtattgctacaggagttattgtgataacaaaagataaaaataatagtatgtaacgtagattaaataacataagcttatatatgttgaagtgatttaaatttaagtagtatatagaatgattattcaaatttaaaagtaagatgatttggccagagaacaaaagaaggaagataatttagatcatatatctaagggttaaaaaattgagttgatatggcttaacgagagaaaacagagataacattaatgaagtgaggatgaacttatatagccatatatgtatacctatataggatattataaaaaataataaaaattgagttgatatggcttaatgagagaaaacagagataacattaatgaagtgaggatgaacttatatagccatataggtatacctatatactccctccatttcgaaatgtttgacaccgttgactttttagcacatgtttgacatttcgtcttattcaaaaacttttgtgagatatgtaaaattatatgcctacataaaaatatatttaacaatgaatcaaatgataggaaaagaattaataattacttaaattttttgaataagacgaatggtcaaacatgtgataaaaagtcaacgccatcaaacattttgaaacggatggagtaggatattataaaaaataatggagagatatatgtgaattatgtggggatgatttaacgtgtttgcattttaatttctaaaatttaataaattataaaattatggataatatagcatgctttcataatgcttaaatataataattgttattggatgatagtgggtgatgatgcgacatctttgcatgttaagctttagaatttagtgggttataagttatactaacttatactaagtgaggattccaacaaccttttgattgtaccagtttattcagttagagagatactcgcgtttgaaattttctgcatgaaacgatcaaaatatagacaacactctgatttgttattaatttcatttagaacatcacggcatagcactagtagtaacagtacacacgagctgtaattttgtcaagcaaaaccaagcagcgccacgccaagcttggcgagcttgaaggcggcgtcgtcctccgccgtcaccggcgacgtcgcgttgcccccgcggaacccgtcctcgcaccgcctcgccgcggccgccgactcctccagcgacgacctcgcctcgccgagcctgccgcccctcaccgccgcggcgcagccgggctgcctccgcgcgatgccggcgtacagcgcccggcacgaccgcaggcaccgcgccgtggcggcgtccaccttcccgccgcttccgccgccgcggagcagggcgtcgatcttgaccgacgtgctggtggcgttggccgtgaggaggccgacggcgacggcggcgaggtcccggtagctccgggcgccggcgccggcgccgacggagcccagggcgtcgaggcagaactggacgtcgaagtaggtgctcccgccgccgacggtcttgcacgacggcagcaggatgccgtcgccggtgacggtgacctcggccggaagagcggcgactacgaagaggagcggcaagatcatcaggaaggggacggtgacgccacgcgaggaggaggacgccatggccgtcgtcatggctgaattttgtttctgcctggctggccgagccgtgcgcgtgtgcattttgaccttccgaaagactaaacaaaaaaagaaattgaatatttgaattgactagaaaaaattgctcatgcgttgcgagagtgaagactattttaatcttattattattatacggtttagataaggtgaaattcacggtaggaatttacttggattttttttttataaaatcatgagctgcaattaagagtctaatcatctcaaggtagcatgtgcgagtttttttaaaagagatttcttatatgtctccttctaaatttctaaaagtgaataaacttaaaaaccgattcaaacacgctttagcgaatgaactaaaaactgacttaaatacggatgacgtaccaaagtaccggtaaaaatatgttcaatttttataatgtttaatttccgtaacgatcaacatttgtctggatacttacttattttagctttacctggccgatttctttcgacttcggattataattatttatgtactttatagtaacaaaattataaaaatttaaatgtcaattcaaaggtattgttttcagcaaataaatattaaaggtactttatttattattttgaatggtagaaagcacttttaggctgtgttcggatgccccttttctcaacctctctctcgttttccatacgcacgtttttcaaactgctaaacggtatgttttttgcaaaaagtttctatacgaaagttgcttaaaagaatcaaattaatctatttttcaaaaaaaatcagcaaatacttaattaatcacgtgctaatggaccgctccgttttccgtgatcacgattctgaatgggaacttcttctagcaaacacagccttaataggtcttcccgtagcgtcataccggtatgcatatgtataaatagttaaatatagtataatttttttataagatacattaatataaattaattagtccaaaaatgcaattacaaatttgatcaacacttgaagaaaaaaataacaaatcgcattatgtagtgtcaaattttgttgttttttctctttctagtaaatcaaattttcacgtgcatgtttttatatacatctaagagcaagtacaatagaaaattataaggtagctacaagcacatatgaaggaaaggaggagaggagagagaataaaagaagatactacctccatcctaaaatacaaagcattttaggatagggagtgcatatttatagtcaagtgcaacacggactataagaaagtatgtataagaggtgagaccagtattaatggtgtactacatatttatatatgaaactattatatgtgtaaactactagattagctctatataatatctcaatttttagagctagcgggctattaaacttgctctaacaagacaatcgttttttttttcggggaaacaagacaatcaatttaacattgcatttgcatgtactaagcaaaatatgcaattgcaccggtatagaaaatttatgttccttttgaaatttgaattgaggtttgatactttcaaattttgaaaggtgtgtctcttggcccacctcttttaatacaaaattgaagagattgtggagagtgtgccaagaatagctggttgcccatcccagctttcccggggtggttgcacaagtgtctgcaacccaaaaacacttcggtgctcaagcgtaggcgtagctctgcagccctgttttgaccatttgaccaaccgctaaaccatgaacaacgttcttttgtttatctgaaggctaaataatggataatatatttttcaactatacgaaaaagaattactacgtaccatgatatctgaaagctgttggatctagcgaggatgtcatcatgcaaggacgcagtggcggcggaaggcgggtgtcaggtgggactacgaggcgaggtggggagccggtgcggccgtgcgggtgtggtttccacctcgggcaggagggctgagtgacagagaggctgctatgtggagaaaggttgcataagtgcggatctgacgaggcatgacgcatagatatagtcaccgtggagacgtggcagcggtgagttccctcgtcgacggtcacctacgtggcgatgggagacggtggctgagggcatggtaggtggttgttggcagtcattaagcataaactttaaccgtcaactactgtataaaagatatcagcaatacattatcaaaatttagtgacaggagtttaccactaatcattttcactagttttggtaaatataatggacctccgacgaatcaagtgcaggcacacggattgatgtgcccacaagtcagcttaaaccgacttaatatggggccaaacatctgtgtaccgccttaggagcccacttgctggtagcctctggtgaaaggcggtggcgagaggtggggcccatgggtcggccgaacccttggttcgaccaaaccacccgtggctcctctcatcgccaccttacacgtggacatctgtgatggcttcccaatgatggttacaagcacaccaacctccacaactgccttacaaccgccattctcaagctataaaaagaggaggcttccacacttctcaacacacaactttaagctcaagtagagtacaacttgaaagtgttaattaagcctagatgggggtgaataggctaattcaaaaatcaactaaaagcagaagcagtaattttcggatatttccgaaattttcggatatatccgaaaattttcggagtcagcacaaacaggaaagtaaatcctagatctagttgcctacaacaagaatatgctagcacaaacagcaactagacctatagcggctcaaacaagcaaagctagaggagagggaggaagtaaagtcaccaaagatgaagctcacgaggttgttcccgaagttcgaattcttgaggggattctactctccgttgaggagctcactaagagccgggtcttagctaaccctttcctcaagaggttgcactaagcactcctccttccactaagggtatctcttccctttcagaggtgagatctgaccttcacaaacttctcccggccaaccacaagtagatcggtggctcgggagcgacacctagccgcctaggagttctcaacctccaagagtaacaaatgaagcaaagaactcccggagatgatgcaagtgctcacaaatcttcatgaagtcaacaacaagcactcacacaaactcaaatccacaactctcacacacacaccaaatccaaatcgaacacgggtgagaggggaaacaagaaagcaaggcacaaaagtgctagagagagagcaagccaagggcacaaatgattggaatggaaccagcagccctcacaagtgaggggagggggctatttatagccacagcccagattctgcccgttatgcacaataattgagattttcggacatgtccgaaaattccagctcagcaccaacagcaaagtcaacgaaggatttttcagacattccgaaaacttttcggacaagtccgaaaatttctagtaccaacaacatcgttctggatgttctcagaaaagtccgaaaataactttcggacaagtccgaaaatatacagaagcgaaattgactctactgatgattttcggaaaatccgaaaatcagtttcggacaagtccgaaaatatacagaaccacttttgccttcgcagtctttttcggaaagtctgaaaatcactttcggacatatccgaaaatttccagaagcgacaatctggttctgtgtgttttcggaaagtccgaaaatgagtttcggaaaactccgaaaaaatccagaacacaccaaactgaggagaaacaccttttaaaaatagattttgagcactttgatcactcctcgtatgtcaatgcatcatccctcttaatagtgcggccttcctattaactcaaggaaacgaaaacgtacaaaataccatttgctcatttgccgcatcacatcacatcaacgtattccgcgggatatgcattacgctaactcattattgaggacataacaaccttcacatttgcttaaataaaaatattagtcctctctaatcgcattgtaattaatcaccaaaatcattaggggcctagatgcactttcacaactcacttgtagtttcatatttagtatgttactttggtatagagtgaggggaagctccggaaggagtgcctcgaaatatcggagttccttcgagaattttatggaggagtgttggagtgtcagtattcttggaacggagttccggagaaaaccaggattgtcggccttcttctctcgcttatatctcggcggatactttctttattcaagtaagtgttcaagtttctttatgttctttaattaatttatttaattgagatatattctcatcggtgcgggttcattgcttagtgtgcaattaagtgctctattactagaactctggataaagaaagaagttcctgcgcaaggttagagtagtaattaataacttaggcgtggtgtctaggttaaaaattaccttcgtctgttgtgtgctcaacggaaaatgaggtaagcggcatgtggtgatagccttgtccgtccttcatattcctccaccatcgggtacatcataaagctcaaggccaaactaatcctggcagaccaggggagggacggtgcccgaagcattcaatagagttgtacctttaacttaattaattaattaaaagatataggaatcctctctagccaatttatactaagttgttgtccttggatcgaatcttgatagttgattatacacacattgtaaggggaagtgctacaacggtattccatgccctggccatggcttcttcgagcctagtctagccatgttcctccccttgttgagcctccggcggctatcgtcgccgaccccccgagtccaccgctggttgccatttttctgacccagtcatctgaccaacattggtgatgcatgtggatgccttttccttttctctttatttctttgtttggattgtccgattggatttcaatcggatttatggacaaaaattttcatggacgatgaaagcaaattgaatcggactttcctttttttttgttttaattttttcatcgttattacggacgacagaaatgttttcactttttaagtagtagagatacactttgataccatattgttcaacccaaaagcttaagctgatgagaaaaggtggacaattcactttatattccaacactccctcatgcgatgtcacaccctgtagttctcctcccaagcctaaaatttaatttataaatgaccctaagaaaatgccggtgcaaatcaagagaaaaccctaagaaagtaatacaaataataatcgaatctggcatgtggaatttttagtggaattttcagagccctagaaataatttttagtcactaacaggatttttagtggaattttcagagccctagaaataattttaaccaattaaaattgagcaaacaatattttaattccagggaaaatccttttcttcctttttctttttctttttcccccttttcttttcgagtgggccgccggcccattctccttcctcctctcccctccgctgggccggccgaaggccaaggcccagctaggccggccgcctccctcctcctacccgggacgccgacaggtgggccccacctgtcgggcccatctcctacctcgcgcccgcgccgccgcgcccgcaaccgccgccgcgcccacgcctccgcctcctccgggccacgtcggtcacgcccgcgcatgcgccgcaccttccgcgcccactcccctctctctcccgcccgcgcccgcgcccgagatggccgggattcgattttcgaatcctgcctctctctctcctctcccactcccccacgttggccggcggaatctcgcccctaccggccacgttcgagactcccctctcctatttaagctccgccgtcgccccctctctctttttccccatttcgccgaactccctcgtgctccccatcgctcccacgccgtgcacccacccgccaccgcctttcccgccgctccggccgccgctagccgccgctaggctcgccgccgcaccgcgccgtcgccgccgtcgggttcgcaaggacgaactccaccccgtccgcccttcctccgtcgggattcatcgccggaattcgcatcccctcgcgctccggtgagttctacctctaccgccgccttcggccgtggatgccggccgccgtggttcatctccctctctctaatctctctctcctccttccttagggcaccccgaagcccgtccgccggttgccgtcgtcctcccgtggcttgccgtcgccgttcgccgtcgtcttcctccgcgccggccaccctcggtgaggcttcctctcccctctattcccctccctctccttcctagccgccgcttagcgccgccgccttcgcgtcgcctttgcgccgtcgccggcaacgcgttcgcgcgcgcgcgccatcgccatcgccgtggccggtcggccggccttgagccgagccgagccgggtcgccgccgcccgtccgatcaaccccgggggcgatctgggccgtcggtcccgtggaccggcagtggaccacccacgtggtcccggtccacggtggaccaccctcccttgagccgctgccgagtagggcccgcttgccggcgcaccttttccctctctcccgagccgctgaccggtgggccccgcatgtcggcgccgcgcccccccttgatgacgtcagccctgggaattattgcgcaataaatgatttaaggactttttttatagtaataaacacagtgaatcttctaaaattcataactaattcatctgtgctccgtttaagcccattcaagtctcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgagatagtcgccgaggtttctccagcagcagagcaaggcaagtcatgcttgtcacttgaacatgttgatcctatattgcaaatgctctattgtttttcttcaaatattgcattgttttataatgttactatggggtgtttacctattgttacagccatgccatttttgataccatgctcctttgttagcttgggttataacatgaatagattttggactaggaattgcttagccatgcttagttccactagcacacaatggggaaagctcactaaaatatagactttaggttcaattggtaaggttggtttagtaccaccgttttggtgttggtcaattaaaatgaatcacatggtgggctgtgggtgcatggttctgctagtcgcacccatggcagttaaggaccggttcgcgggatgccctggaagaacttatcatacttaccacaagccagcatgggcaacggctgggcttgtagtgtagctttcctctagctgacgcatccaggcaagggtgggcgtgatggagcggggcgggccctgcgacggcctctgtcgcttctggattcacctaggcacgagaggggactgcccgctgctttgcaaggagtgggggtgaaacctgaggtgtggtgtgcttggttagagggggttatgcgaagggtcctgtcacggcctctttccggtatgtcgtggtggcatgtcggcgcacggaaacgtgttatggggctgtgtcttgtgggtatagttgtacacctctgatcagagtaaaactattcgaatagccgtgcccgcggttatgggcggtcaaccagattcaccgtgattagtcttaccctagtttagtctaatgaaattggatagtataggtggatggttgggcctgttgcaacgtgggatagcgttggacagcggatgatcaatattaattaattattgcaactgtttaattctttcaacttctgtttataaatgcttgctttatgcaaatgaaccactctagctctcctttgataatttcctgcatcatacccctattccggtatgacttgctgagtacagtgggtagtactcagtcttgctctattttttccccaaccccagagtacgagtatgtgtcagatggaggtttctccgaggagtaggcttcgtccgtgccgtcgaggatgcctgtggagtggtgttcccgctgcagttctagtcaaggcttagctcctgttgtctttcgtttttccgctgcatttatgtaagacttttatgatgtttgtaagacgtgaatctgaatgtcaacattgtcatttgtataccccggccggtcctggacggggattttaatgcacattctgcttggaattctattcgggaatttctgggcatgacatgcgaggccctttcaagcctccaacgtgggatagaagtgggctgcaattttttatttaattgcacgccagccagaattcgaacttgagacctttagctctgataacatattggatagtataggagggagagagatatactgcgtagcgtggatacattgtatcgagccttaggggccgatatatatagaagtacaaaggagaagagataagaaatgattacagatatggaatgaatccaaataaatcaatcctatcctaatataagtctagctgccatatactctaacacctatcttgaattgtcaaaatctgaaaaattttagaattttagttaccatgctaaaatattggtactgtcaatacctaggcaaattttgatattgttaattttttggtaagttgtgtgtgatgattggcatgttttgttagccaaaatactattgaaagtgctatcaattttgtaaggcatattttgacatcaaaccaaaataacccttaattataaaaattgtaaaattattcagtccgaagtaaaaagatcagtactaaaacattaacaataataagtgacacaaacgttcactgttcaaataagagtgctctatggctccgttcggcagtacaagttcccaactcctctttctcgtttttcacgcgcacgcttttcaaactgctaaacagtgtgtttttttaaaagtttctatacgaaagttgcttaaaaaatcatattaatccattttaaaaaaaatagctaaaacttaattaatcacgcgctaaaccactgcttcgttttgcgtgtcggagagtgaccctcactcccgaacagagcctatatacttttatgtaatatactatttaaagtgctctatactcttatgtaatagtcaattcatagtatactattaatatctggtcccacctatcatacataaattacatcttggaatccgtactgcaccgctacttttctatctctttctttatctatacctaataaaaaaattcgtaaggcttccgtgaggtttttttcgtccgtcggcggtttcctgccaaaatacgttttaatccgcttaatagtcggtcggaaattttccaatctactccaaaaccttgcttaatatatgatatgtatcagtcatgtatccatcaatcacaagtagcttgcccgcctggttggtggagagaaaattttcaatttgcccaccagggttcgattcccatcatctctcctttttatacacggctatattgctccgaataagtctactgtgcctcccacatctcattacttcacctttcctaggctgtattgctcggaataagtctacgatgcctcccatatctcaaatcattgctcggaataagtctactttgcctcccacagctcaaatcctactcagaataagtctacttttccctcccacttttaaatttgaaaattaaacataattatatttttcttttcatcatctgcaaaacacgacgacatattagagtccgcgccatctatttgcacctctttcttcaacagatagtgataaatcttataatgaaccagattttaatttgaaaattaaacataattatttttttcttttcatcatctacaaaacatgacatattagagtccgcactatctatcgtccacacatgagccgtgaaaatgattcgtctccacgcaagtccgtgttcgattttagaaattatatcaagcgcttaccatgaatccgatggctaaaaaatcagaagtttttgcacctctttcttcaaaagatatttagtgattctgaaatcttataatgaaccattttttaatttgaaaattaaacatatttttttttcttttcgtcatctgcaaaacacgacatattagagtccgcaccatctatcgtccacgcatgagccgtgaaaacgattcatctccacgcaagtccatgttcgattttagaaataattatattaggcgcttgccatgcaagagttgagagagagtgcatgttatgaaaatatgagtatatcaatatgcaatagtgtttcttatcagtcctgattatcattaacccactgaataatttatctattttggaacattattatatacatgttaattgtgtatttatagcatttaaccttttattatacccgtagcgaagcacgggcattttgctagtctctttaaaattttataactggtttataggttgctattgtacctgctcttactctagtgctgtgcaaatttttgagcccaaactttcagaagagccggaaccgatgaaacgagcgagtcgccgtgcaaactctacacaggatacgcgtcaacgcgggacggtaaaatccgcgccgtccaaatgaaatccaacgggtgagacggccgactgtttcccaagtcaccgtacgcggatttattacccggggtgtcagaaatccaggcccacccgtcagcgacgcgttagcataataagcaggcaaaaccacacccccctttcggcctcagatctcctttacccgcctcgccgccggtcgccgcccgccggcgccgccgccgtcacagccagggaagaactccgttcgccatggagggcgtgggcgcgcggctcgggcgcacctcggcccgctacggcaccacgacgacgttcacggggcccgtcaggaagtggcgcaaggactgggtgcccgtcgccgccgccgccgcccggggggcggcggcggcgtcggccgcctcctccacggcgggggccggatcccgcgggaacaatctcgtgctcttcaagtggaccccgatgaacggcgccaacggcaacgggggcggaggagacggagaccaggcggcggcggcggccgccgccgcggaggaggagaaggccacgaaacggcggcggtacgtgccggtgaggactctcgatttgattcttgggatttgtgctttctcggtatattccttgggccatcgagggttcgatttggtgtccggattggatctttgcttgcttgtgtaggtcctggcagcttagatgattggataattctggatcttggttgatgcgagctcttgtggaatattaattgaattgacgcttttgaattgacggtttgaaaagaattagggttcgtatgtttgaaaaacgattatgaacatcaggtccccaaatatgttggagaattgtattttggctaactcaaggaaaataattgtttgttaggagtctagtaactgtacaatttgtagcgttttggtgtaattaggttagtgcttaggatatccctggttataactatagattgtttcattacgtacagtaatttcgaactagttggtgattagtgcagtaagcattatggtgggggtgctatcaaacaggatagctaatgttcttggttaatgagaacagatctgggctgcaccctcaaggctgcaactataattgggactattcatagtactatcgttgacataattcttcatgatttccagttgttccttttacactacagtccgatgaagtgtatgcgatgcattgaagtgcgcgggacttaattacagcagcaagaaactcagcattaaactatctaagtaacaagtaaactactaaactactgacatcagctcatgaaacaaagatccaaaaacagcagtataaattgaaaatattctatttacggtaaaaatccataagcacttattgtaaatttcatagatactgtaaattttggaatttttatgtgaatttcaaaatagactaacataatcatggaaagaactgtaaaactacaaattatttgttagataaattacagcgtaaatccatcatatatacaatgtaatccaaccaagagggaccagtataagtctagaagaactccggttaccaattatttccacaatcttgtccattcaactttatcactgcttaataatgaccatattaaatatttattcatctcagtgggaaagctggtggattatcataggctcatagcatataattggaaaaattggtagagtatcatagatcctgatagcataactggtgaataggtcctgatcatgcacactgctttctcatggtctagactcctcatggttagatagatggtcatgctcctcccttgtggacggtggggcagcagccagcaggcagaggcatgcagctcaacaaaagggttgcagacttggcaatcaaaacaattgtagcacacatgcacggtaaatcagcacgaatctaaagaaaatcccaagggacaacaaaggccttgtttagttcccaaaaacttctcccaaaaacctcacatcgaatctttggacacatatatggagcattaaatatagataaaaagaaaaactaattgcacagtttgcatgtaaattgcgagacgaaccttttgagcttaattaggccatgattagccataagtgctacagtaacccacatgtgctaatgacggattaattaggctcaaaagattcgtctcgcggttttcaggtgagttatgaaattagttttttcattcgtgtccgaaaaccccttctgacatccggttgtgacacccaaaaattttcatttcaccaactaaacaggccaaaactactgcaattaagctatatctgtgtcgacacgaatatggcaaaccactttaattaatgggctgcgggctgccactgagtgaaaagaagtggaacagtttaccatccttctgaataggtgttgcatcaggtttagtcttggatgttcatttgtatacttgcaggcttacttcttaaaacttacaacagtcgtttgctagttttttcattctattgtattctagtgccaatattactaagttcactatattctagtactcatcatgaaaagctcttggattctataggctcactcgtgttcgtgtgctgaaatttcctcataagttggttcatttttgttgagaacaaatctacttttttgaggaatagtgtgtcaccatcttctccaatgcttgtttatgtatatttgctgattctggtttggcaggtttctgtagttgaagatgaaaggcaagaatctggaaaatctgacgatgaaaataaggcaaatgatggagaaccattatccgccgaaactgagccatctaatggaaaaactaatattaatgatacaccaatggatgaatctcaggtaagatgtcacttagcattcacattgttgctacaccgttttctaatataaaccagtgccaattatacggtttgtgacaacctttgtcatgtggttttgatcctgttgttgccatgattgtttgcatgcaagcaatgttatagtacaaattgttgttataatctcatgcataatatttgcttggtaccttattgaaacctcttttttgatctaaactcgattttattatctgcccccattttttggtgaatagtaagcagccaaggcattcagactatgactttgctgactatgaatctttttctcctgtttagtgagatattttctttccctattgactagacgttcccttttttaattattctgcttgactgttttcttgtcaaccattgtacaaacacatttttacacgtttctttgtcattgatctttcctccacgtccttcaggcatcagatgaggcccgatattctggcaaaaatggcggtggaaccgacctaaatttaaacttgggtctgaaggaccctgacggagacaatgatattgatactgaagaacaagatgctgaaaacaacacacacacagaaaataggctgaagaggaaatctgtagctcctgaccttgagatgagaatgtaaccggctgcttcatttattccttggattctttactatctgcctttgggcctattgtgcaaactttcttgacatattgtcatatttagaggcaattcaacacgatagcttacaggaccagctatagtaaaatgtctgaactgaacattattaagtcaaaattttctcggtctgttgaacatctgaaaagtagtagttttatgttcatcttcaagtccctgcatgactggtaatgtttcatactacacttttgtgcgttccactctggagttgccaattctagtgtaggaaagtaaatgtagtacgtgtgaaagatgatttaagaaagaaagtagtgcaacgtgtaattgcagggtaaaggcaagtgacgagagaacagcagtgactgtagattgtaggcagtggcactgatcagagtttctatgatttttttttttttttgaaatctgaagtgtgattgtactagtagcatgctttgttgcttttctgattctgaattaagtgctgcgcaatcgttttaaatgaacgtaaaaacatccgtattagtaatggtttatcgctttatcataaaatgttgcattgagtctatctataaaataaaatgtagcattgagtctatctataaaaaaaaaacatttggccgttcaataggatatgatgatatgatcatggctaccattaatacaaccattgttcacatcaagatcaagttgtacaagtgctggaatctaattcagccgtctgctatagtactgacttcaaatggccgcaaaatgtatatatatgcttcgttttggatccataataagtacttaatggaaagctctttccaacggatctaacatcatcgctaaattccatctatgggcttgtaacttcttctggaattttttttgaaaataatattattttaatagaaaatcgcaaaattataggtcggctagacgaaatcgcaagtttagcgccctgtcgaactggggcagttcgataggtacccctgtcgaactggggcagttcgacaggggactgtcgaactggggcagttcgacaggctagttgtccaagaaaacaaataaaaaagtacttgctacagtgcccgatagggacgtatcgaacagggggagttcgatagggcgcgtggcatggacgtatcgaacagcggaagttcgataggcagtgtcgctacagtgccgctacagtgtgcgctacagtgcgctacagtgtttttcctttttttaagttattttattacctgtcgaactggggcagttcgacaggtaccctttcgaactgcctccgttcgacaggaaaaaaaaattgcgatttcgtctaactgacctataattttgcgattttccattaaaataatattatttccaaaaaaaactcacttcttctgggacttagacccagtgagcctatgtgggtgcgccccaatcaggtggagcacccagtgggcccatgtaggtgcgccccaattaggtggggcacgacggacccctaggttatcctcccacttccttaaatagatccctaggtcatcctcctgtctccttaaatagtaagtaccacctctttaggatttctcggattctatttagatgattttgtttaaattaaagtttagtcatagctacttgcttgcagcgcacatgtcgactagaccgcttgtatgttcggcttcaaaacctcaacttatcgtgtgtattcaattgtgttcatcttcggaacccaacttatcgtgtgtattcaattcctatttgtaatatcaaattgtttttattttgttcttacttgtttcttcgatttgcttgtaagaataaagttgatctgcaccggcaagatccaaaactcatagatcgacacgcccgtctgttcgtcttcggaacccaacttatcgtgtgtattcaattcctatttgcaatatcagattgtttttattttgttctagcttgtttattcgatttgcttgtgagaataagattaatctacaccggcaagatcaataactcatcgagctatttacaatatcatattgtttttattttgttcttgtttgtttcgtaggaataaggttgatctgcaccgataaggtgtatcgatcgcaaagacgcaacactaacatcttgtatggttgtatcaggttgtcaacgtttctttcaaatcatagttatctttcaacttatcgaaagatcgagctcaaggtttatcacatgatgaaacggttcgatagatcatcgaatggacggttgatccatttatttcctgtagggcataaaatcagtccgagcaaacaattgttttatgcaagtaaggagagagaaatttgactacaaattgccatttcaggcgtacacatggacatggctttttttttattacacagtgatggctggatatgcctggatcaatagaaagggacggagtctgcactaaattatatcaaacagaaaggtaaaaagaagacgctcatcacagcaaaatggcatttcgtattacaaatatccttgaaacaagtaacctatggatcggcttatccaactaaaacgggaaaattgttgatcggttgatacattagtgcaaaactgtgtctgccatgcccttcgaagttccaaagaaccgtaatgttttcatgcaagtgcgaagcacttgtctggctgcctagaaaaatccctgaaggacaagtcgatatctaacttaatctgacttgtcagatttctcctccggctcctcttcaattggaccaccttcagtgacaccaacttccgcaggacggagaacacgatcatgtagcatgtagcccacctaaaaaagaaaagaaattgttaccagtactatcaaggtagcagcattggaggactgaagatattggtgcacaagtagaaatctgggctggttgtccagggaatcactttggatcattcccattaggaatttctggggtttcgattgccttggtaatatttcatctttaaacagatcaaagtgtcaccaggagctgtgggggcatcaggacaagataaaaatgtataattgaaatacgcaatggttccctggtaaccaaacttgtcctaaactaagagtataatatgcattgactagcattagctctgtaaaccttgcccgtatgtactcctagtaatagaggtagtttcctaacaggtgccatcttttagcagaaagaagcataccggcagacaaaatcccaacagaaaatgaataaaggagctacaaatgtgagccatgtttaaataatagaataacagaaagcaaccggctattaaaaatcctcatctaccttgagttatttactacacatacctccatacatatacttatgcagttttaaggatagactatccacttaatgttattctgatggtgtaatattggaagtaaccttgcttagtattaaaaatacagacttttaagtcattcttaggctgttgcagtgtactttcctcattgttatcttaactaatgatatgcacatgaaacaatttattatcatctctgtatttcatctcattctgcagcctagacaaactctatcaagtgatttgatcgacataactataatagaatgtgatatacaaataggcaactttaaaccaacaaacattgaggttaagtaccggacttgaatgagctcttatttcagaagagaaagggggtaaaaaccctataccaaaattatcggaagagcataccttcacaacagccgcaacagttcctgatggttttgaaggatcaggaatttggaaaagcgcagcatgcttatttggatcaaatttctcattaagtggatcaaacttttccactccaaacttcttgaagacctgcacacattaaatgttattgcctttttgctgcataaagatgtaaatttgtgtaaacacgcaagcaacaggatcaaaataagtttgaatgcatgttaccaacaaaagatatgataatgtctaaatcattggcagcatataatcattaagacagggaccataattccaattcacagttgttacgaccaatgcatggaaagttgttgaaatacctccccaagttgcttttcggtcatctcaacaccctctaatagggtgtttagtagcttcactgcttcagcagattcattagatgtatctatctttgagaagctctcctttacaacagatgatgccctagataaattgtctgcaacatctaacaagctcttggagaagccctacagggatgaatagacgtgagctcatttccaaagtaaaacaagattctaaaaaatcatgaccagacatagaatacagacctgtactgcatacttctttgcattatctgattcacgctttgttctcgcaatgacgttctccatctctgcatagctgcgcaaaactttatccttcatgtctttaacttcttcattcttagatttcaacaattcttctttctccagaactagctttgtcaggtcctcctttgacaggtcaaggtcttctgtatctgaatcagaaaatgcagttcgtttagtacctctcctcctcctgttagattggggcacagaatcttgtgaacctgcttgagatgcattctcggttccaggagaactattggtttcatttgaagcttcagattgagtgcttttattaactccatcctctgtctgtttatttgctgccttatcatcttgctggggagcagaagatgaaaacccaaacctttgaaaggttgaagttgagtacagcctcggctgattcagcagaggcaaggcctgagcgtagaaaaaagggaaaaattatccaacagtccggaagatgaaaaacaagaccaaacaagaataccctgagcaatgctacaaatacaatggatggtgtcagcttattatgcctgaaacacctaatgagccgatgaatcaacataacaggctgcttccagctttagattttaatagctagcttatgccaaaggctatcagaaatcgttatgtcatcagcaacacgttactaatgagaattgagcattaattggtacttcgcaaattttgtactgttattaagtatccccagttgaaacaccgcagtattcccacaacgtatgaacacgagctactgagcaaattaagtttttaagtttagcgcaaatcatgcatcaatcgatcttaaccagtacctcagctgcccaacaaagaaaacattaggacaaaatagcacaaagaacttgtatataaaatcaaacttaaattctattaaaaaaaacccatcaatagcgaatcgagtttagattaaatcaaaaaccttagagaaccccaatgctccccctagttttccacgcacaggatacccgaacaaaaaaaaaagcaacttaatcgacggatgcatctctaaaaccctaatctcgcaccaagattagcaaccccacgacggcttaacccttcgaaaaaaaagcacgacgacacacacacacacatcgctccatccgactcagacgagggaatcgaaacccccacccccaccttgatcgaagagcagggcggggccaagtgccgccccgccgaagcgccgagcagcgccgccgcttccgcctgccgcctcgccgccgcggccgaggccacgccctgcctcgagatacgcgcgaggagacgcgccgccgcagccatctctctgtctctctctctctctcctctactctccttattcggtcgtcggcggcggagaagagaagggaaagaagaagaagaagagaagagaagaaaatcggaggcgaagatttcgcggcggcgaagggtctggaagggttttgggggaaaagctggagtggggatatttgtggacaaagaccgttctacccttagtaggtttaacgtgttctggcaatgaaggcaagggtagttgtgtccgtttcgtttcctcttcgttgacatgtgcttgtcgtgcaagaagggaaagcgtgtggtttatactcctgtgctccaattcaaatggtaaaatctaaatcgaaatgcctctctatttagtcttaactagaaaaaatatccatgcattataacgggtaaaagttattttaatcttattattatttactgtgaaatacactatcagaattcgcttggatatatatattttttaggaaatcatgtaagttagcatacaagttgttttgaaagatttcttatacgaccttatgtatttctaaaagtgaacaacttgaaatccgactcaaatacggatctgcatttccaaaagaaaatgaaatgtattttccaatacggttaaaaactgacttatacacggatgacgtaccaaagtattggctaaaacatcttcaatttttataataagtagagatagaagatgtcacatacatcagataagtactactatacatctatagacatgcatatcttctttgttattatgtcatacatatctttttttccttcttataaaagttttcttaaattacttatctgatccataatctgattgtaccattgtgttcgttataattaaatctttgtaacaagatcttacatgaatatttttatgataaaaatatttatatttgtaaattacttttattatatatgtaagttacttttatcatatatataaattacttttggatttgattaaattacttcttatacattcataattctttgagctgattacttttattactgtttttagccaattttatattttatgttggttaaacttaatttctagatagactcatgtttttatccctataacgaatttacttctaatgttgtaacgacttacttccattttaagttaagttacttttatgatttatgcaaattactttcaaactttattggttttacttttataaatgtatttacttgaaaatcttctctacactttgcttgtggatttactccacatagtttcttacttcaactcaatcagaatgtaatttcttctaatgttatagagagttgcttctattgcatagctaagtaacttttacaattcaaataaattatttttaaattaataaaatgttagaatatattcaacatggatctcattttgtcacatattttgagtagagtacaatgatgtaaataaatcttaaaaataatatgtgatttaaaatatataagtcattaaaaaggttaaaaaaagatatgtaccataggctaaaggaggatttatatattggatagaatggtttccgattaggactaacgcactgccgtgctctacctagtcacatccaattcaaatagcctcttatattcctcgtctcgtttatatacttataaggacatgagcagtgtataatgtttaaatgggtcttaaggtaagtcacacatagacctcattgagctacagcacttatattagaatgtatatgactacgagaggtgttaagatcggacccaccttttaccatctcaaccacttctttttatcttcccattcaatctcttcttctccaccgaacaagagagacacaactcacaaatctagcagtggaaggagctaggtcgtggtgacaacggctacatctaggaggaggtcgtgacgaccgcagcccacgggatgaggtgaagcagcggcggtggtggcctaagcgctcgcaggaggtcatggcaatggcggcctgtgggatcaagccacaacggtcatggtggttcaggttcgcaagaggaggttgcgacggcgtggaccgcaggaggaggttgcagcagcggcaatggctcacaggtgccctcctcccttttcccatggcggcaagcaatgaagagagaagagtgtgctagaggagagagatgaacaattgttttttattccttatggctaggcattagccataagggtagctcaaccaaaagtccgctataaatactactcccacaatgtatatagactacttaggaggcttaagaccccctctatttccacaatgtggtcgctctaagttaaaacttaaatataaagtaattttatattgttttgatcgtagattatttatatcattcgcttttgagtcactaagcactcatacataaaattttacccataaaatatattttgattcctaatagacactatggataagcataagttaaacaatgggatttctaaccagaatcattcaagggctttcaaagtcaactaaaagaattttttttaaagaaaaatcataagcgtggtactaacatgtttgggggagtttctagcagagctccccaaacagtctaagggtctgtttgggggctacagcttctcccataatcataagcttccccccccacccaaacagtttagctttggttccaatttttcaaaagctatagtggtagaatctaggaaataaattagaagctaggaagggactacaaatcgggtgcccgatttataagagaaaattagcgcactctaccgcgttactcctgctcctcgtttctttttttttctctactgcatacattgctcctgctgcatgtttgtttatgtctctgttgcacatcttcttttcccatgctatgcatgcaggagtcctctacacatgcatggctgcacggtgcaccccatcctttatataattaatatgcccccgcctctttaaatgatttttttcatctaaattaaaatcatatttacgaatcgattacaccattgtactccttgcaattaaatctttaaaaaataagatcttacacaattatattttgatgagaaaaaaacttatatgtttcaccatgcttaatcaaatgttccaattaactttataaaatgtttaggaaggtgcaacattagaaaatactgattgcaacatcaacaaccattgtatgaaacattgagtcctaacgaatgaaacatataatatatttgcaaacacttgatattgttgtttttttttgtgactactaaaacattcgaagaacaccacgtgcaacatttgcaatcaactaatgaaacatcctaaaatactagtcggaacatccgagtaaaaccacatgcaacatatataaaaaaaatccattgaaaaaagagctaaatatttttctattagaatataatcatgtaaggttttattggaaagatttaattccaatgaatataccgataaaatcggatgatagatcatataaatactagatgagaacaaatattttaaagtttcttaaagaggctattggttacatgtggaagaatatatagccaaagtggagaaaagacacgttgtaaaggacagagcatgtagagcctctgctgcctttggcgcagcagtagtagcgtgtggggggagggcgcccgatttttcagtatggatcaggaggccgacccgaatcaatctcctagaagatatagtagaagttaagaaacccagcttttctagattatcataagctagctatcaaccatcttcttcttagaatctctccaaataagccctaaattttcactcagattctgagaattataattgtagaatctagaaaatgaactagaagctataagatgtgaaagtcatctttcaaaaaaaaaaagtgaaacccagtttttcataatacatagttgtacaatctagaaaatgaaaaatgatatggaatacgttgctattaggaattcacaatgtgtgagtcatctagcattatttttttggggggataatgatttcatgaaacataattttcacaagaagtgtgctttgcatgatctgaactcatataaattacttatctcatttggttttccaggccgtccatgcctcatggtaggcgactatcaatgattgatcccctctactacgaagttcacttgctacacctatagtccatttacacttcatctttgttggccactagctcagtttagaatttgttcaaacacaagccaccataggagatgcaataaattcgtcatcagcaatgtcactatctaaaggccattgatattcaaggggaaaggaagaaacatgaaagagaaaggaggtagaagtgggcaaaaataaccaaaacagctttttaaatatagggacttctcttatgctatttgtcgaactacaaataatcaaatatgtgtagtgtgtaaaataggtgaatgggttatgtgtgatttgtgatgcccctctttgttttccttatgtttgttatgtagatcttggcgcggaatcttgatgataccttcttttaaccattgaacattaagatgcacctttagatgctttcttgtgaaagtatattctccataataccacttttctcaataagatattgtcctattttgaatagtatagattctatatgaaatagtatttatcagtcatgataagactatcgcaccttaatcgtgcctcacacgtataggaaaaagtggagcaagcgagtgtatgctaattgacgctgaagagatcaagttttcctatattagatccaaccatatgtcacactattatgttttttctctttcaagagcttgaaataacacgtactcctatttcattagagatacatgcctctcgtattcataatcgtatgatcaagtcttctatttagagtacaaacatatacaattaaatgtgtaacagagtagaatggaatggagtgtataacgtgctatgtgcgagataggtgaacgagtgacgtgtgtcctatgacacccctttttgctttctttaggcttattttatatatatatatatatgtatatatatatatatatatatatatatatatagtaaatttgtttggtgctccatggtgcccgggcaccattgttgaaattgagtatatacccaattcaaatgagtatgaatctttttcaattacttaggtattaacattaaccactttactaactagttcaaagcaagttcaaaagtttgaactgaatttgaacttgtttttgttagattttgattctaggtatatagcatccatacatatatttagttaggtatgtaatcatggattgtgaaataaagttaaatttgagttgttttgttgataggtataggtatgaatcgaattattataactaggtatatactcataatttgaaaattttgaaaaatttgagtgattttttgcatttgataccatggtgcccgggcaccatggtgccccatatgagtgtcctatatatatatatatatgtatatatatacatatacacatatatgtatacatatacacatatacatatatatacatatatacatatatatacatatatacatatatatacatatatacatatatatatatacatatatatatatatatatatatatatataggctttgacggggaatattgatgatggatactttttacatcgaatattaatgatgtgacttttgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagtgcagcacggcgcgtccctttatccggtctgtgaccagtcacagaccggtcagatcacgggttaggtggcgactggcggtctgacacacgccatgccccatcccgtcaagacgaaagcctctagtcactcgtctcaagccggcgttaagcgtgttatctcttagagatgacacgttagacccggtcgatatatgccaggcttcatcttaaccattacaggcaagatgttgtgtgaagaagggcaaacatgcacgttgccaagattacacgcggtggacaagaacgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagaggggggttgattctttcccagattatgagcttagaacgggggagaagtcagctgaaacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccaccccctccgcgccaaagccctaagcagggggaggcgcttgagagggtcgacaagtccgcagcgtcaccggccgcaggtgatgcaggagaacggcgagacggggagcgtcgcctcctcgtctacggcgacggcagcacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaagacgaagggcgcggcgaacggcggcggctgcacgtcattcggctgccactccctcgtctacaccgtcgactcgggaggatcagcatggggagccggatgcccgcctcaacatcgggcgccggtgtaatagccggcgtactccccgtgcaacggagggagcctcctcgtccagagtgtcaccccgacatggacgtgaagatcagccctccgtgcccccggccggtggtgttggctgtagagcctttgtggcgagtcttcggaacgtccgttggcccccaaggttccggcccaccatcaccgagaagtacgatgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggccggaactcccggcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggtggttccatccggcaaacggcgaggtgaggccaagcagaaggcccccgttgttgacatcgatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacgtgaagttgggacgtgtcctcatagacggaggagcggctctcaacatcctttccccgccggcctttatgctatcaaggccccggggatggtgctccagccgtctcaaccgatcatcggtgtgacgccggggcacacgtggccattaggtcacattgacctaccggtcactttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtccgtggcgaccttaaagtcgcgcttgcttgcattgagcagcgcgcggaccgcctcgctgctgcgtccaagcccgagggtggtgacgagaggcttggcccttctgcccccaccgccccgaggcagcggatggccacttgcgacgaggtcccggtcaaggaggttgccttgggcgacggcccatccaagaccacacggatcggtggttttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagctttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcattgaggccaaccccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatcttagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggccccaggcccccgacgaccggagtcggccctccacccgcttgtcaaacggcgctgggtgcccccgaccctcaggaaggccccgaggccactgagggaaggctgcacttaaagccctttggccccgaggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgcgccccgaggggccacttggacgaagaacgccccgggggtacggcccctaacgaggaggatcggccccgccgaaaggtgcagcggcctgtctactttgttagtgaggccctccgggacgccaagacccgatacccacaggcccagaagatgctttacgctattctgatggcctcaaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcgcgaacccctcacagctgcctcacgccgcccactgggtgatgcaattcgacggttctctgtctcttcagggcgccggtgcaggggtcacgttgacctctccgaacggagacgtcctcagatatttggtccgtctcgactttcgagcgactaacaatatggcagagtacgagggactccttgccggactcagagtggcggctggactggggatccgccgcctcttggtattaggcgactcccagctagtcgttaaccaggtctgtaaggagtaccggtgctctgacccacagatggacgcctacgtacgccaagtgcggcgtatggagcgccattttgacgggatagagcttcggcatgtgcccagacgggataatatgattgccgatgaactctcaaggctcgcgtcctcgcgagcccagaccccaccaggcgcctttgaagaaaggcttacccagccgtcggcgcgacccgaccccttaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccatggaacatcgaacaccttcgtcgcttctacccctgaaggggggggtcgggtgtcaggttttggctcgggctaaccccgcaccccccctcgggtgtgcggggttagccgggggctaccacacatgcatatatattcctttcagcatttcaatagaagcagtttcaatttcctaaaggttgtgtctgtgccgttttttccttttgaagaatcttgacttgaaataatgtcactcgtgctcaaccttgccctcgggggctcggttcggtcggctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgcgagcccttattccaagctaagtcgcaaaaggaccatggcacagatcatcctcaactcatatatatagcaaaataaaactaacacaaaaatttttcatcatttctcattgcagattaagttaaaattgtacaaaaaagaggcatgaaggccttagaagaaagaacaagaaaaaagataagagtggcgggggcctgggggctcattcatatgcgcccgggtcgccggcctcgtcgccaccgccgtcctcgctgctggtgtcgccttcctcgtcggagctgggggcgaacgcaagccgaggggccgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcggcctccccggtggaggagtccagcgcgcgctgcatgtcagcgacggtgtgttcggcagccgcgaggcgagcggctaagtcgctttcgcccgcagccgccccaccgatgcgcgcccccgcggccagctctttctcccgtgcctcgaggttagcaacccgctgctccagcgcggctctctcggcgcggacgctttcaaggttgcggcgcgcctgctcctcttgcgccgcctcgcggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggtggcctcgcggtccatcaagcccctctccacggcgccggcatgttcttccagcgccatggcacgggcctcaagggcctcctcgcgccgccgggacgccgcttcggcttccgttgcccgccgctctcgcgcagcggcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctcccgggcgatctccgccagcgccgccttgcgggcttcgagctccgagatgtggcggcggtgggccttacggcccacctccaccatggcgtccaccgagcgccgcccctcctcgacacgcgcccatgcggcctcgagctccgctcgttccgctcgcaaggcctccacctgggcgctaaatccatctagcaccgcggtgtttgcggcggccaaggcctgcataatgggctcggcgctcactggggcgacgagagaagaggagaaaagccgccttggagaaaaggcgacgcggcttggccccccggaggatgcgctgggctcggggatgtcccccgggcccgtttggtcctgggcgtcgcccggtgaggtaggcccaggcgacgcgcccgcggcctcgtcgcgagccgcctcggaggatgtcgcctgagggccgcccgagggagtgggcccgagtgacgcgccagcagcagctgccgcttcagcctggcgagcccgggcggcctcctcctgggcagcttcttcggcttggcgagcccgggcggcctcctcccgagcagcctcctccgcttggcgaacccgggcggcctcccgggcggcctcttcagcttcccgaaggcgggctgcggcttcacgccggtcagactcccgcctccgctcctctgcggccgctggatcttcgacctcggactggccggacttggggcggcgggaggaatgcgacgggacatcgctgaagcagaagaaaaaaccaaaagacgaacaaaatgagtaagaaaaaacttctctttgggagaaaggtggtcgcaatgagaatgagacgaacctgcgagggggtcggttgaatgaccaccttggaggggaaattaggtttccccgggctggttccgtctcccccatcttgcggagccgcttcttcttgcgctccccctcgggctgtgacgtcggcgcagccccctccgggcgccgaccgctggtacgcactgccccgccccctcggggaggagatgggggaggtgttcctcccagcttcctcttccccggggcgtcggcagggcggctgctccccgagcccccgacgcggggcccagaagcacgaccccctcctggggcagattttttccccgggcggctctcgcccgcgccgtcgtggcccttaggggctctctcctctgaggccccgacccccagcataatggttagaatggagacgcggtcgggatcgatgcagagggggaggatctcctgaggaaggcgagacgcctccgcggagctaagattcagcaccctttggactacgatcttgaagtcctcaggagcccaatcccatctggctccctggtgggtccgcatgtagtcttcaggcccagtgtactcccaggcgctccgggcgcgccgttggagcggcgcaatccgccgacggaggtaatcgccgtacaccatggccccggtgagcccctgggatcgcaggcccgccaggcggtcgaggacggcgtcgtactcctcccccagatctaccggcgcccgccagctggagacctgcgccgggggctggctcggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggtagagaaagagttagagctcaggcagcgaaggcaagaggaacaaaggcgaaaggaagggagcaaatccttttctcgatgcttttatacccttgccatcgctgggcctggctcctcgtttctcgcgcccactacctcgctccctcgtatctcgctatcttgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggggg

SEQ ID NO: 14268 - DNA, 8849 bp, Oryza sativa
ctgtgaccagtcacagaccggtcagatcacgggttaggtgcgactggcggtctgacacacgccatgccccatcccgtcaagacgaaagcctctagtcactcgtctcaagccggcgttaagcgtgttatctcttagagatgacacgttagacccggtcgatatatgccaggcttcatcttaaccattacaggcaagatgttgtgtgaagaagggcaaacatgcacgttgccaagattacacgcggtggacaagaacgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagaggggggttgattctttcccagattatgagcttagaacgggggagaagtcagctgaaacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcaactttacacatagatggttctttctccataatacttctttgaacactaagatattgttctattatgaatagtgcagattccatgtgcaataccagtatttatcaatcatgattacgataagaccatcacactctaatcatatgttatacaagtataagaataatggagcaaagtgcatgctaattgctgctggagagcttttttttttctattccctctattttatattactgagtttatcctaagttaaacaaatttgtagaaaaatgtactaatatgcacaacatcaaattagtttcattaaatttgtcatcaagtatgtttttttattttatgttaaaaatgttattaattttttatataaacttaatcaaacatgagtaggattgacgcaaagttaaagtgactttgccctcagtcaaacttttttttagaaaaatgtactattccacaacacccaatttgtttcattaaatttattatcattgaatatgtttttatagtatctttattttatgttaaaaatattgcaatgtttttctataaatttaatcttggacaagattaaagtgagttatagggcctgtttggcacagctccagctccagctccaccgggagtggagctggagctcagctaaacagtttcagctccaccaaaactagaagtggagctgggtggagttctctcacaaaatgaactagagttgtggagctgggcttagacagctccacaactccactccagacctaactcctagagctaaacttaggagttgagctgtaccaaacatgcccataatataacaaagtgggcacttcaactctactctatttcctcgataaaatcatatcttactgttgaccgttgattactccgagtgcagagtgtttttatggggaaaaaacgagcggggcatgtaacctccataaataagtccatatgggtgggtcacaattatctcgtgtatgggttacacattttgaaatttactcccgaaatttgtgatatattcctgatcattcaaacttcctggaaagatttatacatctttgaccttttttaccccttttagtttccgttgttttctacacatcagatgcactctttctataaccccatgagctcacaagttatgattatgacagtccattaaaaagagcaaacgagataatagcaatttagagaaacagacaacattttctcattaactaccactgtgcaacaacaaagcatgcagttacaagtttgattatatgcagaactgcactagggtgatgaatcaccatgtgggcgagcaacatgcagatgtatcaatgagaaggatttttcccttcccaataaatagttgtcaaaatcattgcaacatctgatactgcctctacaagtaagaggtcagacaaaaaaccgggtaaacagatttcttacccttttttcccatgtacagcgccaccaattgtacaacagctgcaaagagatgaggaactgatgaaaatatgttagcaccaggaaagccaatccatgactccattctcatctttcaatcgtgttccctcaagcagcatcagcagcaaatccaggagagaagcatggctgtctttctttcatcagataaataaaccttagaatttcctgccacatcaaaaggagagctcggagctccgagggccaactggatcatggagaaacagctcttccacttgttaatctctcaccagctgaacagagatatatgtgacagcaaaagcctttgcttcatccttctggcattgagggtctatgattggtttcctggccgaccgggacttgaagaaaaggattccagcggtcaaagatgatgcgacctccccgtccaattctagcttgccaccggaatggtggagcagtagtaccactatcaataggtggatctagtggtggcctgataccagccatcttcagcttatcagggtcaattggtcttgtaaatagcattactggctcctcaggatcccgcatttcaggaacctgttaaatcatgatccaaatataaacatgacaaataaaaaattagatgagttgccatgtgaacctaaattttagtttcactatccaacaactatctagagcaacagaaattgtgcctagcaagcccatcaatttctggctgttctttcagacaaatttgggaattaggggtgaaagaagtcaaaatagataggaaaatgctcaaaaggttttctgaaccatatttttatgagaattgaaaatggtaacaaatgaatatttgaactatcagagtattagaggcggaatcattagagcagaaacatgctggctgctcgaactggtaatttagaccagaaacaccaagtcataatttgctatttcatgcggttgaccgagcaactaataagataaattcatatacacactatatataactcatagccacggatattatggaataaattcatacaaccacatgtatcattttataattatgacttaaggtgcatttagttgtaaggatgttacttggattcccagtaatcatggggtaatcctagttgattcccatgtttagttgaatcacctggaatgttaattaagaatataggattctaatacaactaagattctggtaatatgtggtattaggatcccttttgaaacaggtagcttggattactccccatcccctagcagaatcttatcattttctttctcacatgtgcatgctataatgttacattcccagtatctaattctcacactaaggattacaggggatgttaagtttcccattaatcttgctttcctgtaactaaaccgcacccttattatgtttgctatactaaacaaatactcaaaaggtagcagacatataatatgtctaaaagaaaatgtccataactacaagcagatagcctgttggtttgccccatgcatgggctggcagtagatagtgggttccaaccctagtccgataggtatttctgtggaatttaccaagcaaagccgtgcaaattccaagaaggttgtgccggttgctgggtttaacagggcatggcctagtcgctgtgtacaggcttttcactgttaggccagtgtaattattggcaatgttctccatatgaatttggtaaatcaaggaaatggtcaccaaagagcaaaatcatttccaccaccaattacgattagcctcactgtttctggttccagttctaacgaatttttattccgatcgattcagttggtagaataaggaaacagtagttggtggatcaggaatttctgctaccattttcatccctattgggaagagttgactaggaatgtattggttagttatctttgtgccttcaatagctccaaaagaagtgactgtatactcatcagtagaagtgctggttacacttagtatatgttgtgtggggtgttgggggggggggggtgcaatcggtacacacccatattgcaaaacagtggtaaattcaacgtcctctcattgcaaaaatcgattgaagttgtgcaagaacaaagaatattgccatattggtattaatgattttttgcccatcatttagacctaaattggtaaggtagctcatttattcatgggagggcagtactacttcagagaagattttatgttaaaaaagaattaccaaaaaaaagcatacccttttgaacaaccagccattctggtggggtcttctttttagctcacgctcgcgcttcaaacgcaatggcggaacagctgatagcttattatcagggaatctagaatgaaaagcaaccgatcgtacatatggttgctcgttggccgtatcatctgaatctgcataatcatcttcacttgatccagcttgctggaggcctgatagagcaatcccatcatcaataagctgtgcctcatgctgaacaaggaataaaattgttaatcataggagataattttgcctcttaaattttatctgttttacagaaagaagtaaagcatttggggaaaaaatcctatgagactcagctacaaaactatatgcttttagacagtaattatggcccgtgtcacactttgagaagattctaaatatttggtagtgccaaaatcttggtaagtattacacatgtttggattgttaccaatgtgaagccaaaatttgatgatacagataagaaagttctagagaataatgccaaattgttcaaaggccttaccaacaatttggatttagtacaaacattcactagtactattcaaactaccaataaattgttatggcacatgttggcatcaatccaaaatggcccctagtcttataggaatttttttcccaagcatataggccgtaccaaaaaggtttacaaatactccctagaaataataaactttaagatgtgcaacaaatcccgggccatacagatcacatcaaagaataaacttatttagctagaacacataatctgatgggagctttcaggatttgccactacattgtaattcaagtatgtcactctgtgtcagtgatgtggattttggtgtgacatgtttgtgaggaagtggcaagttcctctttgtgctttccaacaagacagaatctggagatttgcatgtgatgaaaaacaagaataaaatcaacatcgtgtagccacaatgaattatccatctactacttgaacacataagggcattatgcactatcatactcacaagcaatcatcttcattttgttcgtttcttaaatatgtacactaatctactgcagaaaaaacgagggaacctacatattaagagtaatgaaaattaaacacttgcaaaattgcacttctacacttagatgccgaagccatgtatcactctttttagactaagcagggagttatgctcggaaatgtatgagatcatgtgatgaaaacgtaagtcataaattagcatttttctttccaaaatcaaccaatacttactagcaacatcctgttacacacctaccagaactttcattttgtttgttattcttcaacatgtaaattcaaattaattgctagtgcattaaatggtagaaaggaccaaaggacagaaggcatttcatatagtttaataaagcattatctaccttgtatctcatctggatacgtcgaaggtgaacctcacactccatagtctcacgttttctctcttccctctgcgaagaggatgagtgcacggtttagtatttctcatgccaaaattggcattatttaatgcatttgcataccttaatcaatgcgcccattagtgccttagcctgctctagattgcgccggacctgtattggggttttaaaacataaaaataagcaaatttaaatatcagtgtacatagacaacaagtgcatatttcagatacacaccatgttgcaagcactacagaacataaaatatgatggttatgattaagatcgtgcactacacaagaacacaaaggcaccatgacaagcaaaaaaacagagaggcaaacatactgcactattcatatcaagacattaagagttatcaataattggtccttctctgctttcttgacagtcaagaagtttgctattcaagaggacagcaaaacattcgatatttaaggataagcttgattgcttgaatgtatttgcagtctaagctagtgatagtcaaccaaatatggatcttctctagaaatacaattaagaaatatagaaatatgatgttaagataatatgatcaacccctggcacatttaggttttgatctgaggctatcctggtctgcgggacccaacacaagtattcatcctttccaatgaaaaatagagaacaacaaatacagctaagacaatgtcaaaatacttgtgtaataattagaaccatagtttcaatcaagcctgtgtatatttgtgtccaaaaaggaaaatatctaaagagttcaaaaaactacatatgttttgacaaaactattgaaaacaacgtatttaagcccaccatatcacaagaatacatatttaaacaatactataacataacagcagatttaacaatgaatttatcacaaaactatagatttgtgaatttacgtttctggcactattgtactgatggaacatttaaaattatagtttgcaataactaaagccatagtgacaaattaatgttagtatgtagttctgcaacattgtgttttaaatttatatttttctgacaactgtcaaatagctgtaatgttgtaaaatttactctatctagaaagatgcacaagtcagagacttcaacaagaaaaggataacaacatgccataaaatccttggataaagaagaaatgcctatacatacgcaattccaaaaaccaaacatatgcatatttccataattatagcggctgctccttgaaaacccaactattgctgttacacttaccacacggagtttgtcgaatgattggacactattttctcgtctttgcatctgaaaaaataaatgaacataagtacacaaagaaatataggcacacgaagatattatcactcctgtgctttcttgatgacttaaaattgtccaggagtagctattgtcaaactagtttcctgtgactcaccctccttgtgtgaagacgataagccttctcccttggtctgaacacattgtatggatttgtgtcattaactggcggaggcggcttcaccaaaagaagaaaaaaacagttactctaaacagttgtgtgatcaagaaagcaaacatataaacagcggtagttttgtggtaattttctacctgaccacagttaatgaaagaaaaagtccattttactcccccaaactagtttctagtttctagtttggggtgggggttcaaatgagccaaaacctagtttaggggcttaggtgataaaatgcaatagttcgggggagtaaaatggacttttttttttctttaatgaaatatgaaacagaataataactcaagaatgtgagccaactcataaatagtgaatttaacttgcttttgaacttttccgcaactaacgaaattcttgaaactaagacctgtcattgggcagagaagcacttgagtaataataaacaaacaccacatgtttatccaattactttctttcatttttgtagacctttgtccccagtttgttcatttgaaaatgcaaacatattataagcataagccatgatgctaggagcaccttgcaggccctactatcatttttggggcaattgctcatttgaccctgttttgaagtctaactaccaatctgaccctactttttctagtttgcttatttgaccccgtttttcaaaatcgaagatgaagattgaccctactctgtgaagtcaagataacagtgttaactaagggcaaatagtcccttttgcccttgcttattttgaccctgttatggcagatagaccagcgcgctgctccctttctctgcacaccactgccgtcgcggcctcctcacctagtgccagccgagagggatgaggttgggagtgaatggatagggttgggtcctcaagggtattttggtcagtttgaatagtaatttgatttttttttcttttactaaatatatataaccctaacggtgtaatggaaatagggtaagacggtacctttgttattgaaaagtggggtcaaatgaactaactagaaaaggtagggttacattggtagttaggctctgaaaaggggttaaataagcaattgtcccttcattttttttatggtacagtttatcatatttttcactatactaaaggaaaaaaattttaaaagtagtccatcgtcccaaaagctttccatttctcctggcgaggagaaaaacagaaactgaacccagtggtcacagaagatcttgaatcctccatgattggtgaaagccatgaggaatctgttggaaaggacctgttaagatggagaaggggaagccttccaagttgaagataattactgtcaacaaaaccgccatctgccgtccaagcttcctgctagaaagctttccagtcaccataaaagtcactatccctactggaatcatccactagaggcttcctttgtagagtagcaaatgt

SEQ ID NO: 14269 - DNA, 1610 bp, Oryza sativa
tgtatttcaaaatatatatctaaatttcttgacttggaaattgtatttgtcaaacataatttgctagcaaacatccaataataaaccaagccccacacacaaagatatatttatccagccttagaagatcccaacaactctaagtgatggcagattatccaccacctctaggttcttctatatagtagagattccattccaatttcaagtaatagataacaccagcacagtaatatatgttttgtgaatcttgaatacccgaagccatacctgctagctaatagagcagtaacatcagcagtgacaattctgattaaccaacccggttctccaaacaggtgtgatgcacaaaaaaaaaataggaaggccttaaagtcacatccttctagagcaaggtttattccaattggaaaggtcctctccccagacctgaccagattggtgtagaatatattcccctttttttttctacggttagttaattatcaatttgttacatctctagtacttactacattagcagatctgcttatctgataagctctgttcaggtgttttgagactacatctctagtacgttctatggtaggagatctggtaagatagaaagtactaaagatgtaggctccaaaaggaacgaaaaatcatcaaatctaacaaaagcatccttctacagaccttctgtatctattcctccatcccaaatataaggacttctagtgtttgaactttgtccacaaatataaggatttctaaagtactatggacttccctgcatcaaccacccctcatgtaattctcacccaaccttacccccaactaccctcatttaatgaggggcatcatagtgttttcccttcatcattaatatctccaaaaaaaaggcttgaagtccttatattttggaatggagggagtacatcttagagacttttactgtcaagtccacttcttctctaaattcttaatgcatctttcaggaaggtataaattaagccacttctgttggcgactctacaaaagacaaatacatctggagtcgcatgggtaaaaaagaataaagctgtcatggcattaaaagaagaagaaaatgatttgtttatttggaaaagataatagaaaatcacaaaacattcagaaatgaaaagtgtgtactttatgaagaggtaggcagattgataacaagaaaatatttagtctactgattgaactaaacttttacattgttccagatttaacaaactctattgtaatttatatgctactcactcttgtgttgctccattctgagtgctatcaattgttccttttacttttcaatgacacagcacatatacctttttatccctttttgtgccttgatggtaattggtgaagagttcaaatgtttttggaagtcatgtgactcaaatcaaactgataaacaagaaactcgccaactcaaccaagaactgcaaactacaagtgaccatgaaatttctctatgaaatattacctccatggcagaatcaagctgcagaataactggtattggtcctaaaaaggtgggggttatgatgcctgctctttctcgagctttgtggtccaatgtttccagtttgaataggagg

SEQ ID NO: 14270 - DNA, 773 bp, Oryza sativa
gggaactccgacatttaaggcacctccttctggagctttccctcaatctctttgtatattctaactctaccatagagtagcctaaatatgaaaatgagttgtactctactaaagttgtgttatgttttgagagaagaatgaaaagatccttttataggtagcaatgatggttactatggcggttgtgaggtcagttcacccacagccgctatagggaaccaatctctatcctccacatggaaggtggggatagtggtgaatctaggatgaaaatagagggggtgctcctaatatcctatgttcaacccataatgcaatgaaaacatactaaaaatatatatttcttggtctcatgcaaatataatttatattttgttcataaaaaaagaaaaataaactaaggaatcaagtatcggtaccttgttaatcaaatacgatgccataaacacataaaaatccatcaatggcctgcatatcaaattaaattaaatggcctcacttgatctctaatttccttaggataatcttcattttgtttgcgacacgctggatcagcaacaatttcactaggatctaaaacatgcctcaacatgttgttctcatttggtgtattccttcgtgggtaaaaattatgcaatgtttgattctccatccttgcaaattaagtgacctatgtgtgcctaaaataaagaattgatttactgaaaattgctgcagtgataatcaaataaaactgaacctgaacatactattagagagcaaagagattgatt

SEQ ID NO: 14271 - DNA, 22146 bp, Oryza sativa
agctttgaagtacacattattggatgatgagttgtattatcggatgattgatggggtgttgcttaaatgtctgagtgccgatcaagccatggttgtgatgggtgaggtacatgaaggaatttgtggtactcatcaatcggctgataagatgaagtggctgctttggcgttgtcggagatatgggtccggggatttgcgaagtgtggggaatctaccttcctatcctgctgcgtgtccgtacagcctggccctgcccccgagcacgcgaaccgctggagcagccggggggggtcggggcctcggggtgccacgtcatgcccctcgggcccttgcactgcttcgccccgaggccctcgcctagccaccatttggcggggggagcgagcgaggagggggcccaggctgagcttccattaatacgcgcaacgccccaactgccccgtgtcacatttaatgcagtgaggcagacgtgcggcgtgcgaatctgacgcgccataatcaagaatgaccggtctatgaccggtcatgacaccggtcacgtctgactagaccgacaaccgtactcccacgtcgcgtctgctcccggttgagtgggggtaggtatgacccgtcccatcggagggtcattcggacggcggccaccacaagtcttcatccattaatgggggaatgatagggctgtcccccgtgtcaggcgagggacggcgctgggccccactcaagaacaagcagtggcttagcttccaggcaaatgcacgggtcaagttccggtcaagatagggtgggtccccacccgaaagaagagtaggtagaggcggtgcatgtggtatccccttgagatataaaaggaggaccttccccaccgagaaggacgactctcagaaaacctgaactctaggagaagaagggcgagagtgctctccggagtaaaggaacccttgtaatactcatccataatcccaaacacaggagtagggtattacgctccacagcggcccgaacctgtataactcgattgtgtgcaaggtagctagcagcctagggggcggatacgtgatttctaagaggcgagcttcttcccccggccgaactcacgaaaggggcgtctcacaacctcccgctatcgagggacttccctcgataggcgtgcaggatatttttggccgaaaatgttggaagattgttttagatattacaaaaggtgtcaggattgtcagaagtttggagcaattcagagagcaccagcgtcgactatgaaacctatcatcaagccatggtcattcagaggttggggaattgatatcattggtatgattaatccaccctcgagcaagggacacaagttcatattggtggcaaccgattactttaccaagtgggtaggggcgattcttttgaagaaggttgattcaggggatgctatacaatttgttcaagagcatattatttaccaatttaggattcctcatactattacgactgatcaagtgtctatctttgtgtctgatgagtttgttcagttttccgatagcatgggtatcaaattgttgaattcttcgccatactatgcataagctaatgggcaatccgaggcatctaacaagagtttgatcaagttgtttcagagaaagatttctcattatcctcggcaatggcatactaggttggctgaagcattctggtcctatcggatgggttgccatggatcgatccaagttcctccttataagcttgtttatggacattagaatcggctcgaggagaacagatttgcagaatgcgttgtcagccgatgaatattataatctcatgtccgatgtgaaggaggatttggttcaatccagattgagagctctcacaaaagttactaaggataaggaaagggttgctcggcattataacaagaagataatatctaagtctttttctgagggagagcttgtttggaagttgatcttggcgataggaactcgtgataacaaattcggcaagtggtcactgtcacgtcctgataaattcatcccaaaataaaaatcattctctaaatggaataatagaattaattaaaattcgaaaagaaattggcaaacactaaaatacgtacaagaaaaattcgaatgtggtccggagaatttttgttaaattctccttggtctaaaaggagccctcaaattttacttgaattttcagagcaccgaaaatatttattaagcaacaacaacaattaacaaagtttattaaaaagaaaactaaaaataatcctccttttcatttgggccaagcctccctctctctctctcgtcccgcacccgaagtccttctccctctcttttttctccccctctatgtcacgcccagaaattcacgaaccagaatttctaagctgaatgtgcattaaatccctgtccaggaccagccagggtacacaaacgacaattgttgacatacagatccacgtcttacaaaaatagaaaagattacaaatgcagcggaaaagataaaacgagctagacttggaaacttgacttctgcagcgaggcgactcgactccacaggcaatccttgacggcagcgacaaaccaacttcgacaagacagctcccactaggaagatcttcagctctggtataggggaaaagagagcaagactgagtactacccactgtactcagcaagtcataccggaagaggaggtatgatgcaggatataaccgaaggaggctaaaggttcttttgcacaaagcaggcatttaaaaataatagttgaaagcagtaaaacagttgtagtaattaatcaatattaaccaaacactgtccaacgctacaccacgttgcaacaggcccaaccaaccacctaaactacaccagttcattaagctaaactaggggtgagactaaccacggtgaatttggttgatcgcccataactgcgggcacggttcttcgaatagttttactctgatcagagttgtacaactgtacccacaagacacgattccacacatgtcgccatgccccgaagtatcaccatgatactgcaaagggggaaatcgtgacaagaccctccacataaccctcccctaaccatccacaccacgctaagttttcacccccacccgtcaaaaggcagtgggcggtcccctactgcgccgcggtgaatccggcagctggacaacctgacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccgtccagtgtattttaattagctaacaccattgcggtggcaccaatccaaagctatgctcatagttaaagtctatgtaataatgtgatccctatttgtgtgctagttgagctaagcatggctaagcatttcctaaaccaacatctaatcattttgatacccaggttatcaatggcatatggtaaacaataaatggctgagtaataggacccatcccagatgacattgtaaaagaatgcgacatttaatagaaatgcgggacatttgtagattgggtacaatatgatcaattgtaatgcatgacttgccttactctcgcactgatgagaccacagcaacgtcttcgagaaactgcggatcgacgaaacggccgaaatctacgcgacaaacaaagcacacaagcaaaacatgctataagactactgaaacaggaaacaaaaccatttttaatggattctagggatttttatgaatttactgagacttgaatggacttaaacggagctcggatgaattactaataaagaaaaagtccttaattatttattgcgtaataaatcccaagggctgacgtcacccaaggggggggcgccggcaagcggggtccgcatgtcagtggcacaaggggagagggagggggcgccggctggtggctcaaggggaggggtggtccaccagctggtggggcccaccgggcagcagcacaaggcgggaggggagtggatggtggttcggcacggctcaagccggccgaccatggcaaggcggcagcggccgcaggcggcctccgacgacgaccggcggacggcgaggcggcggcggccggcgtgaaggcgacggcgcacggccggaacagcggcgtggctcggcgctcgcgggaaggggaaggaaaggaggaaaggtgtcctcaccggcgatgcgagggaatcgggttccggcggtggcggatggcaatcgagtgggaccgaggtgcgggcgacactggcgagcgcggcggcggctttagcggtggtggcgcgcggccagaggcggtagtaggcggcggcgcgtgggaagagcggtacggcggtggcgaacggaaagcgagcggcggccgaggtagctctcacggcggcgaagctagcggcggtgattgcgcggcgaggcgacggctcttgcgatggcggcgtgcggccggaggcggcggcaagtggcggcgctagcggcgagcggcgcgggctcggtaggaggcacgggagggggcggcgagagcggaaaggggaagaggaggctcgggggagcaatttataggtggagggggaagcggacgtggccgggaaagcctccgattttgccggcgatgtggggtggagagagagagaatgggggggattcaaattcgaatcccgccccttgcaagcgcgcgcgcgggccgggagacgcgggagagagggcggcaacgtggggaggacgcgggagcggcacggcgtgggcgcgggaggagcggaggaggtgtgcgcggcggtttcggcgacggttgccgacgtggggcgggcggctggaggaaggggatgaccccgacaggtggggcccacctgtcggcgtcccagagagagagggagtgagggagggcttcggggaggggaagggaggagcgggccagcccagcaaggggcgcgcgggagagtgatgggccgacggcccatcaagagaaaaaggaaggaaaagaaaagaaatagagaaaaaggattttcctgggatttaaaattgcactttggggatttttagttggttaaaattatttatagggctctgaaaattccactaaaaatcctgttaatcgattgtgacatctagaatccaagaaaaatcccacaatgccatttccaattaataattgcatttattaattagggattcaactctaggttaattagaacaatttctccggacgatttacttaacaaatttttaaagcaaggaaaaggttgaaactttagggcgtgacactctgtctctcaagggccggcccgccctcctttcccttgggccaactccccctcccttccccctccgggccgccttcggcccatccgcccggcccaagccaggccgagtccctcccgcgcacgtgcgctgtgtgcgctgaccgcgtgctagcaggaggggcccacgcgctggcaggaggggcccacgcgcggtagtcttcctcctctagccggccgttccgctctgtccctctcccgaaccatagccacctccccatcaccttcctctctctcctgtgctgacggtcaactccggccgcccctgccgcagtgcctgtgcgccggccggccgcgccgtgttctcgctcggcctcacaggtgcatcatcttccctggcgccgcctccgattcgtggggaaatcgccggagacgcgtccccgccggcttgcagtggcattgccgctactataccatctccaaccatccctgccacctcgcctgagtgcaggccgacgtcgctgccacctctgtcggtgctgcagcgccatcctcttctccggcccggctgcggcgtcgcccgaagttcgctgaaacgccgccgccgcgccaaccgcccgttcctccttgccggctcgtcgccccgctgcaccaccaccttctccaacatcgcaatggcgtgttccacgccgtcccctactccggcattgcagcggtgatgtcgtcctcggcatcgcctccccttcggccgaacccgccggcgtttgtcgtcgcctcctcaccggttcccaccgtcgtcctctcgtcgttcccggtcgtcgtggtgttcgtccctctgtcaagccattctcgttcgtcatcctcgctccatcaagtgccacagccccgtcgtcatcttcgtcctcgcctccgcgtcgtcaagcattgcaccggccgcgtcttgccttcgtgcaaggatcgccgccgaagtcgttccctcgctgttcgcctccgtcgtccctgaaccgtctccgccgtgcccgttcgtcatcatcgtgccacacctcgtcgcatggtggtaagggtctctcctctcgctgccccgccctcgtcctttcgatgtcgcccctgcccgttgtgcggttgtcgatcccgctacccgtgtaccggtgtcggtagtcgtttgtgtgtgcgtgtggtgaccgtgtttgtgtgcccgcttggtagccgcgtggtttccacatgtgcagcccgcatggtgtctagtggagtccgtatgtcagccactcgtctcggttgacacacgggatccgcttccatcgacccgtggactgtctctgtgtacccggtttgccatggtcccttaggttgacatgtggggtccgcatgtcaacagcgcagccttctcgtcttttctaggctagcgcttacacatgttttataattgcaaaacctaattataataatccgcaaatctccagataacagcattaaactaaagaaccatgtgcttcctttttatgtattgttactgcttctttataggcttgtagctttgcttgtgtgcttcgtgtagcttctgtcgttccagaggttcctgaagcgtggttcgtggtcgtcgccgaatgttcggaaggccattctctctgagcaaggcaagtcacatcatccttgagcatattgaatcccagtttataaaattattttgatttaaattaatgcattatctctttatttaaattcctgcgttatcactgttttatttagccatgcctatttacctttgttatgaccttattattatttctattgttattattaccttgttcaccctaggataaacaaaaccccaactagtgggtactctatttatggttccactagtatgaacttaggtagatgcttcgctgattaattaggcaacattaggtggttttataactttagactttgggaattctcatatcatttagacactatggactggttgccttatgttggaattggacacacacctccccctctattcaaaacccccaaaatggttttagcctgggctcgaggtgcgtggttgggttttgttagtcgtacctcgggtactataaggattaagctcaggcctctattgcaaagcactaccatacttccacatgtctagtgggtaaggctaagtttgtggctcagtttggtcataaacaaaggtacacggatggagatggacgaagtcggggctcgatggacatctctaggacaaatgaaggctacacgagctgcggctcggtagttgagatgtcatggcacagggccggtgttctgctgctaggggctcaatcctacctacctgtctcgggggttccagccgtaggcggggttgggtcggtactcttgtctatggctaggatgggttgggaactatgtcacatcgtccgtccgtatgccgtggtggtatgtggcacgtggttacacgtgaggaagacgtgtcttgtgggtaatgatgtacacctctgatcagagtataatctatgcgaatagccgcgccctcggttatgggcaagcctagcaatgtactcaagttagtgttttaattcttaaaaccgcttaacaactaaaatgtgaaatggttgggctgggttggcttgggacgagctgggacctgggtctggtggctagttcggtctgaatcatcgtaggccttgggttaaggcaggttcgtgtgggttcacagccttgattaataacattgtgtagctctagaatcatctttacaaaatagctttgggcaatgaagtaacttttaaatgttgtttactgcaaaacttaacccctattattatccccttgtacccccttgcattaatcatgcatctgccggtgtggcttgctgagtattgtggttgtactcattcttgctctatctttacccccttcagtaagagaagctttggagaagaagtcgtaggtggagtcctggcttataccctagttgagcgcctgtgaagatggaaccgtcggcccgctagtccgctgctgattatttctgtttgtcaggccttaagtgcctttgtaataatgtaaatattatcgatataataaagatgtgccttttgtatcatgtttgtttggtgtaccccagcttttcctgggacggggattaatacactagcgttctggaaaaggtatttttccgggcgcgacagtcaccgaattgggaaggaccgtttcaaatccataaggttgtgtccaaaggagtttatatgttacaaggacttgatggaaaagtttatggacgagcacttaatggcaagtacttgaagagatattacccaagtgtttgggttaatgcatgatcggttgggtgttgccgatgcatgatagccgatgtgtttacatcgccttgagatggccgatatagttatatcgcccttagttgttttactatcataatcggttgtgttttgccaatgtatgacggccgatatagttatatcgcccttagttgttttattatcataatcggttgtgttctgccgatgtatgatggtcgatatttaatatatcgcccttagtccaaattataattttatcgatgccttcatcattgcaaaattaggggggcacatatatacaaaagttgagaattatcggcagaaaggttcagtgataatcaaaaggagtaccaaagtttcttagccgattacaaaaattttctaagtcctattacaaagataatcatctagacaagttacgctggattgccgatacagcccgttggctaatttgatctacttcttcaatagcttggatatcttgggcgtcggttccaggaatgaccttgagagacttggtcaaatcggccacgttcctgatagccaattttagtctggacttttgttcttcgacagcctttgggatatcagttaacttcttctgctcaagagccatttcggcgttgcattcctctagttgagctatgagatctattctgcgagcctcaagccgatctattttagtttgaattggcccaaccaagagttgatctagcttagctttctcttcatgaacggtttgccgattggtttgaatagtggcttcaatatcccttcgctctcgccgatcggctatcctttgcttggccttttctaccttgaattgatgttgctcgaggtatacagctggagaaatggtatttgccagatcattcgggattagggattgaatctctgcaaatcttgcccggattgtaccgcagtcaaccaccaagttgtctaatgatgtctctagccgatgagatatgtcttcaagagttcttttgacatcgtcatctagagggactagagttttgcttgttattttttcttctacctcttcatcaaagtaatccttgatgtcaaacaagaacagatcggctaaagcctacaaaaggaaaattgaagacagttaaatttcaaagcgaattatatagccgatctaagatttatgacaatgaaagacttactggtatggcaggagcagctcgttgttcttcctcctcaatattgtggctgcctgcagccgatggagtacgatcactgggcgtcgactgcacaggaggcgaaggaggaggagaaggctgaaaaaaagacaagtgttaattaacatcagttatgatcatatttaaaggattttatagaggaaaccttaccggtggagctggtttagatggtgctggtgctattttttcttgacgacagttttttttttctacaaatacaaaattgataaccaatcaactctgcaagttttttcaggagatgatcaagatgggttatttccccttgagaagtgagctggagcagcaggagttggaggagtctatttgcgtgaagccgatgatgttttttctcctaagtcactcagttcggctgcagcttggtcgacatcttccttaatctcttcttcatctagggcttgttctatggatggatctaaggcaggcaagtcatcggttggcttggatttcttcttcttggcctttctctttggagccagagccgatggattagcggctgatgccttagttttcctattcctactggcatcagctagttctcttagctgcccttggagtagacttgaggtcctgggggcatggtagccgatgacgggggagttagtccacctccatttggtaagaggcctgaagcatactcgatgtccttgccgctgttgcttttgcgaggatgggaagattctattgtctgcaagacagaagatgagactagtaaaggtacaaatcggctgacaattattttacaggattgacaaagtaaggatttacctgagggataacatctgggaatagatctgtcatgtacatggaagctgattggtggaacaagtgctgcttccattcaccccaccatctgtcaaagttcctgctcctgaactttgctagttctacatttttgatgctgcccaaagggggtcctgggatgttcaacagccgatccatcatcaatgttgatgagatttcgcctctaaattgaattttatcggcaaaataaaagccgattggcagctgtcccatcccaaactgcctggccgagctcattggatggtagaactcgtaagacacttgtatgtttcatccttgatggatgccaacaggaagaatacatggactgatagcagccaagaagacctctctagacttatcatatctttcagaattgatttcttcaaatctaaagtctgatggcagttcaaagctcattgagtcttcatatgcaaaccaaactcgagcatctttctggaagccctcatagaatctgcagaaccagtctttgagcagttcagccgatagctttgctccagaatcggctggtgttgatgcagcttctccatatacatgcatctgcgatgggttagtacttccccatcgtcacttgtgatcagttctagtcttgaaaattgggactctaacagagctggccgattcacagctttcttggcaactaagttaagccatgtttgcagtaaccacgatggtccacctgcacctactactgagcctgcggctatcttggccgatgcgttgttcaacatctgatacagatagccgaggaggattttgcccaaagggatttgcttctttgcttcaagggcttctgctaggaattgccagttggtagtagggccacaacttgatccacagaaaagaaatttctcaagccacattagtagaaaggctgtgtgctcttggggggtgacagatcctatgcccatgtttgcggcgatatagccagaccagccacctattgtttttgttttaaattcaaactggttcttggaatttagggtcatcagattggccgaataggtgacatctaaaccagtgatcatgatgacatcaagcagagtggggggtcatcggcccttgattgaataggaaggcattgagggtgttggaccagaaatatgttgcagaagccatcaggggttcgtccttagctgaatttgctaaagtaagagcaagggcttggctgattccgagttcatcccagtgaccttgcttgctagccaacacacgcttgtaccatacgggctaacttttctcaggagaacttttctcaagcgaaggccaagacttgaaagtatctttccagtgacctagatttgggttggccaatctgatgctcatgtgataggctaggaatcgcaaccagattggaaagatgctacggataaaaatagagaagaagaaaacaagatgagacaaggaaaaaccaatctattgcataaagaagaagatctagccgatggacacgtacctctgcatactcggctgatggcgctgcgaacgggctggcggaagtcgacatcgctgcgggtggaagcttggccggagggagaatcgccttgagatcaccttgcgcactgaggggatcactggggaaagagaagaaaaagtttgcttaagcggtgaaaacggaggtaacggtgtgaaatttctctggggtgacggttagtatttaaagcctacggttacagtcagaaaaacggcaatgagcgatattcttggagaagcagaaatggcaaatccgaaacattaccaaatattccggacttggggggcatgtgttatcgaccaaatttggtaattcaagtatcggagatggaaccgaagcggaatccaagatggagatcgttctggaaacagagcaagaatcagctaaagtccgaatcggccacgaccagaattggtagagttcgagtcggacaaggttagccgattgagccgatttcgacaatgtgactcggtacacgttgtcgggttgagttaatgtgcttcatatggattgccacgcacggattaagtcctgaaaaggcaattgtatctattagttaggacattttatgtaatttccttagagataagtttgggcaaaagtctgccgcaaagacttatggaatcttagagtttgttagagataagagtcgtgtccgataaggacatattttgtatctcgggtataaatatgtcccggacccatgtaatcaaataacacatgttcaatacaatctcggcgcatcaccaccctcttactttcatttacttttcacgagttattgctttcaagttgagctgcatcggtttcgatcttcagctacaggtaaaacttgttatggcggcttgcgttcttgggattagtgcttccaactttatgatactctaatcttgtttatgtaattcgtcgagttgtcatatatcttatataatctttgacaattttgttatttaaccttcaatcggctaacatctatcattggaaggcagccgattaggttaaataccaacgttgacctagattatataagatatccaccaccctatgaaacactgaacggcttgattgtctagatattgtccttcttttcatacttatagctgcatcagttgagtttgaccttataagtcatgattagaatctcaatctctagcctgctttttggttgccgattagggtttcatccgggtttcagccgatcttacctaatttaactactttatgttaagatcttgttgcatttaggtatattaagcttcctgtttgatatattttgcttgctttaatatcttaatatagagtggtatcggagtactagccgatacatgctagatctatctgatcggctatgctatgaatgcttataatcttcttgttaatatatatattttgatctaagtgatttatacagtctcagcatggcgaccgatctatcctaatcacttgatttaagtatatattgatggaagtattatataccattaatatctacagccgatcgaaaagatttagttctttcttgcttatttatgattgccgatcgattctaatatgacatcggctcaaagataaatgatacgtcatcagcgactagctgatcggctatcttttatagatttaactgctattttcctgtctttatttcttgttgattgtaggatcaaatcaactggcacactcacgaacctaaaggcaagattttttggaactgcaccgaagttaagcagatcttccaggcctcgtgtttttcacatcaacacgctgacaagccaatggagtaattcaagccgatgccgataccggccgatagtgaatggattttgagctatcggctatatggttgatgtagaatatgacacttgatgtaaataaagacaatcgactgatgataatgtgataaaacaacaatataatccagtagaaaccaatcggctaacaacgataagatagaataagcactaatccgaaggataaagcatatatcggccggaggtccaatgtcataatgcaagcgattagataaacggtgaaaactttgtcacgatcaggtcaatcaaagtcatatgcaatctttgtaagtcgatgcaacgtccagataactcatcggctggaacccgaattaaatccttattggcaatcaagagcaggctagggattttggttctaagcactacttaatagatcaaactcaactgatgcagtactaagtacgaaaagaaacataatatatagacaatcaagcccttgactaattttcagggtggtggatatcttagctaattcttgacggtcgttagcgcttgttggcggctgttaaatgccaattctataccgccaacatccgcataaattttagataataaaatatccaacatagtgataggtacttaatttcacatatttcacaagtgttggtgcatatttgtatgcagatgatagaccctacgtttttttgagggaaagcactataggggaagcccccacagtaatactttattaaagaatataaattacaaaagatttaaccaattcaaaagggattgtctctcagaaacatttaatccaaaaaccaaaagggaaagatcactcttaaagagagctttccaagaagaaattgagggtgctaaattctggaaaatcagagagttcctctgtttccaaatattccaggctgcataaagaattttctccacaaagtgcgtagacctataagaattcattgcctgataaaccctacgttgggaggaaaatcagactaaagtgagaaggaatatgtatccatacaaggatgggttgtgaacttcatcaaatactagagaatcagcccaaaatactgaagaatggataaaggaggactaggaggagccaggccaagggccagaccagggggtcccagcccaggttcagccgaaccccctggttcggcgaaaccctggagatcaccgttgatcccatgttttggcatggacgctccagatgcattcctgatggcggttgaggggcacttcggacctttccccttcaccaaacgtcatacctacctctatataacgacattactcttttacttcacatacacacttccaagtttcagctgaattataagaggctctattgtactatattgtatctaaaataggaagagagtagagtagaagaattcggaagaattccagagttgtcggtaatcttctctcatttcttttattctgttcattagtctaaattcaatataatattcttcttgagttagatttatctcgtgagaattatctcttggttagttcctaaatagcatacgggatcattgtcatttatttatagtgattgctttagtgtttgatctgcactagagtagttattaattgcgtagacgcggtgtctgggtaattaatttctagtggttgctgcgtatcccatagcacgtttaaggtaggtgtagaggtggtgacagccctcaagagtacttaagtcctccctgtccgtgtacgtagtagagcgatatttaggaacagcgggttgccagtgcctgaagtattgcattaggattaaagttaagctttccctagacactgtttctcactagtaaatcctctctatcctagcctatcatctgcttggtgtccttggatgaaccggaggaagatctgaccacacacgttcccttggattcgatacccctggaatactccgtaggggaagtgctacatcggtatatccgtgcgcttgcggattctatctatgatcgtaagaaataccaacaagcatttctggcgctgttgctggggaacagttgctgatcattcccaaaccttgctcatcctcgtatcctttttacttttctattctacctttacccctgctatcctagagaagtattcctgtgggtataccaagatcaagaatattctacaaaagacggtcaacagaatgggaataggatggaaggatagattgccagacgcactgtgggcataccggatagcatacaagacacccattggaatgtgcccctacagatagtctacggaaaatcttgctgactccctgtagaacttgagcacagagcatgttgggccatcaggaactggaatatgaactttgaaggagcaggagaatggagaaaaatgcaaattgctaaacttgaagaatggagagagaaggcttaccccaacgcaaagatatataaagaaaggacaaagcactagcatgataaaaggataaagatcaagcaattcaagctaggagacaaaatactgatgttcaactacagggttaagcctcttcggccacggaaaattgggtagtaaatgggaaggacagctcgtcgtaatcgacacctcttcgcacggggcaatcacaccccgcgacgactcaggaaatatattcaaggtaaatgatcaacgcttaaagattttccttgagccaaatgaaactgtagatgaagaagtggatgttattgaattaatcgattattaaccatgatgatctcatctaatgcatgcttaaaacattgtatagttgtcatttttatgcttagcttagggtttagtggacctagaaaaaaaattggcacctaacgggacccaccagggttcggccgaaccagggcggcgcctgatcagccccaatttggaacctcaatctccccgctcgtctataatccgttgtgatgcgcattcggaggtagatcagtcgtatcagacccagagctctgttcttcctcctctctcccactttaacaagcctcctctcattctcatctcaattctattgctccatcacctccaaatcactaatggctggcaaatcattgatcccattcatcggctcttcctccaactccacatacaaccttgacggagagccgacatgggcgaatcaattgatcccggtggaacactacaccatggaaggggtgaatgcactgtgggcgcagccccttgtgacagtgtcgggctcccctgcgaatttggagcacttcggcgaataccctggttcggccgaaccctcctcggccacgttcggccccctcttcggcagcgtgatccctgtcccctcgccatgttacgaagaccaaaattcaggggggattcacctgcgcgacggctgacaacaggcaagctcggtctcttgaaggcacgacgccattgtcaagatgatgagaaggccgttccgcctccgccgagcgatatgtgggcaccctgttcactaaggcaggagatgaggtgctccacaagtacaccacatctactactactccatccactccaaaggaggatcggttccgcattcagggagtgcgaactcctggcggtgggtatggtaagggcttgctccggcctttgacggtgtcaaaaaaggagggggcagcagaatcccgtatccctccacctataaaggtgaagcgtcatttgacgccccctccaattgtaagggcggccggccaataccaaggagatgaagtgaagtcaccggagccctcggtctataagctcgcctcgcaagtgagggaactccgcaaggagaacatagagcttagagcttgcaacacggaactaggggtagaactcgctgaacttagaaataatgttgatacccttagtcgcggtttgtgtgctaaaataaagcatgcattcgtagagatggggaaggagaataaatattatgctaattagatgtctcctctcccataaataaagtaatagtaggtgcttggttttatttttccaatcatgtaagcacttgctataaataatgtggctcattggtgttaaccccaatgtttgctgaagtttgtttttgtttaataaaattcaggtttttgaataagtgtggggcagatatcgcagcttctaacgtgcacatactctgaatattgttgaatctctgaacacctggaaggcactgaactctgcagaaaattgcagaggaaatgggcaccagagtggttcggccgaactaccagatgcggccgaaccagagctggccccaatccctctcaattttcacaggtgagcatgtgagcacgtcttttatctgtatatctccaccatggtatagtactagagctgaaaatcagaaaacaattggttcaagcataagtaaaagataaaattttcaactaatgaaattcttcagatgattgatcttgtatattcattattctcagctgaacttgtgcttgtgaacagccatccatgtttagggaaccttatgcatctaagtaattgctttatgtgaggtgaataaagatgaaaggaattcttgcaacttttgtcatgactcttgggaatttgttttcaaaataaaattgttttaaaagctcattcctccaattgacttcattctttattcctaccaaggccatatgcaagtgcatctttgataaaccttattatgcgtatgactgcttgacattatattgagttttgtcaaatttatgtgactcgtcttagatatctttcatacactcatgatcaaggagtcatttccattttcatttccacatatataattaagctaatcttctacactggaagttgccttccaacaaaaattccattcaaataaactccaactttagaccatgctttcttctcctagaaaaattcttggcaaaaagaaaatgataaaaggagggaaagacatggctgtgaaaaaaaagagagaaaaaggaaataaagtttgctcttaaaacattgagcatgatgaaaacaaaatatagccatgccccttctatattcatgccaagaaaacaaaatggagagaaagtctagcaaaaggggagaattatttctttattccaccattccacaaaatattttacttttccattttctaccacaaataaagacccttgatctaggggtatgactgatgatcttcttgagtccatatctttggctttgcaatatatatgttgcaggtatgtcacaatttatccctaccgaactccacatatcagccttagaataggggtaaattctggcacattttgccttggtgaggatacaaaaagaaaatatacacatttccgacaattcacatgctctacaaccatcatacctgcctatttaaagagctctcatcctcactatcttcacacacttcaagcaagagctctctcatattctctcaagtttagtttactagtctcaagctagtggagtaggaatagaatagaaatcagagtctggaagtcttcggaagagttcgggtatggctctagttgctctcctttcttctttcataagatttgtactttatttagaatattcttctttatacaattctggtattgaaatactttccgagtatatgaatgccagctttactttatgttcaagttatactgattatactgctagcttatctgggagatgcataggtacaattataatgcttgcaattgcaattactctacgtcatgacaatgacattagagtagtatctggtagtttaggcatgatgtctagattatagggtaatataatttggggttatatgatgtggatgagaggtgggccactaatggtgacagcccaatacgggtattcctccgcgcgtgtatatagtcctaaattaattttctgggaaggggactcctacgtatttagcctcggttgtatggtcatgacgggctgtcgtaaggaactcggcagtcaggggtggcttctcaaagtaccaggagggcatcagaaagagggtattagaaggttaatcatataactaggatatatgtataatatgtattggaggtataccatgaggaccttctgtcacaccctgaagttcttttcccaagcctaaatcaaagtaataattggtctcaagaaattacctctgtaaaagcaagagagaaaccttaatttaattaacacaaataataatcgaaaatggcatgtggaatttttcttgggttcctcaagtcaaaatatgctaacaggatttttaatggaattttcagagctctagaaataattttaaccaattaaaatcgagcaaaagcattatttaaatccctggaaaaaaactttttctttttccttttctttttcccctcctttttccttttgggccaccggcccacttcccctccccctcccgcgcgctagctggggcggatcgaggccgaggcccagccagtggctgcccgcgccctcccctctccgagtcaccgacaggtggggcccacctgttgggcccattccctacctccggctggcgtgcccgcaatcgccgctcccgcctctcccgtgcgtccccgcccacatcgcctacctcccgcgccacctcccacacgccccacaaccgctgccccacctgcccgcccgcgcccgcgcccgcgctggagacggccgggattcgattttcgaatcacgcctctctcctccccacctcccccatgtcgctgttggtaatcttacgatcatagataaaatccgcaagtgcacggatataccgcgatttagcacttcccctacggagtattccaaatgtgtcaaatccaagggaacgtgtgtgatcagatcatcctccggttcatccaaggacaccaagcgaatgataggccaggatagagaggatttactagtgagaaatagtgtctagggaaagcttaactttaatcctaatgcaatacttcaggcactggcaacccgctgttcccagatgtcgctctactacgtacccggacagggaggacttaagtgatcttgagggctgtcaccacgtctacacctacctcaaacgtactgtgggatatgcagcaattactggataacaactacctaaacaccacgtctatgaaattaatatctactttagtgtttataaaacacgaaagcaatcactatattttagttgattatagtgaacaataatcccgtatgctacttaggaactaaccaagagataattctcacaagataaatctaaaatactcaacaagaatattatattgaattcagagtaataaacagaataaaagaaatataagaagattaccgacaactctagaattcttccgacttcttctactatactcttttcctattctagtatacaatatagtacaatagagcctcttataattcagctaaagcttgaaagtgtgtgtgagagtgaatgaagtgaggtctatttataggacatgtatgacagttataggaagggatatagtccgaagtgcaccttaaccgccatcagcaatgcatctggagtgtccatgccaaaacctgggatcaacggtgatcatcagggttcagctgaaccagggggtttagccgaacctgggctggccccccttgcctggcctttggcctggctcctctcctggtcctcctctatccattcttcggtgttttgggctggttctctggtgttcctatgaagtccacaacccatccttatatggatacatgatactcctcactttaagtctaggtttcctcccatataaatatacaccaataatgtggaatatgtgagatttaagaccttatcactgtgttggatgttttattatctgaattttatgcagatgttggcggtatagaattgacatttagcagccgccaacagtcaccggcccctcgagcctatataaaccatccccggaccctcctctctctttttcgcattgcaatcgcccgctcccaagctctcatctgccctagcgccacgcaccacccaccgccgccgctttaactacctccggccgccgctcgccgccgttagagccgccgccgagccacgccgtcgcctccgttatccgccacttgccgacgctcgtcgttgtcggtgcggcctccctccttcctctctctttctctctctctctgtgtcctgtgccaccgcctagcgccgccgcctagccgcgtcgccgtcgcgttgccgccggtcaccatcgtcagctgccgcctagcgccgccgcctagccgcgtcgccgtcgcgttgccgccggtcaccatcgtcagctgccgccttgcgccaccgctagcgcc

SEQ ID NO: 14272 - DNA, 8224 bp, Oryza sativa
actacgtgagggtaaatcggggccgtccatccaccgcccgcgtggccggcacgtcggtgccacgtcagcgccgcgtggtactcccatcccctgtcccgtcgactcagtccaccatggaccggcacatccgagccgatgacatgtgcggcccgcatgccggcgccgccccccccccccccccttcgctgacgtcatccggggttaattaatgcgcaataatccaattaaggttttttcttttattgtaaaaacaaagtgaatcttctaaaattcatagaaaattcatctgtgctccgtttaagcccattcaagtctcagtaaatccagaaaaatgcaaagaatccattagaaatggttttgttctctgtttcagtagtcttatagcctgtttgcattgtttgctttgtatgtcgcacagaattcggctctcccgacgctccggtgtactttgagataatccgcagagcaaggcaagtcatgcttgtctcttgaacatgttgatcccatattgcaaatgctctattgttttcctttaaatgttgcactgttttataatgttactatgggatgtttacctactgtctcagccttatcatttgttatcctgttccgttgttagcttggggatgtaacatgttagccttatcatttgttagattaggggttgcttagccatgcttagttctactagtacacaatgggggatttacattaatgcatagacttcagattctagtattgatgttggattagtgccaccgctctagtgttggttaattaaaatatattaaatggtgggctgtgggtgtatggttttgatggtcacacccatggcaattaaggaccggttcgcgggaaaccctggaagaattcctcgtatttaccacaagccatcgtgggcaacggctgggcttgtagtgtagctttcctctagctgacacatccaggcaagggtgggcgtgatggagcgggatgggccctgcgacggcctttgtcgcttctggattcacctaggcacgagaggggacttcccgctgccttgcgaggagtgggggtgaaacctaaggtgtggtgtgtttggttagagggggttatgccaagggtcctgtcacagcctctatccggtatgtcgtggtggcatgtcggcgcacgggaacatgtggtggggctgtgtcttgtggctatagttgtacacctctgatcagagtaaaactattcgaatagccgtgcccgcggttatggtcggtcaaccagattcaccttgattagtctcacccctagttagttaatggaactgattagtgcaagtggtggtttgggcctgtctcaacgtggtctagcgttgagcagtgattggtttaatattgattaattattacaacttttttttctgctttcaactaccgtttataaatgctagctttatccaaatgatcccctttagccttcctttggttatatattacatcataccctctgttccggtatgacttgctgagtatagtgggtagtactcagtcttgctgtatctcccaaccctcagagttcgagtatgtgttcgatggtggtttctccaaggagtaggcttcgtctgtgccgtcgaggatgcctgtggagtgttgttcccgctgctatccaagtcaaggcttagctccagttatcttttaatttccgctgcatttatgtaagacttttataatgtttgtaagacgtggatctgtatatcaactttgtcgtttgtgtaccctggccggtcctgaacaggtgtttaatgcacattctgcttgaaattctatttgggaatttctgggcatgacaagttggtatcagagccgacctttacagtaggataagccaaatagaaaccctaagagccctcccaatccttttcattggcatatgttctttgcaattggatttgtttcgggaaaatttggatttgttccttgggttcatggaaaaattcatgatcgctcgtttcattgaaatttgttcaaatgaggtcagcctatggttttagtaaaattatctgggacatatcgggatttaatgggaggtatgccttaggtcctaactaaggaatatgggttgcaggttatttatgctcttgttattattattattattattattattattattattattattattattattattattattattattattattattattattattattattattattattactattattattattatgtatctaattcctcattattttgttgctatgtatgtcagtcttatttatttgctctcatgcaaaaatgatctatgcacaaaattccgctcttattcgcttattttatttgagtcctttaccgttaattttataattgggtttgagcatgcattgactctccatcctttgtcttctatagatggccggctgtcccctaacacaccaaggtcagactatgggaggattcatcgcagagctgtcccgcatggcgtttgtgatcggttttccatgggagccgcagcacagcagcatccaccctctcagtggcgagttcccacaccaggtccgcttggagcttcacggcatcccctcctacctacccaacatggaggtgacagcttgccggggcacatttgagcatgcttgtgaggaggccgccctcaggatgatggcccatttgagggagctgcacgacgacaccctgaacaccaccgcctactgcttccacccttgtcgcggttccagctccaacaccggcaccttcaagtcagcttggcgagagaacgacgtcaccttcggccacatgagtgaggtgatggaaggctacaacaagctgcacgctatgcttcaccgggcgaccaagaggctcaacgacaagaagcttgtgaggatcgccgagctgcaggatgagaacagttgcctcaagaagcaggtagccaggctgcaggggtgcccaccgccaggaggagcccgcatccgcaccatgccaaggaagttggccacagctcccgtgcgcatccagctcgcgcccaggaacccgcctccacctcctcccgcagctccagctccagtccaagctcctgctccagcgccaactccagcatatgccctctcctttgtgccagcttcagcttacaggggtccagtaggtggcagtggagtatggctgctagcttctcccagtggtggtcgtgcatcagcagttctagctcagaggcatgcagcggcgacacctaccagctagagtactccaggagccactcagagggaccaggcgacaagcaggaggacgccttagtagttgtttgtcgactgcattccgagcaattgcaatttaaattcctatataataaagcttagttcctgagcccctatttttcttcttttccatccgctccgtctgttcttccttcagatggtcaacaccaggaatggcagtcgtgcagcaggtgagggcagcagcagcaaagaacgcaccgatggtgggcaccccaacagcccctctagcaatggtccgccaccgctccccgagaacccgacgcttgcacaagtgatggcccatcagacccagatgatggcggccatgatgcagcagcggcaccagcagatgcaccagaggatgcaacagcaggccgatcagcagcagcagtttggtccccctacccctcagtccaagctgctagagtttctacgagtcaggccacctatattctctagcaccaccaaccccttggaggcaaaagactagctccatgccatagagaagaaactcaaccttctgcagtgcaatgatcaggggaaggttgcctttgccacacaccagctccagggtcctgcgtcagcttggtgggacaaccacatggctacccgtccaccaggcatagaagtcacttgggcggaattctgtcgcagcttcaggaaggcgcaggtgccagacggggtcgtggcacagaaaaagagggaattcccggcactcaaccagggaagcaagaccgtgactgagtacctgcatgagttcaaccacctagcgtgatacgcaccggaagatgtccgcaccgacgcggggaaacaggagaaattcctggcaggcctggatgacgagctaaccaaccagctgatctccaaggattacgctgacttcgagaagctggtggacaaggcaatctgccaggaggatcagctcaacaagatggacaggaataggaaggccgcttagttcagggcacatcagggaagtcaccagaggccgcgtttcacttccggacagcaaggtggacccaccaccatgattgtttgacaacaccacccctaccctttcgacaacttccaccaaggcgccagtggcagccagaaccaccagggaggtcagcttaaccgcagcatagctccgcgcccgctaatggcaccagcacagccagctccaccagctcaagcaaaggagaccggggcaaagccagggccctgctacaactgtggcgagcatggccactttgctgacaagtgcccaaagccgtgccgtgccgggccaaggtttgttctagcccgcgtcaaccatgcgtctgcagaggaggcacaaacagcaccagaggttgtactaggtacgtttcctgttaactcaatccctgctacagtactttccgattctggtgcaacccactcattcatttccaagaagtttgttggggtgaatgggataagaagggaagaacttagtacaccaatgagggttcataccccgggaaatagttcaacctctgtctattatagcccctccgtggtaatagaaatccagagatcacaatttctagccaacttcattcttttttaatccaaagacctagatgtcattcgtgggatggattggctgaccatgttcaagggcgtcattgattgtgtgaatcgcacggtcaccttggtcaatgagaaaggagaaacagtggtgtacaagtctccagcctcacccaagcaaggagcctcattgaatctggttgaggcgaaaagttctgtgaccgcagaggagaagagttcgacgaaattggaagatattcctatcgtctatcaatatccagaagtgttccccgaggacctcactaccatgccacccaagagagagattgagttccggattgattttgcactgggaactgctccaatctacaagaggccgtatagaatggcagccaatgagctagcagaggtgaagaaccaagtcgacgaacagcagcagaaacgatacatccgaccgagtacttcaccttggggtgctccgatcatttttgtggagaagaaggacatgacgaagaggatgttcgtcgattatcgcgcacttaatgaggtcacgatcaagaacaagtatccgttgccgagaattgatgacctattcgatcagttgaaaggagctaaagtgttttccaagatagacctgcgatcaggctatcaccagttgagaatccgggaagaggatattcccaaggttgtttgagtgcactgttatgtcctttggacttaccaatgcaccgactttcttcatgaacctgatgaacaaagtgttcacggaatttttagacaagtttgttgtggtattcattgacgacattcttatttattccaagtcgggagaagagcatgagcaacatcttcgtctggtactcgagaagttgcaagagtaccagctctatgccaagttcagtaagtgtgacttctggttgtcggaagtcaaatttcttggtcacgtcattactgctcaaggagtggcagtggacccatcgaatgtggagccagttacaaagtggaccccacctaagacagtgacccagattcgaagtttccatggacttatgggttattaccgtcggttcattgagaatttctccaggattgccaggcctatgactcagttgcttaagaaagatgagaaatttaagtggacagctgagtgtgataagagttttgaggaactcaagaggaaattagtgtctgctcaagttctgattctgcccgatcaatcgaaagatttctaagtctactgtgatgcattccgccaagggctaggatgtgttctgatgcaagaaggccaagtggtcgcacacgcctcgcagcaggtgcgtccacatgaaagcaattatcctactcatgatctagagttggtagcagtggttcacgctctaaaaatctggcggcattacctcatcggtaaccgttgtgaagtttacacggaccacaagagtttgcagtatatcttcacccagcctgacatgaatctcagacaacgaagatggttagagttgataaaagattatgacatggggatacactaccatctaggcaaagctaatgtggtagcagacgctttgagcaggaagaactactgcaacgccttgggtttgaagacatgagcgtcaaattgcaacaagagcttgaacatctcaatttgggaatcgtggaacataggtacgtggctgccctaaaagcacgacccacgctcgtggatcaagtccgagcacctcaggtaaatgatcctgaaatagctgaactgaaaaagaatatgaggttcggaaaagcccgtgatttccatgaggatgagcatggcacaatctggttgggagaaagattttgcgtacctgaagacaaggagttgaaagacctgatactcaccgaggctcatcagacccaatactccattcatcccggcagtaccaagatgtaccaggatctcaaagaaaaattttggtgggccagcatgaggagggaaatggcggagttcgtcgcagtctgtgatgtttgtcagcgagttaaggcagaacattagagacccgatggactgcttcagccccttcagattccggaatggaaatgggaagaaatcggaatggatttcatcactggtttgcctaggacatcgtcaggacacgattcaatatgggtggtggttgatcgcctcaccaaggttgctcacttcatcccagttaacaccacgtatacggggaagaaattggcagagctgtacttaggaagaatcatgtgtctgcatggggtacctaagaagattgtatctgatcgaggaagttagttcacttcaaagttttggcagaagctgcaagtagaattggggacccatttgaatttcagcacagcctaccatccatagacagatggccagaccgagagggtcaatcaaattttggaagatatgctaagagcttgtgcacttgattttggcggagcctgggacaaaagtctgccttatgctgaattctcttacaacaacagctatcagaacaatttgcaaatggcaccgtttgaagtattgtatggtcgaaagtgccgctaataaccgctgaagggagctcacctttgaagcaagggattatgtgtatcttcgtgttccagacgaaaggtaagttggcaccacgcttcgtgcaacatacaagatcttagaacgaagaggaaaagtcgcatatcagcaagagcttccactcaacatggctggcatccaccacgtgttccatgtatcgcggttaaaaaagtgttaagggtaccagaagagcaagccaattcggagcacatcgatattcaagaagatccgacttatgtggtgaagccagttcgcattcttgaaaccagcgagaggagatctagaaacaaggtgatcaggttctgcagggttcagtggagccaccactccgaggaaaaagcaacatcggaaagggaagatgagttaaaggccgcccatccgtacctcttcgccagctcctcccaatctatgggtcgagatcccgtttaaggagggtaggtttgtcacaccctgaagttcttttcccaagcctaaatcaaagtaataaatggtctgaagaaattacctgtgtaaaagcaagagacaaaccttaatttaattaacacaaataataatcggaaatggcatgtggaaattttcttgggttcttagcgtcaaaatatgctaacaggatttttagtggaattttcagagctctagaaataaatttaaccaattaacatcgagaacaagcattatttaaatccctggaaaaaaccctttttcagtttccttttctttttccccctcctttttccttttgggccaccggcccacatcccctccccctcccgcgcgccagctgggctagcccgaggccgaggcccaaccagcagccgtccacgccccttccctcttcgggttaccgacaggtggggcccacctgttggacccgttccctacctt

SEQ ID NO: 14273 - DNA, 1823 bp, Oryza sativa
tcctccccacctcccccacgtcgccggccgattcccacgcctcccggccacgactcgcccccccgagcctataaaccatccccggcccctcctctctctttttcgcattgcaatcgcccgctcccgagctcttctccgtcctagcgccacgcaccacccgccgccgccggtttaactgcctccggccaccgctcgccgccattagagccgccgccaagcgacgccattgcctccgtcgggttcacgagcccaagggccacgccgtccacccctcccctgtccaatttcgccgcaggagccctccttaaatcgcgcgccggtgagctcgacattgtcgccgccttcgaccggcgtctctgcccgtctcactccgtttctccctctctaatcccttccggttcgttcctcaggtcgtcctggagcccgtcccatcgtcgccgccgttatccgccactcgttgtcgctcgtcatcgtctgttaggcctccctccttcttctctctctcccgcatcgccgcctagtgtccccgcctagccgcgctgccgccgctcgccgccgtcggctgccgccttgcgccgcctccatcggcgccgcgccgccgcgcgccaggccaccgggccggcttaagctgcccgcgtgtgcacccggccgcacgccgtctttgccgttctcaggtagatcggggccgtccatccgacgcccgcgtggccgccacgtcggtgccacgtcgacgccgcgtggtactcccatccccggtcccgtggactcggtccaccatggaccagcgcatctgaaaaatgcaaagagtccattaaaaattgttttgttctctgtttcaatagtcttatagcctgtttgcattgtttgctttgtatgtcgcatagatttcgaatctcccgacgctccggtgtactttgagatagtcgccgaggtccctccagctgcaaagcaaggcaagtcatgcttgtctcttgaacatgttgatcccatattgcaaatgctctattgttttcctttaaatattgcattgttttataatgttactatgggttgtttacctactgtctcagccttatcattcgttatcatgttccgttgttagcttggggatgtaacatgactagatgttggattaggggttgcttagcgatgcttagttctactagtacacaatgggggatttacattaatgcatagacttcagattcttgtactgatgttggattagtgccaccgctctggtgttggctaattaaaatatattaaatggtgggttgtgggtgcatagttttgatggcgcacccatggcaattaaggacaggttcgcgggaaaccatggaagaattcctctaacttaccacaagccagcgtgggcaacggctgggcttgtagtgtagctttcctctagctgacgcatccaggcaagggtgggcgtgatggagcgggatgggccctgcgatggcctttgtcgcttccgaattcacctaggcacgagaggggactgcccgctgccttgcgaggagtggtggtgaaacctgaggtgtggtgtttttggttagagggggttatgcgaagggtcctgtcatggcctttttccggtatgtcgtggtggcatgtgggcgcacgagaacgtgtcgtggggatgtgtcttgtgggtacagttgtacacctctgatcaaagtaaaactattcgaatagccgtgcccgcggttatgggcggtcaaccagattcaccgtgattagtctcatccctagttagttaatggaactgattagtgcaggtggtggtgtgggcctgtctcaacgtggtctagcattgagca

SEQ ID NO: 14274 - DNA, 5850 bp, Oryza sativa
ttagctccagttatcttttaatttccgctgcatttatgtaagacttttataatgtttgtaagacgtggatctatatgttaactttgtcgtttgtgtaccctggccagtcctggacaggggtttaatgcacattctgcttgaaattctatttgggaatttctgggcgtgacaccttcggccaggcctaccgaagccaaggacataggcaaaggcacttgctggaggcaagaggtgaaggtcgaagggacaacataggagaaagccaaatgaaaaaagccgtggcatcaagttgacaagctttgccaaagaaggaccctgccggaggggcgtacggtcaaaggccatgaggcgaaagccttgccacgaagggcatgggtttcgccaagtatcgaaccttgccaggtgaaggcccagcgagccgacacgcctttcagaggcttaaccaaggactgggccgagtcacttggcccattaggagcccttcgagcaaaagacactgtacgcccatgaagatgtccctatcataaaggcaaccatgtaaattctcctgtaaagcctaaaccctaaagggagagtctgtaatagggctataagtagccccctagggccatataacagggggatctgagtaatttttacaaagcaatacaattgtctttacttccaacaactgttaaacgaaccacgtccttcgacatgaggcagttgtcgattcgacaacagctggcgccgtccgtggggacctccgagcacaaccattgagagtaagagcgaaaccactgatgccaccgaagaagatcgctaaggagagagtagccaagcgaaaggaaggaaacagcgagggggagatggttggcgaagagggagcagagccttcggcttcggacgccgaagcaggagctgcgctgcttccggtggcagcgccttctctcccatcttcggcgccgaccacttcgacagaccaggagacggtgaaagcagcggccgcggcgaaggcgctccagattagggacgtaatcctttcatctcaagtgctaggggcgtctcaagccgccgcctcgtcgcagcatgctaccacttcgaccgcactcaccgcctcacaagccaacgctaaccttgaagcccaagccgaagccgacatgggggctatgcggcagaacatggccaagttgtaggacacgcttcgccaaatgcaagatcagcagcaggcgtacgaagcggcaagacaagccaaggctaatgcctagcagttttcgacagtctacacacagccccaagctttccctccgcatgttgcacaagttgtacaggctccaatgtacttcgccaagaccgctctggctatggccgcgcgccctacccctcacatgacttcggtgccggttcgcctggtagcacctcaagtacagtacttgaagcctactcatacgccccaagcaatgatggaggcagctttggccttgcaagcctagtttcaagcattttctacagcagctcaatcaacccaacaacaatgtaccaagaactttgcctccggtccaagtcgagggaagtccaagtcagggtgctccggccgggcaactgttaggccagttcaccatgccaagtcaggcgaaccagctagctcaaggtgctacgcctcgaagccaactaccacagttcaaccccagcgccacgattcaagcacccatgaccttcatgcatgtcgtgcctcccgggtttggaacagttccaccgccgaaccaagcctggaaccgagccatgatcgacccaactatggcggcgcaagccgcttcgacggttcagcagacccaggcgttggtgttcggcacggggcatcaatcaacacccgcagccaaccccatgtgcaagccgtaacttcgccattcgcacttccataccaacagataagctggtcctcccagtatcgtgcagtgataaagccgtgtggcgaaaagggtttgccactaagctggggaatcaagagtcatcccatttccccacccaattcaagtaccctcccgtcccaagttactcgggagaaacggacccaaaagagttcctttccatctacgaatccgcaattgaatctgctcatggtgatgagaatatcaaggcaaaggtaattcaactcgcgctcgacggcatagccaaatcttggtactttaacttgcttgttaatagcacttgctcatgggagcaattgtgcgatgtctttgtccttaattttcgtggtacctgtgaggagccgaagacccaacaagaccttggcattcaccaaaggccagggaaatcgacgagggattacatgcgccggttctcgcaggcgcgttgccaagtgcaagatataacggaagcatctgtcatcaacgcagctttggccagcttgcttaagggtgaactcacaagaaaaatcgctcgcaaggaaacaaggacgatcgaacacatctttcgcataatcgatggttatgctcgaggtgaagaagataccaagtggcggcaagaaatccaagccaaatacgacaaggcagctgccaccgcaaccgccaccgcacaagctcaagcttaggcccaagctcaagcaagccattagttcgacacctgtgatggttcgcccttcacctccggcgaatcaagggcagcctccaaggctgaaccaagttccgatgacctagaaaaagttcagaatagatcgcgccggaaaggtagtgatggctgtcaaagaagtgcaagccctccgcaaggagttagacgcacagcaagtagtctgccagcaacaaccttttcgcaagaaagtcaagaaagatttgtacaatgcctttcacggttgctcttcacacacaattgagcaatgtccaaatatccgatagcaaggcaacactcaagctccaaggaagcagacagtcagagccgaagaggtgcctcgcgaagctgttcatgtccaagcaccccaggccgaacagcgccaagatgcacaatgaagagtgatccaagtcatcacaagatctgatcgcccttcgtaggcgtcgaaatgctagaaaaagatgcaactccgagcaatgcacaacattgcttcggcaggcgaaggggttccaaggtacttgacgcagtagatatctttcggaccagaggatgccgaagtagttctgttcccacacaaagaccagctggtggtatcggtacaaatgggcggttttgaagtttggcgtatcttgatcgatgggggtagctcagctgatgtcattttcgccagaacgtatgccaagatgggactaccgaccctggcgttgtctcaagtaccaaattcgcttgggtgttcggaggcgaagcagtgcaagttttgggtcaagccctcttgaaagtcgccttcggcacacaagaaaacaagagagaagaagagatactcttcgatgttgttgacatcccgtacaactacaacgccatcttcggccgaggcactttgaataaattcaagggaataccacatgcaccgtcttacacagtccatcattggatgggcgcccacatgtcttaggtcaagacgccgtccatgccttcgaccggaagcaaggcggtcgttcgcccccaggtgggtcccagtgccatcctccggctgacacgggggacatccctgtcattccctcttaattccatggagacttttgtggattcgtgtatggggggcacgctcgactgcgtgccgatgggacggggcatacctgcccccactccgcctgacagggggcgggacgtgggtgcgctgccacccatcccatgcgcctgtgaccggtcatagaccagtcaaacccgattgacgcacgtcaatcgggcggcgcctcacgtccgcccacgccacattaaacgcggtgagggacggttggggcaccgctcatttaaggcgtttggcagtgcctctccctctgcccactcggccgccacgtggtagctaagtgagggccttggggcagtgcgctccaagggcccgaggggtgcaacagggcaccccgaggccctttggccgcttcacgagcgctcgttctcccctgagggggtaggaacaggccatgcagccacgtggccaaatgaaaggattctttccctctatcttgcgtaccaccgggcccatatcaccgacagtagcccctagcactacatctgaccgtaaccctaccagggcggtctggcgcggtgtctcataacttcctgttttgtgatggtgggtcccatggggagtccaaacggccgtcatcggtttgcctagcttgagcacctaccatgatgatgacttgaccgctaataactgcgccacacacggggacgcgtagggcaggaaaaccgaggggtctgctagaccgcgctcggaatcattacttgccatcacctcgactgcctgactatcaggcacgcgaggggacggaactaatggtgggcccgcccaaccgcaaccgtaatcattgcacgtcccacatcgattttgccgctgacaggcgcattaaacacgggacgtggatttagtaggggaagcaggacgagtgggcacgaaaaacgaggaggcgggcgcggccgacgcgagaataaaaagtgagggaggaggagaattcatctacatcctttcgccattctttctctcacactcgcgctcctcagcgccctatcgttgcaacctccgaccaccgcgcttcgcttactcagtttctcgctcatactcaccggccgccatggctcaacacgccgggaatgttgttctcccgtcttcgcacatcacggaagagcgacacttgagcctcatccgcaagatcatgccggacggctccgtcgtgagggcaagggaaccgcagccgcggccgcggtacctggatcggtccgtgcaccttctgtccttcaccatggcagggctgatcccacctttctcccgtttcttctacaaggtgttgatgtaaaaacacgaggcctgggagatctgcttaactccagtgtaggtccaaaagcttgcctttaggtgtgtgagcatgccagctgatttgatcctacaatcaacaagaaataaagacaaagaaaccgcggttaaatccataaatgatagccgatcggctagttgccgatgacgtatcatttatctctgaaccgatgtcatatgtagatcgatcggcaatcatgaataagtaagaaagaactaaatctactcgatcggctatagacatttacaatatataattcttatgtcgatatatacttaaatcaagtgattgggatagatcggtcgccatgccgagacagtataaatcacttagatcgaaatatatattcacaacaagactatatatgttcataacatagccgatcagatagatctagcatgtatcggctaatactctgatactactctatattaagatattaaagcaagttgaatatactaaacaaaagcctaatatacttaaatgcaacaagatcgtaatataaagggcagatttaacatgtcaatcaagcatatagagtacgaagtagttaaattaggtaagatcggctgaaaccctgatactaccgtaatcggcaaccaaaagcaggctaaagattgagattctaatcacgacgtataagatcaaactcaactgatgcagctataagtatgaaaagaaggacaatatctagacaatcaagccgttggatgtttcatacagtggtaaatatcttatataatcaaagtcaacatcagtatttaacctaatcggctgccttctagtgacagatgttagccgattgggggttagataacgatattgccagagactatataggatatatgataactcgacgaatacataaatgagattagagtatcataaagat

SEQ ID NO: 14275 - DNA, 41240 bp, Oryza sativa
cccgagattacaaaatatgtccgtgtcggacacgactcttatctctaactaactctaagacaccataagtcttgcggaagacttttgcccaaacatatctccaaacatatcctaattaatagatacaattgccttctcaggactcaatccgtgcgtggcaatcctcatgaagcacattaactcaacctgacaacgtgtaccgtgtcacattgtcggattcggttcaatcagctaacctagcccgactcgaactatgccgatcttagtcgtaaccgatccttactctgttcccggaatgatttccatctcaaactccgcctcgatagcatcttcatctccgatacttggattaccaaatttggtcgttaaaacatgccccccaagtccggaatatttgataatgtttcggattttccatatctcaactccgagaggatatcgcacttgccatttttccgaccgttaccgcatcgctttaaatactaaccgtcatcccgacaaatttcacaccgttaactccgttttcaccgcttaagccaactttgtcttttctctctccagcgaacccctcggcgcacaaggcgatctcaaagcgatttcctttccggtcaaatcttccgcccacagagatgtcgtactacgccagcccgtcagtcgcaccatcggctgaatacgcggaggtaagtattcatcggctagatcccctcctttcgcaatagattggtttttccttgcctcatcttgttttattcttctctcttcttgttcacatatgtagcacctgtccaatctggttgcaatcccgagtttgtcacacgagcatcattattttcttgggctgatcggcaatctcaaccccactgaattcattattgccgaaaccaataggatccctttcagattagccaacctgaatctaggtcactagaagaacaccttcaagtcttggccttctctcgagaaaaccgctcttgagaaaagtggggctgtgtggtataaacgtgtttcggctagcaagcatgttcattgggatgagctaggaatcagccaagcgcttgctcttactttggcaaatttggataatgacgaacccctgatggcatctgctgcctatttctggtccaatgcctttttgttcaatcaagggccgatgaccccaactctgcatgacatcaccatgattactggattagatgtaacttcatcagccaaccccatgagtttaaacaccaagaaccagtttgacttcaaaaccaagagcataggtggctggtctggttatgtagcagcatacatgggcaaaggacctgttacccctagggagcacacagcttttcttctgatgtggcttgagaaattcctcttctgcggatcaagttgtggccctaccaccaactggcagttcttagccgaagcccttgagacaaagaggcagttccttttggccaaaattcttctcggctatttgtaccaaatgttgaacaacgcatcggctaagattgctgttggctcagttgttagtgcaggcgggccatggtggttgctgcaaacttggataaactttgtagccatgaaagctgtcaatcggccagccgtaacagaagctgaatttccaagattagagccgattacagatggtgatggagaagagcgcacccaccgcaggtgtatgtcctatgaggaatatgcatccacaccagccgatgctggagcaaagttattggctgaattactcaacgattggttctgcagcttttacgaaggcttccagaaagatgctcgggtttggttcccatatgaagatttagtcaatttggatctcccagccgacttcagatttgaagatatcaactccgaaaaatttgacaaatccagagaagtcttctcagctgctattacccatgcatccttcctgtcggcattcatcaaggaagaaacatacaggtttcttatgagttttaccacccgatgagctctgccagacagtttggaatgggacagcgaccaatcggcttgttctttgccgataaaatccaatgccgaggagagatttcatcaaccctgatgatggattggctactcaacatcccaggacctcctttgggcagcattgataacatagagctggcaaagtttaggagcaaaaactttgacagatgctggggagaatggaagcaacacatattccatcaattggcctctatgtatatgacagacctatttcccgatgtagtccctcaggtacatctttactttgtcaattttccttaaatgattgttagccgacttgaatcttgactaatttctctctataccttacagacaacagaatcttctcctccacgcaagagcaacagtggcaaagacatagaatatgctccgggccttttgcgaaatggtggtggattaactcctcctgtcatcggctaccatgcccccaagacctcaagtttgcttcaagggcagatgagagaaccagccgatgttggcaggaagagaaagaccaaggcaccggcaatcgatccatcggctttggctcccatgaagaaggccaagaagcacaaacccaagctagccgatgacttgcccaccttagatccatccattcagcaagctctggatgaagaagaaattgaagaggacgttgatcaggcagcagccgaattgagtgatacaggagaaaaaacaccgtcggcttcgcccaacaaactcctccaactcctgctgtcccggctcacttatcaagggtaaatcactcacattaatttcctcttgcaatcattttattcatagccgattacttatcaatttcccatttgccgaaaaagaagatcgctgaaaagaagaaatcagcagcaacaacgcttaaaccggctccaccagtaagattgtcatatataaatcctttcacttatcctatcacagccgatatttacttaacactttgtctttttgcaacctcctcctccttcaccacctgtgcaacagatgtcaagtgactgtaccccatcgactacaggaagccaccatgttgaagaagaagaacaaccagccgctcctgccatcccggtaagtctttcattgacataagatcttagatcggctaaaactaattgatacctaactatcttcaaatttctctttttgcaggccttagccgatctattttcttttgacatcaaagattactttgatgaagaagcagaagatgaatccaccagcaaggctctagcccctctggatgaaactgtcaagaaaatacttgaagacatatcccttcggctagagtcatcattggataatctggtggcggactgtggttcatttcaggcacggtttgcagaaatccaagcccaaatcccagacgatctggcaaacaccattactccagctatatacctcgagcaacatcaattcaacctgaagaaggctaagcaacggatagccgatcggcgggaccggaaagatatcgaagacactatccaagccaatcggcaactcgtgcacgaagagaaagctaagttagatcagctctctgtcaggccgattcaatcgaacatagatcggcttgaagctcgcaagattgatcttatagctcaacttgaagaatgcaatgccgagttgtatcaagtagggcagaagctagccaatctcccaagtgctattgaagaacagaagtctagattgagatcggctatcaaaaatgtggctgacatgaccaagtccctcaaagtcatctctggaaccgatgccgaagacattcaagctatcaaagaagtagatcaaattagacaagggactgtgtcggctatccagtgttacttgtctggatgattggtcttgtaataggatagctcattttgtaatcggctaagatactcattttgtgactgaattactatgccgattaatattgctcaaaaaatttgcaacttttgtatatatgtgcccccctaattttacaatgacgaaggcattgacaaaattataaattgaactgagggcgatataacaatatcagcaattgtatatcggcaaaacacaaccgattacaataaaaaacaactaagggaaatatatctatatcggcaattgtacatcggcaaaacacaaccgattacaatataaaaacaactaagggcgatataaccatatcggccatctaaaggcgatgtaaacacatcggttgtcatgtattggcaacaccagcccatcatgcattaacctaaacgcttgggtaatatttcttcaaatatttgccatttaacgctcgttcataaacttctccatcaagtccttgcaacatgtaagctcctttagatacgactttatggatttgaaacggtccttcccaattcggtgaccacttgccgagtttgatatctcgagtccctatcggcaaaattaatttccaaacaagttcacctttagaaaaagacttgggcactactttcttgttgtaatgtcgagcaacgcgttccttatccttagtaacttttacaagggctctcaatcttgattgaaccaagtcttccctttcatcggccatgagattataatactcatcggctatcaactcattttgcaactccgttcttcttcagccgattctaacttcccatgttaaacagcctcatgtccataaacaagcttataaggaggaacttgggtcgaactatgacaagccatccgataggaccacaatgcttcggccaatctagtatgccattgccaaggataatcggaaatcttcctcttaattagtataatcaaattcttgttagatgcctcggcttgcccattggcttgtgcataatatggcgaagaattcagcaatttgatacccatgttatcggcaaattgaacaaactcctcagacacaaaaatcgagacttgatcagttgtaatagtttgaggaataccaaatcgataaataatatgctcttgaacaaattatatagcatcccccaaatcaacttttttcaaaggaatcacctctacccacttggtaaagtaatcggttgccaccaatataaacttgtgtcctttactcgatggtggattaatcataccgatcatatcaattccccaacctctaaatggccatggcttaatgataggattcatagccgatgctggtgctcttggaattgctccaaacttctgacaatcttgacatcctttgtaatatttgaaacaatcgtccaacattgtcggctaaaaatatcctgcccgccgaagcaaccacttcatcttatgagccgattgatgagttccacaaattccttcatgtacctcgcctattgcaaccttagcttgatcggcactcaaacatttaagcaacacccaatcaatcgtccgataatatagttcatcatccaataaggtatacttcaaagcctcatagcgtaatttccgagaagccgattgagatggattctgtaaataatgatgcacctcatacctccaattatcggctcttattgcggcaacttctactttgacatcctttatcatcggcctatatccccatgcctcttgggccaaatcattagcttcgacattttgttctcgagatacatgcttcaaagttactagcagaaattcacccatcaattctcggcacttttcattgtaaaccattaatgtatcattcttgcactcatattccccggccaattgactgattaccaacaaagaatcacccataatttcaacagcatcggcttcaacctccttaagcaattgtaaccccttgaggaccgcttcatactcagcctgattattagttgcatagggcttgacagtataagcaaactcaaaacttgccccacgaggagaaattataaccaagccgataccacacccatgagtgcataccgatccatcaaaaaacaaagtccaaggcacaatttcgaccgagccgattgagtcatcacgatgatcaacaataaaatcggctatagcctgccccttaatcgccttcgatgactcatgccgaagatcaaatttcgtcaaagcaaatatccactttccaacccttcctttcagattcagagccgataacatgtacttaaccacatcggctttgcatattacagtgcattcattggacaatagataatgccttaacttcgtgcaggagaaatataagcacaaacacaacttttccacaggagaatactttgtttctacatccaaaagccgacgactcaaatagaacacaactttttctttcccctcaagctcttgaatcaagaccgagccgattgacttctcaccggccgataaatataatctaaaaggtattcctttttgtggagggattaaaactggaggagagctaagacattcttatattatccaaagccttctgctgctctgccccccaagtaaatttttggtcggctttcaatctgaacaatggtgtaaaaggttctaatcttccagacaaattagagataaaccttctaacaaaatttatcttgccgatcatctcctgcaattctgtcttgtcctccggaggttgaatcttttttattgcattaacattcctctgagttatctcaatccccctttcataaacaagaaatcccaaaaactggccagccgatacgccaaaagcacactttgtcggtttcatcttcaggctatacttcctagttctctcaaaaaccttcctcaaatcggctatgcggtcctctatttcctttgacttaacaaccacatcatcaatatagacttcaactagccagccgattagatcatgatatatgtagttcatagcccgttgatatgtagctccaacactttttaggccaaaagtcatcataacccactcaaacaagccgattgcaccaggacatctaaaagctatcttatgaatgtcttcttctgccataaaaatctgattataaccagcattaccgtccataaaacttaatatcttgtgccctgaagcagcatcaaccaattgattggcaaccggcattggatgctcatccttttgtgtagccttgtttaagtctcggaaatcaatgcacaccctgactttgctgtttttcttgataactggaactatgttgaaaacccactcagcatatcggcaaggccgaataaaaccagcatcatagaaacgtttaacctcagccttaacgtagaggtgtcgaaacgtcttgagagctcatcgaccaatcccctttggcaagtcttgggaagtcaacaatgtgatcgcagctatgttgctccaaaaggcccaaagcgaaggtggccgacacccgagcgtagcaatcgccataagcgacggcagtctcagccatggcgctgcccgcctgttgggtccactccatgaaggcaaggacggaggcgtccccggtaggaacttcactaaccttggcccccaaatcagttagcgccaaccggagggtatggcaggcggtcttcgcctcgtcggtaacatccttagtggcggtcctctctgactccaattcctggcgaggagccttcatcttgctctcggaatcattatagtagtccacaaggccctgagtttcccttttttttcctcttgagctcaagcctaagtcttttgatcttggcgttcgcatcctttagtgaactcacaagcgcctccttttcaaggtcttttcggcccagctctccctccaacgaacgaagctgggacttgtagctatccaggtagaccctcgccatctactctattgagcattgagccgaaagagcctgcttaaacaaccaagtagtttgataaatgggaccacgtataacaaaaaggaaacagagcaatcaacgttcgtacccgaacgagcaggcttttgccgcagtgcatccttcatcaaactcgttcagctccgtaaaaggaacgaggccgcccaccggcgaaataaggtgcaacacccccttcacaaaaggaacaagctccgcccgggtctcgaagttagacgagacaaagcggggggcggacagcgagttgtccgaacccaaggtctcagtcgctgcctgttttccccatgggggttcaagtggcgaaaggcgggggccgggaagagggggttcgaatgccacaaaggccgcttccacgacgccttcggcagaagcagaagcacctgcccggagctcccacccacctcaccggcagaaccagctgcggtggcggcggccggcagactcgggcttcacccggctggcgaagtgggggtgtcctgtgatgagtcactgtctctaaacgcgttgccaacttagacaaccaccctcgtagccctcttcgcacccgctccgacatttaacggagcaatccccgcaattgcggccaaagccttcgcccactccagctccttctgcgaagaggggacgagctcgaagctgcccccgcctcgacgtgctcatggcctgggtcgtgtctgggggagaacagatattcacccgtctcatccacggcatcctcctccccctcttcttcgccttcggcctcctcctcgtcagcatcagagtcagcaaaggatgccggtctgtgtttccgcggtgcagctttccctcttgcccgcttgcccttcctagatggttcggcatcatctgcgtcgatgacgacgaccttgatagggtttgcacggctcggcagctcgccagaaaaaatacggtttgccgcctgtctgacgggtgagcagctggctaaacttgtttatgatgagctcctcgatcattatttgggcctcgatttcagcctgaggcagtgaaagcactgtcgaagtaagggaaaaggaatgagcatagtacaaggtggaagcataggcaaaagcaacaacatcaaaaaataacgatatcacgagttaaatagaaaactcacagttcaccccctcagggagcaccagcctcggcaagccatccgcctcctcctccttgtcaacttcgacttgccatgtccatgaaaggggaagaatctaaagcatacaaaactcttccaccaagacacgacagctaagccaaagagcagtcttccgaagtggggcgaagtgagcctccattgcactgtcgatcgccactttgggcttccgaatacgcacgatggccctacgctgccacttcatggccttggctgcatccgatgcggcctcaaaaggaatgctgttgtaaaaccttttcggcatccaatggcgatcccacttaggcatcgatgcattcacgggccacaaatcggagagctcagggcggaaattaaagtttgtgctcccgaagaccgtcctccaggtgccggccagggtgaccaccgtcttcgagttgacaataacataaaagatcgccccaaaaagctcagcggtcggctcgaaacccgcggttcgacatgcccagtcgaagatggcgacccgaaccagagcgcacgggctaagttggggcaattcgatctcgaagagccgaagtatctcaagcagcaagatgttgcacagaaatcgaagccccgcatcgaaaatgcagcaaagaccacggtttggttgtccccaagcttcaccaccaccttgccaggagcgaaggcttgtccttcggccacgaccctagccaaaaccagcttcgtcaactccgtctcattgataagtgaagcgccgagatatccggtgtgatctctgccaatcttccccagatcaggaccaatggccaaagcaagagcaggtttatgaggggccatgggcgaaaagtccggaaagcccgatgtaagagccaaggtcacgctggccgaagtaggtgacaaaagcccgtgaacgcaaggagaaacaaagcgataccagccacagaggagatggaaaaagtgactagaggtaaaagtgaaagtgacgccgggagggaagtatatatataacccacccgtgcgacggttcgcctaccacccagtaagggactgccacgttaaggcaggccgaacagtgaaaggccgaaagtaacggcagaccggctcatctagcccattactgttcacgagaatcccaacatattcaaccatttcaccaataataagcgaggaaaggaaagaacattgatcaccagatctgctaatgcaaaacgccagactttttcgcaagtacaaaatataggtttcggcaggaacatcggccggaaggaggcgcctcatggtataccacacgatttgcacagcctcggccgaagctccctactcacccttgccgtgaggggcttgttggaggtataccacgaggaccttcgaccaggcctaccaaaaccgaggagataggcaaaggcatgggacggaggcaagcggcgaaggtcgaagggacaacataggcgaaagccgcagcatcaatttgacaagcttcgccaaagatggaccctgttggaggggcgaatggttgaaggccgcgaggcgagagccttgccacaaagggcatgggtttcgccaattattgaacattgccaggagaaggcccagcgggccgacacgccttccagaggcttcgccagggacaaggccatgtcacttggcccattaggaacccatacgagcaaaagacactgtatacccataaagatgtccctattaaaagggcaaccatgtaaatttccctgtaaagcctaaaccgccatgtaacagggggatttgaaaaaaatttactaagcaatacaattgtctttacttccaaccactgttaaaagaaccacgtccttcgacgtgacgcagttgttgattcgacaacaatatgtatactagaagtataggaatatattcttttctattttcttcccacttagcttagataacttaataggagaatgagaggtcttatgcttatgtgccatgctaccctttgaattatattaacccctgcttagactatgattattacaagtaacatatgaattattagtaaggttctgtctactataatcttcccacgggattaaataaatacgatacccttggaatactctcgggtgaaatgctacaatggtatatccatgcgcttgtggatgaactctataaccataatataccaggagtatttctgcgccattgctgggaattatatttctagtaatgtcgttaagaaataccaacaagcatttctggtgctgttgccggggaagatttatagaagagattaccaatactaatactttctatttacctctgtataatcactgtcctttgtaggctaaccttggttgttatcacttttgttgtggaaacagggtagtgcatgactggtttcaacttgccgaaaaacttttaaggaaaatccagaagctttctttcggagcgtcaagccgagagtcgtcgctccacaaaaaactctcccgataaagaaaccagccataacaatgccactaaccttcaagactatggctgacaagaccctccgtgaattcgttgctccctctgctgacaacgtggccattggctcgcaaatcaacatgggagacgtggattttgatctgaagtctagccttatcacaatggcgcaggctagcccgtactgcggcaagcctaacgaggatgccaatgcttacctgcaacaattcctggagatctacaacacgtacactatgaaggaagtcagtcctgacgccatcaggctacggctgtttccagtttccctcctttggaacgcgaagcagtggttttatgccaactgtgctacaatcaacacctgtgacaaatgctctacggcattcttattaatgttcttcccgaggggcaaatccaacgcccttcgtggaagaatttcaagcttccagcagacgacggacgagtccattcctaaggcatgggaacgacttcaggaatatgtggccgcctgtcctcatcatggaatggacgactggcttatcctgcaaaatttttatattggattcactcccatgtctcgcgaccacctgaacatggtagctggaggagcatttttctctaagacggttcgagaagccatcgatttaatagagaaaatggtctccaatatgggttggagcgaggaacgactccagacccgtcagcgaggagtgcacaccatcaaggagatggagattcttgctgcaagctggacttcctcatgaaacgcttggacgaccatgacaagaggccacaaggcaccgtcaaggccttggactcacacgtcacgtgtgaggtccggggcagcacgggtcaccctaggaatgactgcccggagacccatgaagaggcgatgtacatgggcaacaacaataatgggtatcgtccacaaggaggtcaggggtggaaccagccatgcccatattaccaaggaggtaacaacaacggtaacttttctaaccagccctccttcgaagatctcgtctttgcgcaagctaaaacaacatatgctcttagcaaaaagctagctgctaatgacaaggacttagagaatataaatgttaagctagatggctttgcttctgcattccaaaatcagctgagctttaataagatgattgaaacttagctggcacaattagctgtgttagtacctgcaaatgagtctgcgaggattccggggcagcccgaatcttccgtagaaatgttaaggtgatcataacgaggggaggtaagtctactcgtgatccgccatatcctaaccttacaaggactagcagtatcaccagagaagcaccatccggtaatacgactgacgaagaggttcagcaagagaagactatgccgcaggagtactacgacacccggttgctgccgtttcctgaaagaagcaggaaaccgtcagtggacgagcagttcactcattttgttgaagtaattcagaagatccatatcaacgtgccattgttggatgctatgcaagtgccaacatacgcgtgttatctcgaggatatcctcaataacaaaaggtcgcttccgacaactaaggtggtcaagctgatggagcagtgcagcaatgccatactccagaagctcctagaaaagaaggatccgggtgtcccacgatcacctgctcaatcgggacacagcaattcgaccaagccctctgtgacttaggagcaagcgtgagcatcgtgcctaaagacgtcttcgataagctcaacttcacgatattggaaccaacaccagcctgtagttggctgattcgtcggtccattacacatctaggatagcggaggatgttccggtcaagatacgggatttcttcatcccggtggacttcgtggtgctggacatggacactaaaaaggaaacgccgctcattctggggcgtccattccttagcaccacagaagccaacattgacgtgggaacggatagcatccgtttccatatcaacgagaaagaagagaaatttgagttctagccgagaaccgaacaatgctccatggtccggattaagtacgggcaaacccgcagaatattcaagtggtcgaagtggagccacccaagatgaatattctggtaaaatttatgcagaatatctaggaaaaggaaacaacgattcccaggaaccgttattggaagacgctagtaaaactcaatacaccggctaagaagctagagaagccggctcagaagaagccgtctcccgcacgaaaactaaagaaggtgtggaagcaagagccaaagacacccgctccaccactcggcagacgggcagaaaatccgcgatctgaactgaagggaggtacggtcttgcacgttggacccaaaattacgcgatattcgccaaaaggtaaattggtatgtatccgcatatttattttcaacaatttgaacttttgcatcaatgcatgtttgaatttcaaatttttgcatttaagattgatttttgaggaaattctttcaaatgatttttcaaacaaaaataaaattttcaatgaaaatttattgtgccacgaccacactgaccattggaacccaacggccaaaagtggggccggttaggcccactaggggttcggccgaaaccctggttcggccaaaccggttaggccaagaaagaaacctttctaaagataaaaaggaaacataaagtccttatgggacactaaacacaccttcctaaagataaaaggaaacaaaaagactcttcgtaactaatagataaactgtcatgttgcatcctccttgaactcagtcacttctggataaacttcctttagtagattaatttccttaaccaaatacagcaataatctgactattggcgacttgataattcccatcggccgattccaggactatgaagccgataatgattttaggccgatgacgtcttcggggcttgccaaatttcactgttaattgataggtaggtaagggatattgaaggaataaatttttttgatttatgacctgatagtggattagaatgtagaagttgatttattttaggacaaaatttgaattccagaagcagatttattttgggatggagggagtagattactgtagcagattaatcctgtagcaaatgctagcaaacggtatactctgggccggtttggcacagctctagctcccaactccaacttatatagagccggagctgtgccaaacggtccagatcctaagttttctagagtggagtttgtagagttgctcctaaaaaatgaactaagggggtggagctgggtttttctgctccacagctccactcaaccccaaaggacccactaccctttaattatttgacatatttacgtgaaactgccactaacctacccccacctcctcacctccctcccgtaactctccaagtcccacccatcgagcgaggcggcagcggcgggcgaataggcggcagtggcgggccaaccgtagcgcgcggccgagcaacaaggcgacgagggcgcttcggcggtggcttggcgcgggcgggcagaaggccgcagcgctctggcggctgctcggcgacgcgtaggcgggcagcaagccgcggtgctccggcggcggcttgacagccgggtagcagggcgacggcggtgctctggcggcggctcggccaaggaagagcgctgtaaggatggcagcggcggcggccaaggaggcgacgggggtggaggcgtgcatcagctcgagaaggagcgccgcaagatcaagatgttcaggcgggcagcaggtcgcggctctccggcggcggctcagcggacgcgaccagctggccgacggcggcgcacggccggcggctagggctgtgaggagctaatcccctctaccattttttcattttttttccaatttgaaatctagaccaaaagaacaataggtgattttgcatgtatgtcatgggtgattcttgttttataagaactatgtagaagtgaaaaattatgtgtttatacaaattgaagtgagaacaaaatggtagactatacaaatttcagatctaaaccaagaaaacacttggtgctttcactaattatgtcaattattttgtggattaatttttaaccttgcattttgttgctgaaattgtaaagaaaaataaacagttatcagtcatacatcacaaaaacagaaaaaaccacaagggtacttttgttaacctccctcatatcctctgtttctagagttctggagcagaccaagcttgccaaacacttttcacataacctccagctccttggagtttggagtcctaccaaacagggcctacgtatatcctgatcgttggatcctttgatctaacggcactgaaggtctaaaactgctaagcttgcagtccctattcaaacagcatgggatcccacattcaagcatgaaaagttcgaagagcatggatttacccggccacgcagtcaagcgaacaaagaaaaagctgttccgtgcttccatgctgccagcctgccactggccaccgctatgcccggtgtcagaggaaatggctcacgcggcaatggtcctggcctatgaggttggcggcgaaggaggtacgcctctgctcagtagcggctctgccttctcgcggaggggacattgtggccccgcgcacggcagcaacacgcgcggctactaccagcgtctggcggcaacgccggtgtcgaggagtgatcctctcaagcgggaggtcgcgaggccctttgtgagttcggccgggagataaggcgcgataatcaagagcgtatctccgctatggatctagcttaccaggtcgtttgcaagagaatgagagacaagggattatatatgttcgagccgctaggaagcgtatcaccctactcctgtgcgtggtattaggcttgtgctgttacaagggagttctaaccctaggctcaagcttctcaagtggcgtcctttctttaagtggacaaggtcatccttttatagtttaaggggataccacatgcaccgtcttacatagtccatcattggatggggcccacatgtcctgggtcaagccgtcgtccttgccttcgaccgaaagcaaggcggtcgttcgcccccaggtgggtcccaacgccgtcctccggctgacacgggagacatccttatcattccctcttaattccatggagacttttctggattcgtgtacgagggacacgctcggctacgtgccgatgggacaggcatacctacccccactctgcctgacagggggcaggacgtgggtgcgctgccacccatctgcctatgaccggtcacagaccaatcaagcccgattgacgcacgtcaatcgggcggcgcctcacgcccgcccacgtcacattaaacgcgacgagggacggttggggcaccgctcatttaagacgtttggcagcgcctctccctccgcccactcagccaccacgtggaagccgagtgagggcctcggggcagcatgctccaagggcccgaggggtgcgacagggcaccccgaggccccttggccgcttcacgagcgctcgttctccccgggggaggcggggggacaggccgcgcggccacgtggccggatcgaaggattctttccctctatcttgtgtaccgcggggcccatatcaccaacaaccgggtacaggcaaaagacatcagccatcaggttgggagcgcgtcaggcggcgtatccctgatgcgagcgaagacggagacagaccatgggcgtatcgttggcgtatctcacgtcatgcacatgtgtttttccttccatcccgaaccaatgcagtatgccgatgtcagttatattttattttgtttttttacaatcgtgaatatgtgggatacgtatcagtatccgtggccgtatctgatacgggacgcgactttatagccatatcagcgatcatcccagtccacctatagcgaggaattagttttttaaacggaaaactctgataggccacacccctttcctttcaagtattcagcattggtattaattgcttttgagcttgacaatactacttagtatagcaattaaatgtgcacgttacaaatcaaaagtgagtagggaaaagaagcccttgcaaatacacggccgaaagcagaagtataacttggaagatatgattatggctgagtttagttctcaactttttcttcaaactctaacttttctatcacatcaaaacttttctacacacataaacttttaattttttcttcaaacttccaattttagtcaaacttccaattttgaggtgaaactaaacacagcctttatcactgaagtagtcctaacacccaggataataatcgcacaatcacactgtcacatcaatgacagaaaaaggtgctatcagcacagtgccggaatatcggtgcgtttagttcacgccaaaattaaaagtttagctgaaattggaatgatgtgatgaaaaattataagtttatgtgtgtagaaaaattttgatgtgatgaaaaaattaaaagtttgaagaaaaaatttaaaactaaactcggcctatataaacacatatttgtagtagtactagcaagacatggatcaacagaaagctttcttcctttctttcttttcaccacgggcggcacaagtcccctgagctgagactacagcgttccattacatcaacctttttccactgctactcatcagtgtcgagtgtccaccaaggcaccaacccatataaccacatttcaccgagctgcctccgtaatttcatgggacaccaaccaagcagaggctacaaaaaaaaaacacatcggaaaaagatcaaaaggggagagagagagagagagagaggcagcactcgagtggtctttggcacgaggaaatgacgctgccggacacatcatgtccatgtccatctcattttactactactcctaaaacgcacagagagacaccaaccaaacactagtgctgctgagacaggtgagggagatagatgaatgggaaagtttgggccgtgcgaccgtggtgacagcatgcatcgatcacgatggggtccgtccatgggtttctgcttcactttacaacgacacgcaaaacaaggcaggtttggtatgtgtgatcgatcgatctatctggtgagatccctaggcaacgcagctgagtcccaggcaccccatccacaggctcctggtcaccctcttctgaaaccacatgaaacgaagaaaagcacaagcatcagtgaactactcttcattaagtataattgcacaagcatccgtgttgggttgtccataaaaaaactttttttactgaacatgatttttttttcagcataatgatagtactaattttttttcccaaaaacatcacatcaaatctttaaatacagatatgaaatattaaatatagataaataaaaaaactaattacacagttaaggaggaaaatgagagatgaatctattgagcctaattagtccataattagctataagtactacagtaacccacgtgtaccaatgacggattaattagattcaaaagattcgtctcacggttcccatgtaagttatgaaattatttttttttattcgtgttcaaaaagcccttccgacatccgatcaaacatccaatgtgacacataaaaatttttttttcgcgaactaaataggcccaaaaaaattaggaataacaaaatcagcactgtgaaatggatagactactagtagaaaagattcatgtaatggtatcacacgagtcagcgaggttgtggtttgagacaagcacaaatgtcagtgcaggctcgcaaatggagtggtgctggtgcaacgcgacccctacggagtactactaaccaccatcgagagagagatcaagagatacggagtactaggtgcgttacccttggcttgttgcagagcatgtcgggtgggatctcgtagaggtcccggtccacggccttgaccaccgccggcctgcaccccttgtagcccatcgccgcatgggccccgccgtcagccactctgctctgcttcccctgcttcctcgccgccccgtgctctcctcctgccaccgccagccccaccaccaccttgtgctgcctctgcctctgcttctcgtccaccacctcctcctccccaagtgcgccgctgtcaatccacttcaccgcctggtaaaaaaagagatcaacagcgacaaccgtccaatcatctgtttaccgcgtgagtttgaccgtaagaaaaactgtcaggttgcaacatgcaaacgccatgtatcgtgctttttgaaaaacttctttaccctgtcagagatccatgatagccattaaatgaaactaagcacgatttttgtccaaatcttgttttttataaaaaaaaaaacatgatgtatatccgcctcagaacaacacttacgtttaccttctttgcaagtgttgccaatgaacgatgatgcggagacaagtttataccttcttgggtggttttggtgagggcggcagggagatgaccaggccgcgggcctgcatggcggagtcgaagtactgtgtgaccggccagtcgccgtcgcggtagccgtagccatagcagccgccgccaccgccaaggtcgccgtcgccgtcgtagttccactccccgaacgccgggatgcgccgccgcctcaccctctcctgcacgtacgcacgcgtgcacatccacagcatcaatccattatcatgaagaaaaaacggaacaagaaactattagtagaacaagacgacgacaacgcagcatgcgtcctgtggagtagaatagctagctcgctcgctggcttaccttcatgactgccgctacagggttcactcaccctcacggcctcacactggatgagtcaggcggtgttgatgagcacttggacacatctgtgtgtaaggtaggggaatttatagtgtaaaggaaggcagctactactacgagctggggaatggagactggagcggaagatggagcgaggaatgttttgtgctgtgatatgtccaagtgtccatggtggtcagtagcgttggttacagacttgcacaggaacagagcagatggtggactggttgggggcccactgggaagcagtaggagtgtgggggcccacgggaggtactgtagcatctggtaggagtagaagtcaacagaaacagcgtgattggtgctgactgctcgcccaaattctaagtacgtgactattaatttattgagggcggataccgttgcaacggaatattttaagtgactctctctttttctttcctctgtgctcccctagtacctggtacataatacctggtaccttaggtatcggttggaacctataccaactaggtatcgaccgataactgatgcccggtgcccaagataccgggtggtacctaggtatcagaccttggtaccaaggtatcaagcatgatacttgtggggtatcagagggtaacgatgagggagacgtgggagagggagcgccgcaacggcggaggatggcgtcgaggaggcacggcgaggtgagggacatgtgctcccctagtacctggtaccttaggtaccggttggtacctggtacctggtacctttggtaccaactaggtatcgaccgatacctgatgcccggtgcctaaggtaccgggtgatatctaggtatcagaccttggtaccaaggtatcaagcatgatacttgtgaggtatcggagggtactgtcaaaaggaggaggagacgtgggagagggagggccacaacggcggaggatggcgtctaggaggcacagcgaggtgaggagcgaggcctgagccatagagcgcgagaagtctcgaggaggagccgaggaggagtttgatggccatacctgttgcaggtcgacgcgggctggcggcgtccataccgaaggcgcaaaagcgacaggccgcagcagggacgacggtgactccgaggccgagggcaaggacgaggggagctcccgcttctgccctcctcggggcgacaactccccggcacacacccgaccgacgagggcggcgagctagatcggcgcagcgaggggaggcgagctcgagggtgaccctgccgagggttggccgacctcgccgacgcagtgccgtcgtcgtcctcctcggccgccggagacgaccccttcctcccggccggcttcgtctccgctcggccttctttagagagagagagagaaaggggagagggagagagagggctgcagtgctgtgtgatttgggagaggagagttaggtaggaggacaggattcggatgattttggggagaggagtgaggtaggaggaggggatcccgtctccacgggatgccgtagtgtaggttttctgtaatttatttcatattatatataatctaacaactataaaattaaaattagtatcacacataaatgtatttttaaatataagtcaaatgatataatatgtataatagttaatactactgtaattatttaagtcaaattagaaaggtagcccacacgataccatgggctttttttccattaatgttagaatcttttatgatgactaatatcttttatctatacataaagtttctgtaaaatatcaatgtatatagcagtccccccatcatgcagtcattggtccttcaaagcttgcttacacgtaaagaatttgacgcctttgattgcatgtatatacattgagcaataaaactatagctgagatctacagataatattgaactaattattctatgaattttgagatatacctctattttcctgaatttctattttccttaatgactcgtgagctttttctcatgatatatagtgattccaaattggtcatccacaatttttattgtaattattgttaaatttacttaaatgtggtgacattgattaatatgaaatttagacattgatgtggtagaattttcatacttatgtcatgttcttttctccaacaagagttggatgaagattaagaattttgttgcacacttttcaaactgctaaatggtacgtttcgtgtgaaaactttttacataaaagttgctccaaaatatcatattaatctatttttcaagtttgtaataattaacactcaatcaattatacgttaataccacctcattttacgtaaaaaaaatttacgttcatcttcacgagagaagaacaccaccttacaggccggtgacccttgattcaactccctagcttgtctgaagcctacaggatggtgtagttgaggcccatatatgccataggttgttataattagtggttttgtacatggataaaagtctgtttataaatcagtcttgacgctttaaatataatacctatatttaatcatttttatatgaagtgaggatagaagtgtaagtggagtatgcatatgaacgctcaatcaacatatagagttcatgttaatgtagattttagagctagagtgttaaatggtttggccggcaggattttacacggtgttggtcaaatttccctaatccaatgatacttcgtaatattaatcattatagtataaatttacgacgtggtaataaatcttggtgccttattaaggtttctgttagtccttctccaaacatgacatggaaaaatcaatataatatgttttcaccaaatactactgtagtaaaacatcattaagtgcaactcatcatgagatagttctattaaaaaaaccacaataaaaggaccttgatataattaatgcacacatctcttgcaaaatggtcaatactctactaaccgtttgaatttatgttaaaatatacttaagagtaattaacttggctctcgagtcataaatttagttgtaataatttaaattagcagtattatttttgggttttctattttgttcctctaactaatacagaaacaaggtgattatcatttttgtcagggctcatgaaagtcaagagtacttttttagatatgggttcttgtattgttaatgatggggaacaaattagattttgggaagataaatagctaggcaacttggccttgaaggataaatatccatatttatatgctattgtccgaaggagatcgtcttctattgccactgtcatgggttctgttccgcttaatgttgctttcagaagagctttagttggtcaaaatcttgtatattggcatgagttgtgtgcttctattgtgcatatccagttgaatcgttcttctgattgttttagatggaactaccataagaacggtaggttctcggtaagatcaacgtacctagctttaattaataatggctatgttgagagaaataagtgtatttggaagcttaagatgccacttaagattaagatctttatgtggtacttgcttaaaggggttgtgttaactaaggacaatttggcgagacggaattggaacggcagcttgaggtgttgcttttgtatgaataatgagtctattcaacatctctttatggattgtcattatgcaaaattcatatggagagcagtttagttttcttttggttttaaccttccaattagtatatctcatatttttgataggtggcttttgggggttgacaagaaaaagagtaaactgatacttgtcagagcttcggccatttgttgggctctatggttgagtagaaatgatatggtttttgataaatcaccatctattttctatatgcaggtaattttcagggcaactcattggctccggttttgggcacaattacaaaggtgtgatgaagatggagagtttttgaaagttgcatgtcgcaagttggagacaatggttatgcaactttatgcaaactatggatagagattcacaaataagctagaataaatgtgttctccttattttggcttttcctatttaaatgtgttctattttatttgaactatactattatctcgagtgctactttgtaataattagttgtagcttttcttgagcaaaggccgaaatattatattccactattgaaaaaaaactaatacagaaacaagaaacaatagaaggggaacactggccgcagaacaggaaggagggcgtacatacgttcatacgtaggtgtataggacaggagattcagttttagtaatttaaaatttatttattgttgtaaataccaatgattttttatgttaataaggtggtgtttggatggaagggacttagggactgaaacttttgcgagagggactaaaataagttcctcctatcccaaatagcccctaatatagcattgaaatagaatacgaaaggaatagaaagggtgagctacacgcaccgaacgtggttttcacgtaagcacgtacctaggcacatgaacttttcttaaaaaacatatctaatatatgccctataatgtcgggttcattgcaaatgtaaatctacttaactatgggtccatcaatttattaaaaggtcatgtgacggcttagaagggtttatagaagtgccatatggtaggatgagaatctaggaagtttaatggatttttagtagagtttaatttttctataaataagaacacattataagagagagagagaggaagtatgtcttagagcctgtttggatagtttatagctgctgtgacttctcgcagaatcaaaagctcttccaaagagttcattttttattcagattctaagaacttatagttatatagaataaaaaaatgaactagaagaccaaagctagaaaagattctcataaactcgttaccagcatgctgcttttcggaataaaactcccaaacatgcccttgctacgagctgacttcagctcgccattactacgagctgactgcagctggccataacgtgcaggggcgcggctggcaggccattcacagtgcaccctgctggcattcagcccgagcggtccacgtagttgagcagccaaaaatcgccgccacgtcctagtgttggcccacaaatcgtgagcgcatgtgaccaaatttggtcacccgttcttcaatgctatcgaggtggggcggcgtggagaaacgagggcacgacgcattgctgaggcgtgtcttcgccgcgcggttcctcccggcgcgcttcatccccaaatcgccctctctgcgcgcgtgtttcttctcctcccgcgctctcctgaatcaagcacaagacatgaacagctgcattagtcattgaccgattgacatactgcactgcacgactgttcatctattagaaaatcaacatctaactactgaaatttcataatcgcaaagaccaaaaaaaactaaaccaattcaaatcatgaacccagatgagaacctggaacaggttagcacacactgaactgattgatggcttcaacaccttaagcgtattcatgaacacaagaccaatctagaatagatgctttagtactaatcaataaaaaagacatcgagaacaaacaacaaatcaccctcgaaagaacttgccttcctcaacagaaaaccgatctaaaaaattctatctgaaagagcagtccaagaagaaagaaaaaacaggagatcagtctctgcagcaaagcaacccaagaaactaacctcaagatcgcggctcgtcgcgccgacgacagggagggaaggggcgctggcgacagggatggggatgggagagagggcgccgacgatggggagggaggggcgccggcgatggggatggggatgggacgttgtgaggggagaagaaacggcagcttcaggcttatctgattggggagaaatctatacgtattatctgactttcgagatacaaagtgtaaaatttggatttctttgttaatagaaagatagcaagggactgaaatagaaaatgcgaggggctgaaacgaaaaaaccaaagctacgcatgaagacccttgcactgtgggagagaaattttttttagcgtgcgtagggaggggaacgtgtagcagtgaggcgtgcactgtttcctgtatccattgcactgtgccgtcgtcgtgcaggcggatcacaagtacgggcaggccgcaggccagacttcaatgatcctttgacaagaggataggggtttcgtagcatgtccgttcgaccccgaaggatacatggggtctctcaatgtctcttgctcatccatttttcgttatcgttgttgctgaccattgtgggtactgatagcattgagcagtgctagccctgttcttttcttttcttataaagggggtgtttagttccacacaaaaaaattacaccctatcacattgaacatttgaacacctgcatgtaatattaaatgtagactaaaaaataactaattacacagattacgaccaaatttgcgagacgaatcttttgagcctaattgctccatgatttgacaatgtggtgctacattaaacatttgttaataacggattaattaggcttaataaattcgtctcgcagtttatatgcggattctgtaattttttttgttattagactacgtttaatacttccaatgtgtttccgtatatctgatgtgacacggcaaaaatttttattcctagatctaaacacagccaaagaaacgtattttattttgatttttttagcatatttttgaacggtgtattttatgcgaaaactttttaacaaaatattagataaattatttcttttttatgtataaaataattaaaaattaatcaatatgttaatagtgttctcgttttatgtatataatcttcatccatcagttgactgaacagggcagatgcgttcgtttcatgctgttaccaacccctctccctcatttttcacgcgcacgtttttcaaactgctaaacggtgccttttttaaaaaaaaatttcgatacaaagttgcttaaaaatcaaattaatcctttttccgtgcgcagtttgatacaaaactaatacttagttgatcacgcgctaatggactgcttgatcaaagggtttaaatttatttctactaccacctcacttaacggtagtagaatcgtggaggggtattattgttcaggaaaaattatttgtggaagggtatagttgtcatttacactcactaatcctagtagcccatgcgccgctgccgcgtggaacggatcggagagatgctcatgcgtgcaaaattggcacagatgggttgccggggatgggtggacgagaagaaaggggcacggtggaggccccgctcgaatcctctgtgaagagagaataaaattttgaatatttgtggcacgctttttaaactgctaaaaaaatgtttcgtgtgaaaactttctatatgaaagttactctaaaatataaaattaatctattttttttagtttgtaataattataacttaattaatcacatgttattaccaccttattttatatgaaacacttaattttcatcttcatatttataagattcaaacgccaccggagtgcgtcatcgccggcaggatcaacacgcgccgccgggcggaggacttgccactcgccgccgccataacttgcgatccaatttaatttctggatggaatcgatctggacgatgtgccgagctagccacaggctcacagccaactagcaagtcaaggtgcatgggcttgatgccatcgacctgccgatccatgaggtggaaaaatggaaaatggctaagttacccttattatattaataaattactaatttatctttaataatgaacggtacaaatcttttctacttgtagtataatacagagagcaccggagcatcgcccaatttacttatggcgaatggtcagctaaacagtactatagctgcgttcggagatcttgtataggaactctttctctccgtaaaaaaaatagagcggtccattaacacgtgattaattaagtattagttaatttttttcgaaaatagattaatttgatttttttaaacaacttttgtatagaaaatttttacaaaaaatacaccgcagttcaaaaagtatgcgcggaaaacgacaaagaatggttaggaaccctgagcagcaaacacagcctatattagcatccctacaagtagataccgtcctgttactctctctatcccacaataaagtcaacttttatatacggatcagaacataggcaggcttagggcttgtttaggtagcaaaattttttgcctctgcatgtcacatcgtcggatatacaaacacatatttaaagtactaaacatagtctaataacaaaacaaattacatattccaccaagaaactgtgagacaaatttattaagcataattaatccctcattagcgaatgtttactgcagcaccacattgtcaaattatggcacaattaagcttaaaagattcgtctcgcaatttcctagcgaactgtgtaattgatttttgttttagtctacatttaatactctaattgtacaggagtttcattttaaaatgaaaattaaatcaggtctggtgtcaaaaataaaaattaaatcaagcatgttctataaaagtttatgctcacagctagcaatcaaattaatgattatgcaagcaattggcaggcgttatattgatttaaagattcaatgcctatgtttctgatcctttaatagcaatatgggatgaaaaaaatttctgtagtatggtctatagcacaatagcttagccaagaacacaaatgcaaaagacattcttgcaatcctaatgaccaaaaataacggcaaggtctacacaaaatcctgaccaatatggaacttgcacttaatatcatcatagcaggccaaccggcctaatatatattgatctgcggaagcttgtatacccgttcccataagcagccgactagtggtagacccctaatgaatcaagtcctagaagaagtagtcgaaacccgaatcactaaacataatttaaacctactacctgcaaaacaagatcataaacaattggcaagagtcagtacattaatcaaattaatgtactgacaactacaaaacaagcctaacatactacatgtaaggccataattcaaaggaaggctttctttagctcaaattttagcataaagacaaattttagttcacaatcatttgtaaagagagttgacaattcaattgacaaaacacgaacatagatatatcataatatttatcatatatcatattataatcattcttgatacctaaaccggcatcaagtctcacattattcatctatgtaccataatcaatacaattctacactagttaccattttccaacctatatttcacaatcacaatttgaaaacataaatcataaaactatacccataccactcactatgtcgctcatgaccatgagcattgctaatcgattaggtttagactctgcagagtttgtatagctttacccacatgatatgaatcgctctagtttgtccggtacccgtcggtaccaccactctctacacattgagtgtggtctagaggacacaacgagcttttacattaagaagtacctaaccttgcatgagcacgataagtgtgaatccaccctaggcttaagtcctagagccgttaggtggagggcccacgccttaacctaatgctgtggcggcgaacacatccgttcccccacgaggcatgctatcattgtattggacggacttagacgcccatgctgtgaggtggaacatctgtcccccatagaacacatacatagggaactagtcatcctacaaacaaacacacacacataggtagttcctaaagatagctccacaaaccgtgaccgccatctttactagaacagcctcccgagtacaaggttagagacatacttaacttaataggccaaggttaccccataataactcatatcgatgcacggtaaacattagagggtgacacgaagttcgttccttaatcgacccgggcgaacactccccctattggtgtgcaactaccaccatatgcacaccacttgtcgcccaagcctaaaataagtttaacttcatttttagttcagaaataatcataattttcatatctgtacagcagcaaaataatacccaaaatttcatttataaagtgaccataaatattatttgcataattctaagcatggctaagcacatagtagcatattaagcatttgtagccccaaatgaacacaagtgttgtactctaaccattcctaagtatacaaatggagaggtgtacaataattcaagggagtttatgcagcaagttagggataactaccatatcccaagttttcaaatattggtttaataaaatataaatgcaactttgcaaacaacacatttcatctcccaaaacatgggtttcaatgtgatcaaacgaagggggaggaaaaacttgccttgatcttgtgcaacttggacaattcctaagtcactcctttaacgtgaatgcaaattatctagacaaataacacgacatgcaaataaataccaaattatgcgaaaaatacaaaattctctaaaatgaatgttttgtgcgcagtgggaaggttctgtccttatatgaatttaggtaaaagaatttctattttatctcatgtactctggcagataggaattttacaagtcctaggctacaattatgtcatttaggctttattcgaatttaaaggtagtttctaaccatgttctgtacaatttcatttttttaacaggaaaggtcatgatatactaagttcaacataattggattcatcatttttggagctaaaatgaatttcttatgcattctacaaattataatgcgttctatgttagtagtttcctatatatatagttttagatgtttatctgtacatgatgtgttacttgctgtctatacaaatgaagaaaaatattttattaatctaacaaaaccgagttcataatatttaaagctaatataaatttcctatgaattctagaagttggattacgtgtgtggtgatcacttaactatacaaattattagttctcttcagggtaaggagttattgtgtttataaaactttatgctcatgacaatgtccagggaagtgtgtccaatttaatatattagagtttgccactgattaggctggaatatttaagttgaatgacctttagggaataaagttattaagtcattctacaaaattagttgcctccagtttttaattaatgccatgatacctattatgcaatgcaattaaattccaaaaacacttaaaaggactcaaatcacacaccacactttgtgctaatgcaaacatgaaatatattacgtgtcaaattaaattagaatggaaaagttttaaattgtcctaaattgttatttgagttctagctatgatgggctcatttagatgtctgatgcaaaaattctaggattcctagataggaaaaagtcattctaattctttaggtgcaaaattttaaattttaaattttgggtatgttacagcccacaaggggttcggctgaaccggcaaagcaacggtcagctgtgccactttcaaacaacttgtgggccccatgtaacaccctaaaaattttgactctaaaatatggaattaaaaattcggaataaccaaaaatcttttgaactccggtccccatcggttgcccacttcttattataagccataacggtttattagcgattaaaaaaataatatgcgagtaaaacttttgtatgtatgttcttagtgattgaaaagccaaagttgaaaaaaaaacaatgttgaaaaaatattaaaatcaaattcaaaatcaagttttaaaattcaaattttggctttggtttataagctatagggcaaccgatgaggccctcccttgcatgctagaatttatttgattttatttttcgttttccggttatgtatgggctaaatgaggaacttctaagaatatgcgtgtattttgatttcaaatattatttaattaaagaaccatgattatgaaatatattaagggcctgttcactttgatgccattttcaaccttaccaaattttggtaaagttgctaaaaaagtggctatatttagtttgctgttaaattttggtaactatataagaaattctgcaaaaattttgataagttgccaaaattttggcatagttgccaaaattttggcaatgccaaattttaataaggtttttttttatcaaagtgaacaggccctaatactagttatcttcctaaaaacccttctctatataatagagcccctctggtatatttgctctgtaaataaaattatatattactattatggatggacaccctcggtgggatagtcattaaaacaaatactattttacaaaagaaatattgttttgattattttctatgagtccctgtaaagggttaagtcttttggcaactatattgcaaataatagctaccagtaaagtatttactaaaaactctatttgcgaagtataattcctagaagtttatttaaaagaaatagcattctcagataaagtctggttttcctctagggaaggcctagcccagtttgtataatagaatttgttatttatttgcgtgtgtttaggttgtgtactaaagatctccattaaattaaaagcgtacatctattacaatgtgagtaaaccaatctattcgaatagccgtactcacatttaatgagcgccaagacttatactactcttaactaaactcatctctactacttagaaaatttgtaatggtggtcttgattcctagcagagacatcggacagatacgtgtaatatcaaccatcggatcgtcatatcaaacgggccatcgcagtagactgccagacggtttctccactccaatcgccactcgccaccgccgcccacccgcaactgccgccgactcctccgccaatccacccccacgaacgattcttcctcgccgacgccgccacccacccacaaccaccgccgcctccgctccagatcccccgccgggcagagtcttactcctcctcctccccgccgccgactcttactcctccgcccactcaccacgcgcgctgcccgcttgcctcctctgcccatccaccccagccgtcgacgccgccgtcacccacccgcaaccgccgtggacgccaccgttgccgacgcctactacttcgcccactagccacgcgtgctgcccacctgcctcctcctaccaccagccgccgccgacgactaatcctccagatcgccacagtcgccgtggctgccgccgttcgcgtgctcctcctacccatcagcccattgccccgcgtcgcttcgtctcctcaccccgctgcttctcgacaccgccaccgcaggatttgggagctacaacgcaacgacgagctaccaccgcaccgatcgccaactctgaatgattgttagtttacctctgaatgaaaaaaatccatgtgttgtttctgccttggggattctgtcttgttctcctgtattgcgttgccttggggattcacgtgtattgcgttgccttggggattcagtcttgttttcctgcccaagatttatgatgacttccattgtgaaagattttcttattattcgtgcaggaatttctgaagccgaagatcgccgagccagcgacgatctcctccgcggcagccgctgaccggctccgcccgcctgccgaaacgaacgtcatgtgtgtggtgtggctaaatgtgtttgatacaatcaggtgcgacagctggtgaagactacgacggcggtggcggtggttcttcgacggtctgggctggcgttgtggcagctgacacaggcggcgcgggcgagaaaacggctcaaaaacgatctttgcggcaaaccagtccaggcctgcggtcgctgccgatgtcgagccaccaatctcacacagaatctatgccgtgatctccgccgccgatgccggatatctgcccgccgtcggttcggacaccccgcattcgcgcgcggcgccaccgacgcccggcatcctctcacacgcaacgctggccgccgcctaacccaacagtagtcgccgctccaactgcatcacagcagccgccgggcgccgtagattccgacacccctccttcgcgtgcgacgacgccgactccctgcaatgggcaagcacgatggatcagcattttgttctttttctgaggtgtcatcctgcatgtgcaggaaagtgaaggtgaaacacatcaatcctaactgcattttcagttattagctctccatcgaggattgagtgttcttatagatgaaactgtggttttagtctttagctctctattttgtgggttaagagttctaacaagtggaatttctctccggttgccacagagcatgcaagcctagatgagtacatggagaactggtttggactggatcaatactaatgtgcgtgcaacaactactgcgacagcacgggcaaaggttaattaagcttgccttgcgttctttactgattggtttatgcatctgtttaggttttaagattacaattttgattttgcaaatgtttcagaagttttactcaatgccctataaccaatcctgtattcaatccaatttagtaatttacgcaattgagtttagaatagtttcacaaatcaattcggagtcaaactatcaattgtttttggtgtttcaggtcttcagactgaagtttcaatgtagcttcatcaaatttttgaaagctttcagctcttgtgattgaggcaggtatctctgccctccttgtttgaggattgagtatatgagaaactgaagtgaaggaggatttgtgcatgaaaaatattgcagaattacttagtatagaattacatacatagtaagaaaattctctaaaagataagagtaatctgcttctctctttcttgcagtagcctttggaactaacactactatcaaacgattagctctactaactttcttccttgcaggaggcacaattagcagtgcgtctctcatgctatgtgttacttcttttgataagataaactacagtgcgaaattagtttcatgataaattatgcatgttcaagaaataattgtattattatttacttcctcgagtcataaaaaaaatcttatatgaaaaaggaatatgacaaattaaagaccagaccatattcatgcttctttgttaatcttgtcaatattggaaagcctggaggttagtgctaactaatataatgccttttttcacccttaccgagttttgtgcccttgcatctactccctctgttccaaaaagactcaattcctaggtttctgtgtctaacgtttgactatccgtctacttctgccatatgttggagcacagcgtaatgagcctgcgcgtaggacgcttgatcgggcctaattcttttccttccgattgtgccaacacctgacaaccttccctcgtgacgagacgcaggaactccgataggattggcatcggacatgcaattgacacataacacaatagcctcctcggtcgtgtaaccttcaatgatgctcccctcgggtttagctctgttacgaacgtacgactttagatctcccatgtacctttcaaacggccacatttcccttagaaaagccgggacacatagttttgtttgcttcaccagatgaacagggagatgaaccattttatcaaagaaagacagagggtattcacaatatcggtctgcaacccatctagatcttctggatctataaccttctgtccaatcgcattgaagaaggcgcacagacgttggatcgtgtgacgcactttcggtggtagaatgcatctgatagcaactagcatgatttgtgtgattagcacgtggcaatcgtgagacttcattccaagaagttttagatcgtccaatttaacatacttacttatcctcgtccaatacatcgatatcattgtcgggttgcctcggaccttggattaacaagcacaacataatatatttccatttaaagcataaccatggcgggaggttatagttcgcaataagaactggccaagtgctgtgagtactactcatgtcaccgaaaggattcatgccatccgtacacagacatatcctcatatttctagggtcaacagcaaagtctttgtgttttcgatcgatattcctccattcaatcgaatcccctgggtgtctaagcataccgtcattccttctctctgtggcgtgccaacgtactaacttcgcttcgttcgggttggcaaagattctcttgaaatgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgtttggataagcgtgaattctacggacctctaaccccagtggacacagaacctgctttgcttcgtatgtcgtcttgggaaatgtgttctcagcaggaagcatagccttcaaaattcctaaaagatctgtgaaactcttgtctatccaacaacttagtgtgttttgctttgcatccagcgtacagaggcgtctcggaatcactgaccaacctgctgaacttcattccatctctctcattcttggctgggtcctcaacgtcatgtaacatttgcagcagatcgtgatccacatcaaccatttcaccgcccaatagagaaggtataaatatgtcatgctcatcttcatcttcctaattatgcgcaccacttctgtctgctgcttctccacttcctgattcttgctctccatgcttctcccaatatgtatagcccttcatgaatcctcgttgtatcagataaccgtgtacgtcctctccgttatcaaacatattcttattcttgcaatctgcacatggacaacacatgtaatcattgtttcttcttttccgatcctcctccgcggcgttcataaaatttattacgccctttctgtactccgtagaatgacgtttcaaatttttcgcaaacatccaacttcgatcaattgctacaaaataaaaaacaaattagagacacatattataagatcagtattgcaaaagtaagacgtgatgaaattgctcaattaatgattaatattgctcacttgattgatccattttgatcacttttgggaatttaatttctgttttcctcgtaaaaaagacaaaaaatcgccctctacagcctcccaccaaaatagtgaacagtgggatacaattacactaggtggtggggggtatttatattgtgcaacaaatatctgtaacagccctaaaacaatcaaccgtgatgggcatacaagtaatctctaccgggccttaataaaagcccgtcaaataagagtgtcatctgtgacgagcattaaacttatctcaatcgggcctctagttggtgcccgtcacagatgacatctgtgacgggcttcttttagggtccgattgagatatggaaccctcatctcaatcgggcctcaactatgtcccgtcacagataagtgtcatccgtgacgggctttagttttatgccgatataccatggccgtgcgaccatatctcaatcgggcgaaacttcggctcgattgagattacttccttatgacggcccgcaaattccagtcttattaggggccgtcacagatggaaggatctgtactagtgagctgaaagcctgaaccttcaactagactcaagtatgtatgagtctgtagtaggtttcaaaagtgaaggttttactatagactataaatagttaattcttatttttttcagtattctcgatttgattggtatctattttattttccagtgcaacagaaaagtgcctcaaaccacaatgtgttttgtatatatatagctacagctttgatttgagatattggagagtcatgatagtttgatcattaaccacattttaaaaatgtaaaatgtataaaatatataacattttaattttacccctagtgattcattggttcataaattacaatatatatttttcaaaatgttgaatgcagctatatatttctaatgatatgcagaaactttagtcatatgcatatacttgttagtgatatgacaagacatgtaattttttgggcaaaatttagctatatcggttgtttgccgttgtttatttctacacatagatgaaaacatcgatcaactgactttgattacagatgtattaaatgagcgtcaattttagttcagaggttcatttgttagtcatccaagcgagtccaccttgcttatcacagtagtttatcttcaagttatgaaatgaccaatattcttttttgtgtaaatacaaataactagagtgacaatatacgttttggttgttttgtaaccttgtccagataatcaggaccacatcaagcgaaatggatggcttaagtcaagctaattttagatatttattatattgtgtatttgagaggagtaatacctgtactttatagcattgcaagggatggcttgttcctagatggtattgtggatagatatgttgattaattttttttctaataactctatcgcttttttagcctaactatctgttctatgtaccattcatgaagcatatattgtgtcgctgtcatttggttgtttcatttgcaatattagttgtcaccgtagcgttagcacgggtatgctactagtagattttaacattgcttagtttagagaagagaagacatgagtaaccttgcccgatgtgcgggaatatggtagagttggtgtaaaatggaatgcgaggcgtgggaaggtggatgaaccctcgattaatgacaacttcaacattaacattgtttttcagttaaaactgctaagtcataggattatgaaatgaattgtgaaaactagctttatgcaactaaaccaagccatccttgaacccctgtgagcaccaaatgcattttgtagtggtggtcccctgtgagcaccagatgcattttgtagtggtggtttgctgagtacgtatgtactcacccttgctttttttaatttaaatcttttagaaaggaattggagtcgattatatttatgcaatgctgtcgagtgcatgtcgaagacaatggatttgagaccctaggttcaccagtcgttgcctgtggagtacgatggatcgccgctgcttcgcttccgctaccctatctatttcttttggtatcttgtaatgtatatgaccatgcttggtctattttgggacctgtttgggctaccctagtattattaatgtagaaatacctgtaaacaatgtcagcttgtgatattcaattgtgctacatgtgtaccacctattgattcagggagtggtattgcaagacacatggggtttccggtgtattaaactgggggtcttgttgatgcgacaaacacgaggcctgggagatctgcttaactccagtgcaggtccaaaaaatcttgcctttaagtttgtgagcgtgccagttgatttgatcctgcaattaacaagaaataaagacaggaaaatagcggttaaatctataacgatagccgatcagccagtcgtcgatgacgtatcatttatctttgagccgatgtcatatttgagtcgatcggcagttataaataggcaagaaagaacttaatctattcaatcggctgtagatatcaatggtatataatgctttcgtcgatatatgtttaaatcaagtgattgggatagatcatcgccatgccgagatagtataaatcacttagatcgaaatatatattaacaaggagattataagcattcatagcatagccgatcagatagatctagcatgtatcggctagtactccgataccactctatattaagatattaaagcaagcaaaatatatcaaacggaaagcttaatatacctaaacgcaacaagatcttaacataaagggcggatttaatatctcaatcaagcatatgagatataaaagagttaaatcaggtaagatcggcggaaactccgatactgccctaatcggcaaccaaaagcaggctagagattgagattctaatgacgacttataagatcaaactcaactgatgcagctataaatatgaaaagaaggacaatatctagacaatcaagccattgaatgtttcatagggtggtggatatcttatatagtctaagtcaacattagtatttaacctaatcggctgctttccaatgatagatgtcagccaattgaaggttaaataacaatattgcaagagattatataggatatatgataacttgacgaattacataaacaatattagagtatcataaagataaaagcactaatcccgagaacgcaagccgccataacaagctttacctctagttgaagatcgaaaccgatgcagctcaacccgaaagcaagaactcgtcgaaagtaaacgaaagtaaaagggtggcgatgcgctgagattgtattgaacgtgtgttgtttgcttacatgggttcgggctctatttatacccgagatacaaaatatgtccttgccggacacgacacttatctctaacaaactctaagatacaataagtctttgcgatagacttttgcccaaacatatctctaaggaaattacataaaatatcctaattaattgaaacaattgcccaaaccgagagctttatctctatcgtggcaatccttgtgaagcactttgaacgattctaaaaacagcctcgaagctgtcttcatcgtaatcggttgcattgcctccatcggctgtatcgactatcctctgtccgatccatcccagccaatgtacactccagccgataccttcacagccgatgcatactctgttcttcgaatcgatctcttcatcgaattcgcctcgatcctaatgttgaacctggttcacatcttaccaaatttggtcgttaacaggtccccacaccccatatggcagttatagcctatgggacctctataagaggagaatggccggcggagggaagttcaccccatttgaacac

SEQ ID NO: 14276 - DNA, 4891 bp, Oryza sativa
aaaaccatattttttctcgtgtgtttttttcttgttttctcgcacgtttttttgcttgtttttttcgaaggttcttttttgctttttttctaatacacgagaatatatgacgaaataaagccatgtagtagatggcaaaaaatcgatggatcccattcgactcgagcgtccatcaatttagtttttttctgacagttttttcagagcgatttgtttttaatagacggtgtttttttcttgcacggttttttaaaactatttttttagaaatggcgtgttttttcaacagttttttcctcgcatgtttttttaaaatattttaccgatgatggaaataatttttctcgcgcgtctttttttattattattgacaatggaaaacctttttagcgtgtttttttgcgcatttttttctgacttttgcctcacacgttattttaaccgtttttattttctcatgcattttctctttttaaatagttagattagagatagagaagagatatatactggttagaaatcagattttggttcgccctttccattttttctctcttgcattctttattttatacgaaccagctttttattttttacgaactatttttcgccactttcttagggaatcgaacaaactttttaagatgtttttttagatttttttcgcctttataggaattagacttttttttctgtttttaaaggaatcggatctagctttttttgtcaccactttttttttttgccttttatatgaatcagattttttttcccgtcggatctacagtttttttggccactcaggggaaaaaacttttgttgttgttgtttttctttattttctttttttacggtttttctttttatgcacctttctgtctttgttctctttctcttttatttttttttaacaaaaacgacctcaagtaccttgttgcaagattatagggactcaaatataaatataaaaattacagggactcaaatataaaagtacaaaccaaaaaattaaaatcatataaaaatggaatgttgtcgacctgtagattccgtttttgcaaacagatctttaatccggcacatcaatttttttcaaagtcaaattttttttccgtttctaagaccgaatctgatataggagtcaggacctttttttttgctatttcggatataggagtcggacattttaattttttttcattatttttttatggacgaaggaagcacctcttattttttaagtagtagagatgtgatcttgggagttgaattttattgaatcttgtacatgaactttgtttaaaacataattagcaagtgccaacctagtttgctatataatttaatttagaattttggaattaataaatatcgagttatacttaatgttagagtcacaaatataccttttcatgatttacttaaatagcaagagctactgctattgacttttcaaaatgtgagtttataatttgttgctacctggataaatttgaaatttgaaattcgtaaatagaaatttttaatggttgaaagagtgcaatctatttgaataatgatacaaataatatacccactgatctttttaatggttgtggacgttactattatgacacgtcctagtgaaccgacatcaattaattttaccttttcactctaaccttctcatctttgcaattgttgagagtcaaaataattgcagctaatacatgcataaattaattgagtttaaatagatacactcggaactccttttatctgacgacttgtttttgtttcttcaacgtctgttacataagatgctaaagccaatgatatccgcggaagggagaaggtggtgtcaatatgaattatttaacacgtggtcctctttcaataagaattttgtgggggaaaggatttcagcatagttatctcatggaaaattgaaatttccttgttctcagaaatttaggaatttttgggaatgatatctttttgaaagttgaacaaagattgatttaactcataaaaaaatttaacttggaagtttaaattttgaaacgcatcttgatttagtgcttgctatattagggtgggtggtgactctactatcactgcaaagccttggaggtgactagagatcggtcggccgatcgaaatcttcaaaaatcgagcgctgacgtcacgctgatatcagcgcccgacttacgtgcaaaactactttaaaatgattttttcttaaattacttatccaaatcatgatccgattgcaccattaaattcgttgtaattaaatcttcaaaataagaccatacatagatatattctgatgaaatttttttagcttattattgaattttttttaaatgttgcacgatgttccatcagatatatcggaattgtttcactaagtagatcgaaaatgtttcactcgtttaaatcgggtattatttcaccttatataaaaacaatgtttcagcaaatagcgaaagaatatttcagttcactacgacatttgatctatacacactaaaacattataagaatagtaggtgaaacattttttcggtggaacaaaaaataaaacaaattcccttaataggggtttctaaaatatgtgggttttttttgttgcaatggagtatttcagttcactgcaacattagatctatacatagtgaaacatagtgagtacactaggtaaaacattttttgtagaaaaaaataaaataaattctcttaacagggggttttcaaaaaatatgagttttttttttcaatgacgggtggtagcatagaacgctggtggggccagagcatgcatgcacgggggaggggcgtggggggagcgcacgatccggctcccccgcgtcgggcgaccggatcacatcattatcgcaaagctttaggcgctgcgatcgtggttgtcaacttgtcataaaaagttaccaacagcttgtaatggttgcttattagcagaaattaacaaaggattaaaactttgcaacacaacataaatagtaagcgacatagtacgcgtactatttgtttgaagatactaaatgatagaacaaaattgtgtggcatatagattagtccggcaatatatagattacattatgttccaattgatgctatgggcagtcaactttcttgcgatggtgcagatcattgcaatgccggcggcggcggctgcaccaagtggatagtcagcggcgtgctcgcgtcttctaaactgcttgtagatggtgacacaaccgatcaatctggcgatcaagtcagtcaagtaactgctcgatagatggtgatggatttcttgatgttcgtgcaggatctggagaacggcggccaaatcgtggtgttggcgtacttcatctcaaggtatcgatggcttcttcgtgtacacaggcgggttttccctcgtcgtcagggagctcggcagttgtgatctcgcgtgacgtgtgctgagtcctgaccagatacatgatatccacgtaggccaactggtgcaccacaactgtatggattagatgaaggcctgtacaaagattggtaggctttaaaacgcaagattagatgggcacattaaaattaaaagccacatgttgtcatgatattatgttgtatcaaatcaatgatcagatatttctggatatccacataggccaaccaccgagatatccgtactttcatatgtggtaactgcatggattagatgaagaatcgaagacccgtacaaagattggtgggctttaaaatacaagattagatgggcattagaattaaaagccacatgttgtattaatatgttgtcatgatattatgttgcatcaaatcaacgatcagaaatttttggttaacgggagagctcataaaaaatgcctgattagtatgtgtataaatgtatagatatatagatagatgtatagatatatatagatgtatagatgtatagacagataatgataatgtaaacaagtattatttggttcatacgacattatctttactactttaaaaagtacatttttttcaccaccgcagttgttctccttttcccttccaaccgtatgaggtccacagatccagtaatttatttttagtcctcccacccaattgaagataatttgaacttaaattggagatattttggtctgtatacgttgcttgatcagtaaggtttggtaatccgagctgacccaaatcagagctgcaaatttaaattccccggttcatcgccggccgccgggacaagatgtgatcaagcaataattatgatccgcacggagaaggataataagttaatcacacaatcagggggatcatgcatcatggcaacaacagctaacccgctaatatataggtgcgaaatgtttgcttgataattagtggcaccccaccgtgtaaattaactttctctctgtttttcttcctttccatggcaggaagtcatatgactagcggttaacatcgagaacctaccttttgggtagccactcattgcctgttccacctccaccgtgcatccgtgatttcatacgtttgaaaagatcaaaagggatgcacctcacctcctccaaaagatcaggcagcaggaaaaagcaacgctcgagtagtctcaccggcaatggcatcgccttacgcatcatgccattcgttatgcccgactgcccataatttcatacatcgggaaaatggcaatgctggcctttcttttgtatgcgcgcgtgtaattttgaaacagacagcaacatgttagagtaggggtcaaatatagcagtcctattaagagctggacttataattgaaataggtataggataaagttagagtcggacactatcttatactctctcttaaatatagagtgggacaacacgatataatcattatgactacaatatagcgt

SEQ ID NO: 14277 - DNA, 1040 bp, Oryza sativa
aagtcgatgatctgttattcccttgcgcaatcctgtcatggttagtagcaaacaagaaatacacaagaatatgcacgctcctatcaactactaggtagtggtagctgaaatatcacacacactcaagcttttcaccaagctcttacaagttcttactaaagcaagcggaatggtgacgtacaccgactcaaccaagcaccccaatggaggttggatgtatcgatgccttggcaaacacttgctgtacagctgcaatcaaatctgtggagctctaggtaggcttaaatatgtagcaaaggaatagcaaatgctcaatgcagagaatgcaaagttgaatgatcgttcaaagtcatgtaccgtgctggtcctaggctagaacgtactagagacgcgagcctagacacaaacgataccacaagatataaacactaaagcacaactctgatatatgaaagcaaactcaaagatacaactgatttttctcttttccttctttcttctttcttttttttctttgttttcgttttcttttcttttttttggtgcggcttttcttttctttgtttctatgcacctttctgcctttttctctttcttttttttgattttttttacaaaaacagacttaaggacctcaacgtaaggttagagggactcaaatgcaaaagagaaaacccataaataaaattaaaactatacaaaaatagagtgctctcgtcccataggctccatttttgcaaacagatttccaatccgatactccaacaattttcacatagctatgtgagaagtcacggtgtagatcaaaaccgagagaaaaaaagagggagggagtcagactcgggagagggggagggaagccacacgcaggggggtgggaatcagctaaaaatctgcaaatcacgcatggaaggaaacaaagtccaaaaaccgatctgctatcatttctttctccttaaccgcgcgcaacagatcttcgtcctcacatgaacagaacaagcacgggcgaatgcagacggcaaaccccatatgcaacttca

SEQ ID NO: 14278 - DNA, 8824 bp, Oryza sativa
atttctactatattcctattccaccagctagatactactaaactaacttgagagaaatgagagagctattgcttgaggtgtgtgagtgaagtaagaagagaagctccttttataggcaggtaatgacggttgtgacggttgaaatggtcgataataccctccaaccgtcattcgggatcaattccagtcatccatccaaaccctgcatccatcggtgccacggaaggttcgaccaaaccatgggctggcctaacccaacccatcttcggctagcggcctcttttgttgtcctcctccgtagacttgtgaattttggcccaatgtgtcgtgttatttatgagttcatggctcattcatacataagtatagttcttgacaccgtacgatttgtttatcgtctgagttgatgtcgattctcctccactttattgtcattctctgcaaaaggttagtatacctaatactagtggaattttattattctaacatatatatgcattgcaagcatcactagttctcctctattttagtaatattgacggtcgaaactgatcgataacgaccgtctacagcgggaccggtggtcttttttgcatagaatagtttgaggtgtttccataatcttcaaaagatcaccctcaaactagaatgataattccaaaggctgaatttcttcttcctttgtttctggcggttcgaatgagaattcaacggttgaatcttggtgtatggaggtagatggctccgattcaacggttgaatgttcatctggtgtaggctcgatttcctggatgctgtcgcaatgaaaaaaagagatgttgtcaagtatccgatcgagttccgtatcttccgttgtcatcttgtgtgcgaatgatcgttgggcgcaaatatcaaaatacatggtagactccgtgtctaaactcgaatggaagtattcctcagcaacgtggtcagataggcacaagtctgggctggctagagttagcaaatagaactgtgctcaggctacactgatggactccttctagtcatgctaaagttgagaacctccctacggagagaaactacacgactaatgggaagaaagcaaggcaaaacattttttttcaactcctcccatggtcccatttcccatatagcttcatccgcaattcaagaaacatggtgctatgccacttgccatgtgtctttgggcttgtaactttattctgggatcccagcctaagtggggcccaaattgggtgctcctcaacctggtggagcacgaccctccagaccccttggtcgtattctcacctctttaaatagctagatacctctttagaatttctcgagttttgttaaattaaagttttagccattgctactttatcttgcagttacacatgttggctaggccgtctaattactcgtttttagaaccccaccttatcatgaagaggtaggaggaggagacggctgtacttaccacatgtaagtattaccgtgtacttcgtctggtgccacacaataatacaatgtaaaaacctatacaatcactttctacgtgcaaatgaacaaaataaatatacatagacagtcccttcggtcgggtgcgcgtcgaccaacagctgatcttcgagcattaggtctcgcatcacctcgggtggccttgggaagaagggacctgatctaatgtgacgctaataagctacaggcaggtgtcaggcaggtcttgtttagctctgcaaaaatttttactctacatgacacattgaatataatagccgtcaagccgtgcgttgcacgggctctttatttatatcatcataaataaatattaaaattttagttatgtatgaatatgtggtcttttctaattacaatggctcttagattatattaaaagaagagtttttatgaaatatacattgttaaatattgattcctaatcaatagaatacttaaaacgataaaattcatattttttaattcattttgagtatgacttccaatggcatattttcttaatacaatgtcccaatatactattattagattaataataaataaaacaattttagtcatgtttatccctcaacattgattaaaagaaaagtacttcatctgaatttgttggaggaatgatgtatttttctgaagtaatgaatatcaatgaaaacataaattgttcaactggatgaagcatgcaacagattatagtgatataggatgatacacatatatatacttatttatcgtgagaacatggcataataaaggatcaaaatcaaataacatatagtattaacatatagtaagaggaaaccatgtactacgtataaatattaatggattagttctaggagccaaatcaagaactctgctgtactatcctaccataatgttaatatggattggttccgtgtccaataatttttcattgtgtgccatgttaggataaagtaggatcagcaaaatgcatgggattattcttttttccatggttttggaaaatagggacgaaaataaaccatgtttcactgcacaccatttgtctttttcatgcatgcatgtatattactgaagcaacgcatgcatatctattgcttttttccacccatgcattattatcgaaaaaaactgcacatgcatatctattgtttttttccatgccctttgcctttgcatgaccacctgtataacacaaaatttatgatgaatcaactaaataatataattatgcatctatttgccaatatcgggtggaggttctctaatagatttcggtagttagaggatctttttcttctgttggtgtctattagtttgtggtttgcttagctctgtttctgctatcgtaaactctctgtgtgagttctgtaataattggctgtagctctttgagtaaaggccggaatgttacattccattataaaaaaaatcaactaaataatatacggagagtttttttttttgcggggatagtttaggaaagtccgaacatatttttgaacataaatatgaaaaaagttttttacaatataataataagggtagcaaattcttatcacataggaaaaaaaatacattttaaaacaaatatactcccttcatccacaaatatttttgatcctagacttcaaattctatccacaaatataagggatttaagagtagaactttgtaaagccacctctcatttaatatttttcgatcaatcttatccctaaccatcgttctactgccccttcaccccgttttaaactttatcttcatttttccttcattcctaatctcttgaaatcgcttatatttaaggagagagtgaatatatgaagaatggtaaaagtagatcaaatacagataaaaagtcagactatgcaaattgatggaatacttacatgtagtacatgtggcgaccactatggatcttcctaaatgccagcgaatttgtcaaagcaaatagatggaagacttctatgaattattatggtacgatgaccatggattggcttgtcaggtgctatcgaacttgttgatgctgaatcaacatctcaacatcaaaaatatatacagtatggtgatgacgtagattagttcctattggacgctgtgacagatgagaagtatgcatgtaaagagaattgaactggaaattagaagttagaatcaaaccttaacaatggagaaaacaacaattagcattcggctgacgttgtgtgcttttccggcgctcaccggctgcacgtcaacctcgccttagtgattgtgtgttgctagatccgataacgttgatatattcgcctttgccgcggccgagcgagcagaacataaatggcgtacgatgtgcttgtatgtactgtttcctcctgcctttctccgtcgtttgccgctgccggccggcgcgatggccatgccgtgccctcccgtatcttccattgcatctgatcagatcgatctcagtaaatatggatggactcatcggtttagaaaaagaaacaaatacccacgttcgaaagaaaaaggaaaaagaatgcgtgcgtgaaaggatcatatcgatgggcttgacaatataggttacatgggctttaaaagacccaccacgtggaacttggattagattgtaatcaacggttgacatattatggtttgtttaatcaatggcttgatcttcctgattaacgtgagagctccaaaaaagtgcccgattagtatggatacatatttaaagtattaagcgtagtctaataacaaaacagattaaagattccaccagaaaactacgagacgaatttattaagtctaattaatccgttatcagtaaatgtttactgtagcaccacatggttaaattatagcgcaattaggcttaaaagatttgtctcgcaatttcttagtgaactgtgtagttgattatttttgtctacatctagtacttcgtgtatatatctaaatattaaatattaaatgtgatagctatgaaaaattttgtccgggcctaactctgctaggcatcaacgagtccatgattcaatcaccggctttgagagtggagtaaatttttcactcgtcagacaagctctagtgcggtaacccctgcggtggattggacacacagctgcatgcatggcatacaatccgtggagcatggcttttgcttttttttttcgcaggcctcgacagccagtcacgaagttccgctgagccgctgacaatgggtcgcgtcaagctttacaattgatgttactgcttctgcttgctgctagctcccttagagtagaatataacatgtcctatataatccctctattttataatataaatcattctaacatttctcatattcatattaatattaatgaatctagatatatatctatctatattcattaccatcaatataaatgtggaaaatgctagaatgatttataatgtgaaacggagagagtaatagttttattcggattaatcattatacgatggttgtgtttagctcacactaaaattggaagtttggttgaaattgaaatgatgtgatggaaaagttagacatttgtgtgtataaaacagttttgatgtgatgaataactttagaactaaagacggtcgataacacggtcgatatgttacgtcctgttcttgattaagtttgtttacacgaaggaagtactgtgctgctatagcgtttacagtacagtgcttcgttaaatgccactggtacggaaacatttttctcgtgtgcccgaaaaattggcatctctcttagcggtaccgtaacggcgcatggagagtgattgagtacagttagtcaagttatgctcgcctccccgtccaaaaaaaaatcacaaatataatgtcgaaacaagatttcagcaatactaaaaaggtggctatcaagctgaaaaagtagatgggtttacagacaagaaattttatacaggttcagaccttcataataagaaataataccctactcctgtccggggattgatccgtcgagtgtattattgatcgtatgatctgggagaaaaatcgtgttctaagaggcacccggacccctctttatataggggaaggggtccgtattacaaagtacaacccatatctctaacggaataggtagttacagataagatacaatcgtaacctactataatcccaggtgcttccttgatatacaagtttagacatttaacccaaaaacttttaaagatattctatctatacatggtacccccatacccagtcggatatacattccgtgtgggtatggggtatccataatctccacagtagcccctaagacctttatggtcaacgaaatagtcctttctcgtaattcaaaacgataatacaagtgattcagcttcttctgccttggtgtcccgagtactgaagtcaaagactgtgaagggctgaaaataaaaagaaaatcaggtgcatcgaccagatgcacctaattaggtgtagcccccgactatgtgatccatccgagtggttcaaggtacattacaaccaccgaatcactttgggaattaaatatttaatcttaagcagcacgtgataaaatatccaaccgactgctttaaccataatacacccagaaaaggcataacgagacccgagtgaaaagcactctaaaagtctataaaccaacatatatgacaagaatctgagtaaaaaactcttaaaggattcatcaactgttgtataaagaatgacaaatgacaagtcaatatggcctaagctgtgacttatgtcaatatcaaaataagcatataacatgctgaggggatagctatctgaaattagccatctcaacaaaacccaagcagctttgcaacctaaaaaggtcaacaaaattagtattacacttttctaccgggcaccttctttatttcgcattacagtaattccaaagaattatctaactgcatcgaaaaggatttcaacggcattgggctatcctgttgtgagcaatttttaccaaggcaaaaatatatgctgaaatccctaaggaacacaaccagccacgccaatattgaagttgggctgaaagcactgtataggcctaggcccattagcacctcccgataccctaacaaaaaacgctaaacaagtgccgcttcgtcttccctgccgagacctccgccactttccccattctccgctacagtacagcgaccactccggcgagaactagggctagcaaatccacaccaatccactcctctcgaagcttcgtaaattcgcaaaaatcttttgcgcaaccaccgcaccaatctccccttcattcatcgccatccttgcttcaaatcccatcatccattctcgcatccatggcgtatgagagagagttttgagagtcaatgggctccctccgatgttacagaggagaacttcaaggagatggtggcgcacaacgttctcctagcgaaggaaattatcgggtggcgtgcggcgtgcggtgaagcatttctgacccctgacacacacgaggtcgtggtattttctcacttcttctatggtggcttttctcttccaacatcgaaattcttcagggggatccttgaattttacgggattagcttgcatcatctgaaccccaattccatagttcacattgccaatttcatccatgcctgcgaagctttcctgggtattaggccgcactttgccttattccgccgcatcttcttcctcaagccccagccaaacaagagcaagccgtgcgttgttgggggagctagttttcagttaaggggaacccttagtcggaaatacttccccatgcccttcaaaacctcaaacaagggctggcatgcaaactggttctatgtgcagaatcctgaaccagcgctccctgagtactcttgccttcccccagtataacaagacacttggaactcgcttccagtgggagatgaagccgctcaaccgcttaccctaatggagcacatgttgaaacttaaagagcaaggcctgcaaggggagcaaatcactcggcactttatcaacagccagctggcacctattaaagagagatcccgcacagtcttcgaatttgatggcaaaactgaccccaatcgtgaagatccaaaatctcttgagttcaagattatgaaggagaagatgtacaaaatcttctctaacgctattgtggtttgctattcacacctgctgccagtggtgccatataacactttcaaccctcctccatcggtatgtatcaaaaatatctcggccttcctgatgacatccttttgtcttttgtaatgttagctgaaaacttgaaatattatgcataggaattttctcttatgaaatctgatcctccaatcgctcaacgccgctcgccccgccggcaggctggtcaggccagtgatgggccgaaaatccaatctgacgctcagcccaacatctcaaagccaactaactagtcgggctctcagaaaaggaaattaattctttgtgacgacgaaggtgacaatgttgggaaagctggcagcaaagaggtgaccggaaaacagccaaggcaggctaacccgaaaaagaaaacatccagtcgtccaataccaaaaatcaggaagtcatccaggtacgagtcatctagcaatttctcctgtattgccaaacatacaccatcaaggtagcaatttctcctttattagcaatttctcaaatctgcaggaagccatttgacatcgattcctctagaaaagaccctgaaccgactgacaaggagactgatcctacgaccaccacagaaaccgggctgactgttgaaaatcgcccgactggtagtcaaccggcgaccgacaatgtagaggccggaaatgaacccccgactggaaaccagtcggccgaagctgaagccggtgctaatcaggagcccccgactggaaacgagtcgggtactgaacaaaataaggacatcccggaaacagaggctcgggcaagcagccctcccccaaaaaataccaacaccgacccggagtccaattcatctgataaggtgcaagggcctgctcgtcctcaaccgaagattataacaggtaatcaattctccgaattcattttgacttgacaaattctcttcgattacttcatcatcatttgtgagtgttcaaaggcccaatgatcggcgacgaagaagatgttcttcggattcagtcagctgaagattctcgcccacccatcttagttaaatggtgggatgatgaaatgcagcctcaagggatcataataaataagcagaaagaagatgaggaagtgtccttgcttgcaaagacgctcaatcaggccactcatctcgtaaatgtatgtttctcacatatagctt

SEQ ID NO: 14279 - DNA, 30599 bp, Oryza sativa
ttcgagctgagtggttcatccaaaggtaacccctacacctgattaacttattctaggctgctatccgcatccaattaatcagtggaatatattacagtacaagctgccaagatcaccgagctagaaaagcaaatcaaagctctggaaaaagacaagggtgaactaaccaaaaagagggactcggctctaaaagatgtcgaaggtatttgtagttaaaactctaaaatcattcttatcttcgtgcctggacgttgatgtgaaccttttatgcagatcgcaaaattaaatctcaggctcaattcgaagtcctggtcaacaagattaagaagcttgaaggagctagggatgaagttgccaacgccgccacaccactcatccaagccatgttttttaataacaatggtccgagttcgttcgacgctgttgaaatcttcgacaagctgagagctgctccagatacatactttaagaacatcaaagaagctgaatgcatgggagcgagcatggcattggcaatgaccaagtccctgtacccgaagattgatattgacgctgtcgacggctttgcaaatgggaccagtgaagaagatgcccttgacctcatcaataatgcatagaaggttgccgacaaaatcgctgctgatgttgttgagagatttcaagacagtaatctcggtccgactgggtctgatgattctgataatgaaaaaactaagtctgattgacattgtgtgatgtgacttatgatgatggaggcacaatttgtacaatactgatgtatttatgctgtgcttgataatttaaactcagctcttgatttcttaaaagtttttgtcaaaccttattgagcctagaacccgcaaaagttgttaaaaacattcagtcctcattgactaagccaaaaaatcaaacaaggcaatgataaaccaagtaagcaaattgaattgataagaatcacactctattattattatagtagcccccgactgttaactcaaggagaaacttgatattagcagtcaaagagggaaagaagatacaaaagtaatgcctaagcataaaaacgacgaagatgctcaatattccaagagttgtcgacgtgagtaccatcttcacgcttgagtcgataataacctggccgagtaacttcagaaattatgaacggtccctcccataatggagataacttgtgccgatctcgtgtagtttgaatcttcctcaagaccatgtctccgactaagaatgcccgcgatcgaacgtttcggttgtgatagcgtcgcaaccattgtaaataccgtgccgactaaatcaatgctgcctcacaagcttcctccagtcggttgagatcatcaactcggtcttctccgtagcgctcctccttgaaattgcgaaatcgcaaggattcgaattctacctcacttgacaacattgcttccacaccatgaaccagaagaaacggtgattgccccgtggcccgactaggcatagtgcgtagagaccaaagtacagatgacagctgatcaacccacttgccggtgtagggatgcagtccgacgaagtcttgtgctttgattccttgaagtaccataccattggcacgttcaacttgtccattgctcataggatgcgctacggaggcataacaaattttgatgctgaagtcttcacaaaaatctttaaacacacaaccagtgaattgagtaccattatcggtgataattcgattgggtaccccaaaccagtgcacgatgttgacgaagaaatctctagccttgtccgctgtgattgtgacgactggcttggcttctatccacttggagaacttgtcaacagctacaaatagatgagtgaaaccaccggtagcccttttgaaagggccaaccatgtcgagcccccaaaccgcgaacggccaggataatgggatagtttgcaactcctgagctggtaaatgagtttgtcgggcaaaaaattgacaaccttcgcatgttcgcacaattttatcggcgtctgatacagcagtgggctagaaaaaaccctgccgataagccttgccgacaatggttgtggggacacccgatatagtcatggtgccccacgaatatgtaactgcccaggatgttcagttaagcatgaaatgatataaaagtataaacttcgattatacaatactcaagtcacttagttcacaacacaacataaatacaaaccattacatatatggcctataaagccttatttctacaaacagataaactgctagactccaccacaggaaatgcctgagcgtagggtgacctagaaaccatagctgtcccactctaacgggtcaacaggatcttcacaagcatcctcctcctcatgatctgaacccatttatgagtacaaaaggtactcagcaagacatgcttatgataataaatacaataattgcaatataaaacatgcagtatcgagagctgcaaggtttaaaccctaaccttaacagttatttcatagagcctaacttaataaacatttgatataaacaacactattgaacatttaatttaaacaataataacgagcataaaaatataaatgttacttataattaacatgaatagaacattaagtaataaataagttaaccatattaattaatagccatttagtttaacttgtgcccataatctggaatcacccatagacacatctccattaaccgggagcacggcgtattcgaatactcaacgactctgcagcgtatgcccagctttacccgcacgatacccacagctggccgggctgaaaagtaacaaggtgtaatattgctccatatatctttcccttctgcctagtaagttaaaggatgcttgggatgttgctcggagtgatccggtccgaggtgtgtaccaacctacgtccgcatccacttaccattgttcgttactcgatgggcagccgagaacttcatgggccaatagggcagttctgaactctcggggcccatcgagcccacatatataaatcatataaacatgaaccatgtcactttgcttcacacacttgaaagctaatggcgagtacactgaaaggcctgcagaagtttaatcaattggagcaatatacggccaggttcgacaaatcgatcgtgtggatgggcgaaactatgtcattcttattgacacaagggggtttattattatatcaattttaaataagaaataaccataaatatatccatatatccatcacgaccataaacaggtccataaaaccaaacacatgaactctatcatgtgtaccacccgctcacatgcgctgtcaacagttcttagcatatagccataaatagttccataagcatgttttcataagcaataataataatatccatattaaatcgatagcatgctaaataattaacagtttgtttaaatgtttctcaaattttatcctaagtttgttagactctaaggctcattaaggtgtttataacaacaaacagaaaatataatgcaataatagtaatataattaatttaaaagaattcgtgcagtctatcgtactccaaaggacaagtacgctactaaaataactctctatctactcggattaaatttctcaagggagggtgcatgtattgcaaccttcgggctcgatgtagtcgcacaaaccatctcctcctggcacggagatttcactcgcttcgactaccgaaccaaagtcagcattttctatttacgcaacaatcatcaccacaataaataacagaaaaacaaagataaccaaaacaaatagtatcacaaagtgcaacaatgggtgaaaaggatttaaagaaataattttagggattttttggaatttcggtgaacggcgaaccataggcctaaaattagggtcgtgacaacgggtgctcggattgcaacgaaactgacacggatggattcggaataagaaaaaggatttttcttatttatttttcaatagaaaaatcggatttttcttttcttctctcgctctgtacaggaacggccggcaactccctggcgccggtggtggagatggccggttttgagcaagggggcgccggtttcacgatctaggggtcagggcgactccgttcccgtggttggcggcggcacaggcggtggcgcaggcggtggcggcggggctggcgacggcggcctagagcaggaggcggcggcggccatggcggcagtggtgcaaggggagcgcggtggtggcggcggctcggcctatggcggccgggagcggcggcgcgccgtatggctggcggcggccgaacagagcggcgacgccgggaggaggcgctggtgacgttccggcgacggattggaatgggaaagagagggaaaaggtagtactcggcatggagaatccatttttaccttcaatttcagaggatttgcgatgtatgcgacgaatttaggagctttattaatggcgcaaattttgcgttttggggatttttcctccggtaatggcgatttgattcagtggagataggtgcgcatttgagtagtaagagaggtcggaattgcggttcttttacccccggtattgagccttctagttgagggacgaaggagatacggaggcgggaagctggaggtgtcgtccggggattcgtccgtcgatcggcctcatgtgcacgcgtgcgagcgtgtggcatgcgcgggctggcacgagctgggcgcgagcgtgcgcgagcatggtgcgggatcagcgcgtgacaacaccgggcgacacaggccctggctcggccgagcccagtagaggaagaaagaaaaggaaaaacagagaaaggaagaagaaagagaaaaacagagaaagagggaaaaagaaaagaaaagaaaaaataatagagaaaaggaaaactagggtggaaataaagaaaaggaaattttgggcaaaattaaactagatagaatttgaactgatgtgatatttagatggtgcgatatttgggatagatttaaatcggattcaaaggaattatttgagggatgatatgcactttgcgacaaaaaattaaacgagaaaagaaacaccggaaacaaacttggaaaataatattttaaataaatgtctaactcgacggttatatttttagagaatcaaagcaaactaaatcggttttaaaaagttgtcaaattttaaggatgttacaatggttcgtgcggcagcgtgattgtcgctgatgcccgagtgtatatctctgagcaattgccttccctcctccaaagagacacaacgttgcagaattcctgatggacttttcttgtacagctcggtctcatgtatgacataaagcttgctgcgcctggaaatccgctcggcttcgtctttatcctgagggagttcttgcttggtcaaaaacttgatgagggctctctccagtcggcgtcgatcatgcttacttcttgagtgtctacagcctcggttgtttcccttcttggtacggttggttcgtaaagatgctcaacaaacacatcagagggagatgtttctcgtttcgaaccgaaattggctagtctgtcggccgcctcgttattatgtcggaggacatgggttaactcggggccgtcaaacttgtcttctaacttgcgcacctcttgtcgataagcagccatattatcatcgaggcaggaccattcttacatgacttgattaacaaccaactgagaatctccacggactatcagacgacgaatccctaaagatactgtcgaaacaagatttcggcaatactaaaaatggggaggctatcaagctagaaaagtggatgggtttgaagacaaggaattttacataggttcaggccttcttaatcaagaagtaataccctactcctgtccggggattgatccgccgagtgtattattgatcgtatgatctaggagaaaattgtgtccctagagggacccggacccctccttatataggggaaggggtccatattacaaaatatagcccatatccctaacggaatatgtgattacagataaaatacaatcgtaaccgactaggatcctgggtatttcctagacatacaagtttagaaaactaacctgagtcctcctaaagatattctatctatatctggtaccccgtacccaaccaaactatacatgccgtatagatatggggtatctataatctccacagtagcccccgagacctttacagtcgacgaaataaccttctcttggagcataaagcaataatccgtgtgcttcaatttcttctgctctggcctcccgagtactaaaatcaaagactgtgaagtgcgaaaaaagaaaataaaaactgggtgcatcgagtagatgcacctaattaggtgtagcccccgactatgtggttagttaaaaatctaaacatgtagtcaagaaccgagagattttacaaccaaacatcatatagcaaagcatacgtggcattcaataaaacacccagccgactgcttcttggctttaatatatcgagaatagagatatgaaaaggcccgagtgataaacactcaaaaggtccataaatagacatatttgacaagaatccgagtaaaaactcttaagatgatccaccaaatatgataaaaatcatggtaattaacaagtctaatagcctaggctatgaccctcaccataaccaaaacaagcatatgacatgctaagagaatgactattagtaaactagtcatctcgaatcaacccaaacagcttttggagcctaaaaaagcttacaaaaatagtataacacttttctgtcgggcacctttttatttgcatcgtagtaattccaaggaattatctaaccgcgtcaaaaaggattttaacagcatcgggtcacaccattgtgagcacaaattgccaaagcaaaaaatgcctaagtccctagggatcacaacgggccacgctgataataatattgggctgaagtactgtataggcctaggcccattagcactcccgataccctagtgaaataaacactgaagtccaagcgacgtttcgtcttccccgccgagactctcgccattttccccatttctcgctacagtgcaaaaccgcgccgacgaagctagggttcaccaatccgctccaatccatcctcaaaaactccgtgaaatccttctgcacgaccaccgcaccgattccccatccccttcgagccacatctcggaccaaatcaaaccatccagttcacatccatggcggaagagagagaaagctttgagagtcagtgggcgccctccgacgtgaccaaggaaaatctgaaagaaatggtggcgcacgacgttcttctggcgaaagagatcatcgggtggcgaccagcattcggcgaagcgttcccgacccatgatacacatgaagttgtggtattttctcacttcttctatggcggtttttctcttccaacctcaagattcttccggggtattctgaatttctatgggattagcatgcatcacttgaacccaaactccaaagttcacattgccaattttattcatgcctgcgaagcttttttgggcactaggccacacttcgccttgttccgccgcatcttcttcctcaagccccaaccgaacaagagcaaaccatgcgtcgttggggggggctagtttccaacttaggggaactttgagccaaaaatacttctccatgcccttcaaaacctcaaacaaaggctggcatgtgaactggttttatgttcaaaaccctgagcctgcactcccggagtacttatgtctccccccagtttatcaggacacttgtaactcattgcctatgggagatgaagctgctcaagcactggaactgatggagcgcatgataaagctgaaggaacaaggtctgcaaggtgaacagatcactcggcactttatcaagagtcggttagctcctattaaggcgagatctcgtacagccttcgaatttgatggcaagcacgacccaaaccgtgaagatccagattctcttgattttgaggtcatgaaggagagaatgtacaagatcttctcaaatgctatcgtagtcagctactcacacttgctgccggtagtgccgtacaatgtattcaatcctcctccaccggtacatattcaaacatctcaacctccctcaaaagcatgatctcatctcttgttaaattgtttgacattcatgctcaggagttcgcgttgatgaagtcggatcctccaatcgctcagcgccgatcacctcgccttcaaactggtcaggaaagtggaggaccaaagattcggtctgaaacccaaccaaacacctctaatccagccggccagtcagattcccacaagaggaagttagttctgagtgacgacgaaggcgatgatgccagaaaacctgaagataaaggggcgaccggaaaactaccgaagcaagccaatccaaagaagaaaacatccagttgtcctatgccgaaaatcaggaagtcttccaggtacaaatcatataacgatcttccttgtattgatgctcacccatcatgaaaatgatactgatagcacaactcaaacttgtaggaaaccatctgatatagatccttctgggaaagactcttatccgactaacatggagacgggctcctcaaaagaaactgggccgactgcaaaagatcatccgagtgacaatcagccggcaaccgacaatgtagaacccagcaacgaacccccgactggaagccagtcggccgaagctggagccgaagttaaccaggagcccccgactagaaaccagtcggacacagggccaagccaagagatctctgaagttgaagctcaagcaggcagccctcccggaaaggatgccagcaatggcccaggatccagatctcctgtaaaggcacaagagtccactcgtccccgtcgagaaatcatcacaggtaaacacattatctgaaatcattttgatccaacagactttattcgattgtttcacctttattcatggatacattagggccaatgattggtgatgaagaagaaattctccggatacgagcggctgaagattcgcgccctcctattctggtcaagtggtgggataacgatgggatcgtaataaataagcaaaaagaagatgaggaggtatgcctgctgaagaaggcactcagccaggctactcgcattgtaaacgtaagtttcttgacgcccgacctcaaccatctgttcgccatttagctcaagcgctaataaaactgttttgcagaggattcatctcaggaacgaagcaaaaaccgcaaccctggagaaattagttcctcatctcggcacccttgaggccaccagaaatcaactgcacgaagccaaagaacttgccaggaaaactaagcatgatctgagggatcggattgctgaggtccaggaatccaattttgaactgagtggctcatcaaaaggtacacataaactctgtccaactaacttgtgctgctatctttgtaatttcgattaaccggagtcaatatagtgcaagccgccaagatatctcaactggagaaacagattcagactctggagaatgaaaaggctgaactagcaagacagagggactcggctttgaaagatgttgaaggtaccagtaatcaatacttcaaaagccatcattttctttatgctgacttattaatgtgaatctgttgatgcagaccgcaagatcaagtcacaagctcaatttgacatcttagtcggcaaaatcaaaaggcttgaaagggctagggatgaagttgctaatgctgctaccccactcgagtacattcgatgctcccgaaatcttcgacaagctgagtgttgctccggattcttatttcaagaatatcaaagaggctgggagtatgggagcgagcctggctttagcgatgaccaagtccctatacccgaagatcgatattgacgctgttgatggctttgcagacgggacaagcgaagaagctgctcttgacctcatcaatgacgcacaaaaagccatcgataaggtagcggttgatgtagttgagagattgcaggacaccgatcttcgaccgactggtcctgataactctgatgatgaaaagactgatactaattgatgtaatttgacaacaatgattctgatgatgatgatggaggcacaatttgtacaatactgatgaatttatgctgtgctcagtatttcatacctagcttctgatttcttaaaagcttttgtcaaaccttattgaacctaaaacccgcaaaagctattaaaaagctttcagtcctcatggactaatccgaaaaatcaagcaaggcaatgataaatcaagtaagcaaattgaattgataaagatcacactccattattattataatagcccccgactgataacttcaagggggagcttgatgttagcagtcaaaatagggaaatacaaaagtaaaacttaagcataaaaacgatgaagatgttcgatattccaggagttgtcgataggtgtaccgtcttcacgcttgagtcgataggaacctggccaagtgacttctaagattataaatggcccttcccataagggggataacttgtgccgatatcgtgtagtttgaatttttcttagaaccaggtcgccgactaagaaggttcatgatcgaatgttacgattatgatagcgacgcaacccttgcaagtatcgggccgactgaattaaggttgcttcgcgggcctcttccagtcggtgtagatcatccactcggtcttctttgtagcgctcctcgcgaaagttacgaaaatgcagagattcaaattccaccttgctaggcaacattgctttggctccataaactaggaagaatggcgactagcccgtagcccgactgggggtggtgcgcaaggaccaaagtacagatgtcagctgttccacccatttgccggcatagggattcagtcggtagaaaactcgtgcctttattccttgtagacccatgccgttggctcgtttgacttgtccattgctcataggatgcgctacgtgggcgtggcatatttaaacgccaaagtcttcacagaagtctttaaatactctgctagtgaattgtgtgccgttatcagtgatgatccgattaggtactccaaaccgatgcacattgttgatgaaaaaatctctagctttgtctgccgtgattttgatgaccggtttagcttcaatccacttggagaatttgtcgacagccacaaagagatgagtgtaaccttcaagcccccaaaccgcaaacggccaggacaacgggatggtttgcaaatcttgggctggcagatgagtttatctggcgaaaaattgacaacctccacatgtccgcacaatcttatcagcatcggacacagctgtaggccagaaaaaaccttgccgataagccttgccgacaatggtccgtgcagcagcgtgattgccacaaataccagaatgtatatccttcaataattgtctcccttcctccaaagacacacagcgttgcaggattcctgatggacttttcttgtacagctcggtctcatgaataatataaagcctgctgcgcctggaaatccgctcggcttcatctttatcttgggggagttcttggttggttagaaatcgtataaggggctctctccagtcggcttcaaccatagctatgtcttgagtgtccgtggcctcaactatttctttccttggtacggttggttcgtaaagatgttcgacgaatttgtcggaaggagctgcttcgcgtttggatccaaaatgtgctagtctgtcggctgcttcgttattgtgccgaagaacgtaagtgagttcgagtccatcgaacttatcttccaacttgcgtacctcttgccgataggcggtcatgttatcatcaaggctggaccactctttcataacttgattaacaaccaactttgaatctccacgaactatcaaacgcctaattcccaaagagattgcaatccgtagtccgtgaataagcgcctcgtattctggcacattgtgagatgcagaaaaatgtatccacaacacgtaacttagtctttctccaatcggggaaattaaaacaaccccaacaccagtgcccgaaaatctcttcgacccgtcaaagtgcatagtccaatactccatcttctcatcgggcgttgttgacagaaaacacgaggccgttaacaggcgtatcctcttggcactcggcgacgaaatcggctaaagcttgggacttgatcgaagttcgcggcttgaacgatatatccaaggacatcagttctaaggcccattttgtgatccgcccgtttgctttgtgattatgaagtatatcgtcgagcggaaacgatgtaaccaccgtgaccgagtgaccctggaagtagtgagataatttcctgacggtaattagaacaccatataacagcttctgaacttgaggatatcttgtcttggagtcggccaaaacctcgctaacgaagtagattggtcgctggactctctgaacatggccttcttcttcacgctcgacaaccaataccgtgctcacaacctgagaagttgccgatacgtacagtactagcggctcttgcggatgtggtgaggccaaaattggtggagtggtgagaagtttcttgaagtcttcaaaggctttctgtgctttgggtccccactggaaattgtctgttttctttaacagcttgaagaagggcatcctccgctcgccgagtcgtgaaacaaactggctgagcgccgccatgcatccagtcagcttttggacatctttctgcgaactcggcggtttgatgttgaggatggcgttgactttctctgggttggcctgtatgcctctatgagacaccataaatccaagcagcttccctgacggtactgcgaaggtgcatttttcagggttcagtttcatcctgaacgcgcggatgctcacaaaggtttcttccaggtccatgatcaaatcatctttctgcttggtcttgacgactacgtcatccacataagcttcaacgttgcgaccgatctgagttgagaaacatctctggatcaagcgttgagaagttgctcctgcgttctttaatccaaaggcatggtgatgtagcagtaggccccaaagggcgtgatgaatgaagtcttcaagcagtcggattccttcaatcggatctgatgatatcctgagtagcaatccaaaaaactgagtagctcgcagccggcggtcgaatcgactacctggtcaatgcgaggcaacccaaaaggatctttggggcaagacttgttgaggtcggtgtaatcgacacacatgcgccattgcccggtcttcttccgaactaaaactgggttagccagccagtcgggatgaaggacttctttgatgaagcctgctactaatagcttggtcaattcctccttgatcgcgtccttcctgtcttgtgcgaagcggcggagtcgttgtttgatgggtttagcgtcttccttaacatgcaaagagtgctcaatcacctctctgggaataccaggcatatcggatggttttcacgcaaagatatctttattattttgaagaaaggtgatgagcgcgctttcctatttacaatctaactcggggcctattacagcagttttagtaggatcagaaggatctagaggaattttcttggtcttggcttcgctttctccactctttgagatcttggttgaaggcacttctccttcacttgccatggttgcagccagtcggatgtcttctcgggcgatcgcgatctcgcgggtttgggccatctcgcagctttccttgtcgcatgtgacggcttgtttgatgtcgctccgtagggatatgactcctcgaggacaaggcatcttcatcatcatgtaggtgtagtgcggaacggccataaatttggcaaacgccgggcgcccgggtatggcatgatacgctgtctcgaagtcagcaacctcgaagcagacgttctctgtgcggaagttctcccgagtaccaaaggtgaccggaagagtaatctggccgagtcgcgtggcggatagccctgggatgactccgtggaagggcgcattactcggcttcaactcggtgcgagggatctgcatgtgatgtgaccatggctactatggatacaaccattgctcacatcatggatgaacaagatgatatcaagatcaagtcctccaagtgctggaatcagattcagccacctgctacactgctgacttcaaatggccgccgaatctgcatacgacctccgtttttggcccatgagtacttgatggaaagctctcggagtcctctttccaacggatctagcatcatcgccaaattccatccaagtcatccatagatgaagaaacaaggtgctgcgtcacctgtcatgagcctgtgggcttgtaacttcatttgggacccggcccaggtggggcccatgtggggtgcgccccaagctggtggagcacgaccctaggcacccctaggtcgtcctcccacccctatatatagctagttaccccttcagggtttctcgggttttgatagattaaagtttagccattgctacttgcttgcagcgcgcgtgtcggctagaccgtccgtctgcttgttcttcggaaccccaacatatcatttgtattaaattcctatttgcaatatcagattgcttttatcttgttcttgcttgtttcttcaatttgcttgcaggaatagggttgatctgcaccggcaagatcaacaatccacggagaggtgtatcgatcgctaaggcgcaacacaatgtctcgtatggttgtagtcggatcgtcaacgtttctcccaaatcgtagttatcataactcaccgaaagatcgggccaacaacagccttgagtgtcgagaggaactcaaggttcatcaggtggtatcagagctttcattgctcggtgagttttaatctacccataactagaaaattgccatgaaaaaattgtgccattgcattgtttttattagtttttgctttgttgagttttgtgttacatcgtcgagtcgagttgctggtgttagcgtctagttcgtttacagatacagtcgtcgtcacctccgtgtatctgttgtcgtcgggacctacgaaaacggaatcggctcgctgccacgattctatttttgtagttttcaaaagtttttaccgggttggtttttgcagttgttgagttgcatcttgggtttgctgaccgacgtgcttctgttttggccgtgcctgtgtcgtgcacgagaggaggaaggtgaattaccatatctgattttggaagtagtcaagtttgttttggaaagatatagtagattggattgattaaaaatcagtttcctttttatcccatacaccaaattcggctgccatccactccacctcctggccgactcccactcgcccctttggccgagtccgactccctccctccctttcacagttccgagttttgtcaaacaccttggtgaatttttatttggtgtcggtttcgagatctatttggaaaaacagaaccggcataaattcagcattccatttttgtataattttaattttgggtttagacttttacatttgtgtccctataatttttatatttacgtttgagtccctgtagcgttacattgacgtccttgaatctgtttttgtaaaaaaaatcaaaaaaaaagaaagaaaaaaaaaggcagaaaggtgcaaaaaaaaaagcaaagaaaagccgcaccctaaaaaaaagaaaagaaaaggaaaggaaaaaaagaaagaagaaagaaagaaaagagaaaatattgttatgtttgagctgaacttcatatatgagagttgtgcatgagttgttcctagtgctatcttatcgtattgtttgtgtctaggctcgcgtctctagtacgttctagcctaggaccagcacgatacttgactttgaaccattattcaactttgcattctctgatttgaaccattgctttcctttgctacatattttaagcctacccagagctctacagatttgattgtagccgtacagcaagtgcttgccaaggcatcgatacatccaacctccattggggtgcttggttgagtcggtgtatgtcaccttttcgcttgcattggtaagaacttgtaagagcttggttaaaagcttgagtgtgtttgatatttgagctgccactacttagtagttgataggagcgtgcatatatttgtgtatgtttcttgtttgctactaaccatggcaggattgcgaaaggggaaacgagatggtcatgctcaacatcgacttcttcaccatcaacgagatatattgtcttcttcacgctttgcatacaaggtacatgataacgatcttgcaagtgtagaatctaatttgcctgtttttgatggtaattatgattccgccgctaatgttaattgggagctagcagtagacaaacaatttgatgagtatgatttctctaatgctcaaatgattaaggctgctagtaataagtgtactggttctgcatcttcttggtggtatactgttggcaataagcttgaaacttgggatgaatgcaaaacaatgatgagaaaaaattttgtgttttcatattataaacgtactctccttgagaaattagaacatctaaaacaaggtgacaaaaccgtgcgggagtactttcatgactttaaaatttgtatcacttatagtggtttaaaagaaagcaatgagaacacaatgactagattttttagagggcttaattctgatattcagactgggcttattaatgtgacatataatcatataggccatttgttgacgattgcttgcagtgttgagagcaatattttaaagaacccaagggagaaataagctatgcttgtgcctcctattactgacactttgcagggagctcagaacattcaccatgaggagaagagcaatatgctcgagatgtcatctccatcactcacgaaggaagaagagaagactgatgcacctacattatctgaagagggcataaaaggtaaattaaatggtgctggtattactcaaggtgagtgtgcttctgatgagtcacatttgtccactatccatgctaatctagagcaaattttggtggaaactacttctgatttgcctttgtcacaagttgatttacttgctgttccttgtgataaagaagagttgtgtgataatgcttcacttatatccctaccacaactagtgaatgaacatgctatttctagtgtttctttgtgtgccgattttaagcatgttgttcacattgctaatgatgtacaggaacgtgaattgctatcttctttaaatattttgggctatgttcagtttgatgatttttgtgagctcgataatttgaagaagaaattatttgctaagtctgatttgccttgtccaactagtgctatttttcatatatttggtgaatctgatgatagaggaatatatttggtgcatagagtttacatatgttcagattttgaacctcctatacatatggataaaacatgcaagctagagagaaatgttattgctaacaaaattatctcgagtttgtcttgttttgatttgatgaaacaggttgttttaaatcgaccacgcgttgagcaccatatggaaaaaccgaggacggttttccgtgaagaaggggaggatgatgtgaccatggctactatggatacaaccattgctcacatcatggatgaacaagatgatatcaagatcaagtcctccaagtgctggaatcagattcggccacctgctacactgctgacttcaaatggccgctgaatctgcatacgacctccgttttcggcccatgagtacttgatggaaagctctcggagtcctctttccaacggatctggcatcatcgccaaattccatccaagtcatccacagatgaagaaacaaggtgctgcgtcacctgtcatgagcctgtgggcttgtaacttcatttgggaccccgacccaggtggggcccatgtggggtgcgccctaagctggtggagcacgaccctaggcacccctaggtcatcctcccacccctatatatagctagttaccccttcagggtttctccggttttgatagattaaagtttagccattgctacttgcttgcagcgcgcgtgtcggctagaccgtctgtctgcttgttcttcggaaccccaacttatcatttgtaataaattcctatttgcaatatcatattgcttttatcttgttcttgcttgtttcttcaatttgcttgcaggaatagggttgatctgcaccggcaagatcaacaatccacggagaggtgtatcgatcgctaaggcgcaacacaacggcttgtacagttgtagtcggatcgtcaacgtttctcccaaatcgtagttatcacaactcaccgaaagatcgggccaacaataaccttgagtgttgagaggaactcagggttcatcagcatgtcgtccagggtcttgtcgaagaggatattgagtgcgctgccgccatcgatgagggatctgcgaagcttgacattgcgaaccactgggtctagtaccagggggtacccccccgggtggaccactcggtctggacgatccgagcggtcaaacttgattgttgtctctgaccaccgaagatattggggcgtatcgggctgaacagcgttgatctcccattcagtcagcttttgctttcttttagactcgtaagccagagggccaccaaagatgtgattgagttccttgcgatggtcttgaaaacctgtcgaggcatcatcattatcatccttctttttcgacgtgctttgatctccatcggaggtcttccgtgcattcttggcatattgctccgcaaactgtttgtagacgaagcaatctttagctgtatgattggagttgggatgatgcggacattgggagttcatgatcttgtcaaaagtgttgacgcgcgaacgttgtcgggaggtgtgtgtagtagtcgcaccaagttcctcgggcttactcttgcggtccttgtgattgttacttccaccccctcccatagtcggcgcatctttctttggcttccaggtgggacccgactgcttggatgcgataatggcgtcttcggctttggcatactcgttggctttttcaaacatctgtttgaccgtcttgggaggcttgcgcccgaacttaccgactagatcttcgtgacgaatccccttggtgaaagcagcgatgatgacatcgtcggtaatgtcagagatcttgttgcgttgttcagagaagcgtcagatgtaatctcgaagggattctccagacttctgaatgacgttgtagagatcaaactgtgtgccagggcgttcaaaggtgccctggaagttggcgatgaagtggtcatgaagttccgcccatgatccgattgtgccacagggtaaccaatgaagccaggaccgggcagaatccgctagggccacaggtaagtagtttgccatggccttgctgtctcctcctgctgcgcggattgcgagaccgtagacggtaagccaagactccggattagtggtgccgtcatacttcttgattccagtcggcttgaagccgggctggccaatccactcgacgcaggtcgttagtaaaggcagctactccatccacgtcgtcgtcgtagcgatccggtgaatggcgatgggcatggcctcgtgctgcatggcgctggttgattgtatcacgaagatcgacagggcgcctacaaggtggggagcgaggctgttcaactcggcgctccctgtgtcgcttaggaggcgagtgaaccgatcgctcgttgtggcccctgctcctgcgattggatcctgcgccggcgatgctgaggcttggctggtgataatcttgagatcgaagatgggggacccggctgccagtcggcgtgcggacgcttctggagttaaccgggaccgaggcagcaatcatggtcttggtctggttcaagatgttgacgacgtggtcagcttggttgagtgcgtcttccttgaggatggtgtcgaggagggtgatcgccgcaacagcgttctgttgagggctacagaagaccgccgtcccctcaacgtcttgctgcccgatgagatctcgcgctcgtcgccctgcgtccaaggctcgttgtcgtcggtcctcggcctcctttgtagcccgttcgtgttcctgttgctcacactgcagccgttcttgctcttgtgcttggcgctcctcttccagtcggcgtcgctcggcctcctgttgtacgcgtcgtgcttctgtttctcgggcttggcgttgttcttccgtctcgttatcggccatgaagacgtcgaaatagagaggggtgtagttatcttcaaagctttcgtcgaagtcgtcgaggtcgcggttgtcgtagcggtagccgaattcgtcatactctatgatctctgttggtcgtgagtcgacgccgggggagctgaagtagctttccaattgatccgtcgaaaccgtgccgagtggctggagtatgacgctgacttccttggagctaggctggatcggtgttgaagccgaattctgcctaggcctacggggagaagacgtccttttagtgaaggtccactttgcaatccgtccatttgcttcgcgattatgaagtatgtcactgagtgggaacggtgtgaccaccgtgaccaagtgaccttgaaaatagtgggataatttcctgacggtaattaaaacaccatataacaacttttgcacgtgaggatatcatgtcttggagttggccaaaacctcgctgacgaagtaaattggtcgctggactttttggacatggccatcttcttcacgctcgacaaccaggaccgtgctcacaacttgagatgtcgccgacacatacagcaacagcggctcttgcgggtgtggtgaagctaagatcggtggagttgtgagaagtttcttgaagtcttcgaaggatttctaagcttcgggtccccactagaaattgtcgattttctttagcaacttgaaaaagggcatcccctgctcaccgagtcgtgagacaaaccggctgagcgccgccatgcatccagttagcttttggacgtatttctgagaacttggcggtttcatgttgaggatggcattgatattctccgggttggcttatatgcccctatgggacaccataaagccaagcagcttccctaacggtactccgaagattcattttttaggattcaatttcatcctgaaggcgcagatgcttgcaaaggtctcttctagatctgtaatcaaatcatccttttgcttggtcttgacaactacttcatcaatgtaagtctcaacgttgcgaccaatctgagttgaaaaacacctctggatcatgtgttgataagttgctcctgcgttcttcaatccaaaaggtatggtgatgtagcagtaagccccgaaaggcgtgatgaatgaagtcttcaagcagtcgaactcatttaagcggatctgatgataccctgagtagcaatccagaaaactgagtagctcacagccggccgttgagtcaactacctagtcaatgcgaggtaacccgaagggatctttaggacaatatttgttgaggtcagtgtaatcaacacacatacgacattgtcctgtcttcttccgaaccaggactgggtttaccagccagtcgggatgtaggacttccttgatgaagcctgctgctagcagcttggtcaattcctccttgatggcatccttcctatcctatgcaaaacggcggagtcgctgattaatgggtttagcatcttccttaacatgtaaatagtgctcaatcacctccctaggaataccaggcatatcagatggtttccacgcaaaaatatctttattattttgaagaaaggtgatgagcgctttcctatttacaatctaactcggcgcctattacaacagtcttagtgggacagagggatctagagggattttcttggttttggcatcgctttctccgctctttggtaacttgggtgcaggcacttctccttcggttgctgttgatgcagccagtcggatctcctcttgagcgagcgtgatctcgcgtgtttgggccatctcgtagctttccttatcgcagctgacgacctgcttgatgtcgctccgcagagatatgactcctcgaggtcctagaatcttaatcatcatgtaggtatagtgtgggacggccataaacttggctaacgccggccatccgagtatagcaaggtacgctgtctcgaaatcagcaacttcgaagcaaatgttctctgtgcgaaagttctcccgagtgccgaaggtaaccggcaaagtgatctggccgagcggagtagaagatagcccggggatgactctgtgaaagggcgcagtactcggcttcagctcggtccaagggatctgcatgtcatccagagtcatggcgaaaaggatattgagtgcgctgccaccatcgatgagagatcgttggagcttgacgttgcgaaccactgggtctagtaccagggggtaccaccccggatggaccactcggtcaggatgaaccgagcggtcaaacttgatagctgtctctgaccaccgaagatgttggggcgtatcgggctaaacagcattgatctcccgttcagtcagcttttgctttcgtttggattcgtaagccaggggcccaccaaagatgtggttgagttcgttacgggagtcttaaaaaccagtcggggcatcgtcttcatcatccttcttcttcgacgtgctttgatctccgtcagtcagcttccgtgcgttcttggcatattgctctgcgaactgtttgtagacgaagcaatctttggccgtgtgattttaattcagatgacgtgggcattgggagttcatgatcttgctgaaggtgttgacgcgtgaacgttgtcgggaggatggtgtagtagttgccacaatttcttcgggcttacgcttgcgatccttgcgattggcacttccactcccccctgtagtcggcgcatctttctttggtttccaggtgctgcccgactgcttggatgcagtgacagcgtcttctgctttggcgtactcattggccttttcaaacatttgcttgactgtcttgagaggcttgtgtccaaacttgccgactaagagttcatggcaaatacccttagtgaaggtggcgatgataatgtcgtcggtgatgtctgagatcttgttacgttgttcagagaaacgtcggatgtaatctcggagagattctccggacttctggataacgttgtaaagatcaaactaggtaccagggcattcaaaagtgccctggaagttggcgatgaagtggtcgcgaagcactgcccaagatcgaatcgtgccatggggtaacccgtgaagccaggaccaggcagagtctgctagggccactggtagataattagccatggctttgctatctcctcctactgcgtgaattgcaaaactgtagacggtgacccaagactcgggatttttcatgccttcgtacttctcgattccagtcggtttgaagctggttggccaatccactcgacgcaagtcacttgtgaaggcaacaactccatccacatcgtcgtcgtaacgatctggtgaatgatgggggatgtggcctctcaccgcacgacgctggttgatagtatcgcgaagatcgacgggacgcctgcgacgtggagagcggggctgttcagcctaacgctccctgtgtcggtcggcaggcgagtgaatagatcgttcaccatggtccctgttcctgcgactagatcccgcgccggcaacgctgaggcttggttgatgatagtcttgagatcgaagaggcggaactcggctgccagtcggcgtacggacacttgaggcgttgactgggaccgaggcggcgatcatggtcttggtctggtttaagatgttgacgacgtgattgggtgcgtcttccttaagtagagtgtcaagaagggtgatcgctgctatcgcgttctgctgcggggtgtgaaaaaccgccgtcccttcaacgtcttgttgtctgataagttctcgtgctcgtcgcccagcctccacggcgcactgttgccggtcctcagcctccttcacggctcgttcacgctcctgttgctcacgctgcagccggtctcgctcttgtgcttgacgctcctcctccagtcggcgacgctcggcttcttgtcgcgtgcgcagttcttctgtttctcgggcttgacgctgttcttccgtctcgttgtcagccatgaaaacgccgaagaagagaggcgtgtagctgttttcgtagccttcttcgaagtcgtcgaggttgttctagtcgtagtggtagccgaagtcgtcgtactcgaggatctccgtcggtcgagaatcaacaccaggggagctgaggtagccatccaattcttccgtcgaaactgtcccaagaggttggagtatgacgccgacatccctggagcaagactggattggggccgaggccggatcccgtctaggcctacagggagaagacgcccttgtggtgaagacagcagccaaatcgtcggggaggttcatcaggattgagggataggccccatcgtcttgatcaagtcgtgtcggagtagattgaatctcgtccgagtggtttgaagccgactcggttgagatgatcttggagtagatctcggccgagttcgggataccgaacggggcggagacctggcctctccctgactggttcgaatctgagtcgaggagagaaatcttgccgaagtcgttggtgatgaagtcgaggttgcccaaccggaatgcctgcccgggagggaagacgaagtcattgatatcggagacgaaacccatcgcactagtcagcgatgaacttgacgctacccctacctggtgcgccaactgtcgaaacaagatttcggcaatactaaaagggggtggctatcaagatggaaaagtggatgggtttagagacaaagaattttatacaggttcaggccttcttaataagatgtaataccctactcctgtccggggattgatccgccgagtgtattattgatcgtatgatctgggagaaaaatcgtgtcccaagaggcacccggacccctccttatataggggaaggggtccgtattacaaagtacaacccatatctctaacggaataggtagttacagataagatacaatcgtaacctactagaatcccgggtgcttccttgatatacaagtttagacatttaacccgaaaccttttaaagatattctatctatacatagtacccccatactaagtcgaatatacatgccgtgtgggtatggggtatccataatatccacatataaatcaagaaatccaaaaatagaaactctaactcttatccaccgccgtcttcgctcccgtgcctaggaaccgtcgttgtttctacggtagtgctcggagcacgtgatcaccaccgctccaaaggctgccatggtcgttagtggtcactccctttccgagcggccgcggatccaccacttccgagctggaggaacaccgcggctgatatgccattcttgaaactgctgcttactcaaggccgccgtcgtcgtccccgcagttccggtggcaaaccacccctccctagggcagcaatgccggatccgccgctcttgaggatatcgttgtcatcctagttgtcgccattgtcatcacatcttctcgtagcgctagatccgatgcctccactgccattagatcgagccatcgtggagctgccactgccggatcatcacatcggggatccaacgatggcggatccactcgtcaagcggccagcgccggtcctatcaccgccctctcctaccacatgttcctcctgaggcctctggtggctggttgtcgaggagtggtgagataaagggaggagacgaaatgagaggagatgaggaaggagagactaaggagaggaaaataaaggagactgtgagaaaaaaggggaagaacatgagagaaaaggagaggaagagatggatttgtggccacatacgaatgcagtctctggcttcttagcaggaccatatgtgaaaattgattttcctaatatgtcgttactggatactgtatccattatagcctgtttgtaaaaataaatgaggcatctaagaaaaaaatcatttttagtaatgcgcccagcaggttgagcactcttaaacacatgtatccctctatttcaaaataaaggaccagaattccattaattactataaaagttatattggtgggtgatagataagggtatttaagggttaaaatttctcaaactgtggatcgatagtaagtaagaatataggtgttgaagcccgaactcctctagtggagagaaaggacacccctttcggtttcgaccaaggtacttgtgtcatagtaagggcttgtttagttgacaaaaaaaaattacccctgcatgttacatccgttatacggacacacatttgaagtattaaacgtagtctaataacaaaataaattatagattataccaagaaactgcgaggcgaatttattaagcctaattaatccaccattagcaaatgtttactgtagcactacattgtcaaatcatggcgtaattaggcttaaaagattcatctcgcaatttcttggtgaactgtgtaattggttttttctacatttaatactctatacatgtgtccaaacatttcacgtgacattgtgaaaaaatttgtttgggaactagacaaaccctaactgttgatgttgcggacagcagaagcaaagtcgggcatacgatgtactgtatcatagtaactgtatcttggagcggatcaggaatgagaactctatttcttgaagtatgatgagctagaactagggccatcaatgatagtggggccagcagctgatggggccacaacttgcaaatgtacaacggatctcgaaaagtttcgtcccgatagtttaaaaatggataataggtcattcagcgtatcattaacaaaataataataacagcaaaataataataacttatatataaaacttttatatatgtattttagtgacttaaaataccaatactgaaaaataaacttcgatgaacaaacttcaaatattatatttaagttttaaaatttaaattttagcggcgactaatgctgtatggagaaaacgatggggcctttcttctccagaaagttttatttttgttgttgaatggtcgaattgttacaaaatagttcggaacagaacaatatatttttgtaggaaaaatacacagggaatgtgcaaaatttactaaacagacaatatgtttccgttgaacaaaggtagtttgttaactttttttctaagagaaacattagtgtgccgtcggtgtgttttgaccacagaaactgaatgaaatatttagttcgataactgcagcgtataatcgattttggtgggacccacaaaaataaatctcaatcccacctctatccactcctctcctctcgcgaccagccggaaaattccgcatgcgcacgttctcgttttccctcgttccccttcctttgccctctccctgcccaaacattccaaagctccaatccggtgataatctctccctgcccaaacattccaaagctccaatccggtgataatctagaaattaacccatggaggagagcagatcaggtcaaccagctatggatccaactagatcggatccttcgcggtgctcgtgtggctcgtgctcgtgctcatgtgggctgttgcacatgatgccatggaatcagtatgccgccgcatacggcgccgctgcaagctggctccagcggttgtgttggcgagtttgcttctcgttggcacggtcgtgcatcaacgaggtcatggagcgcaggtaggaaatggcaccctgggggatgcgtattgagggcctcaacaaacaacaccttgatccactaccaccgtcggttaaaactaattttgagtattataggagataagctcccgagtcccaccagtgctataaatagaagaaccgtagagaggagtgaatgctctaatctctcgccaaaccctaaagccgtgacgctatctcagccaacggcgtgaagaaggaaagcaaagccgaaggaagaagaagaaaaggcaagaagaaaaacagaggaatcaatttcaatggcttctagtgcaggtcagtagattaatttgtaattcgagtaaatgtaattgcttataagctaaagtaataagatcctgtaatttagaactccaacattgtggtatcagagctgatcttttacctaatccatccttcataatctcatcatccctgcctaagccatatttgcctttattttaaaccgagaagtggttcagcttgatgaatctttaagtgatatgagtccaattaaggttttaagctctactgttgttgcattctaattttattttgtcgagcagtagaggaaagatggaaggaggggataaactagattgaaattcctcaaaaccgtgtcactaaatttgtggagactagacacgctatcttcttagaaaataataaagtagggaactcaaaagataaggagagtaatcttgaagaaatccgggctaatgctccaatactggaaatccgagagactaatattccaatttttcaagctgtgccacagaatgtagtgccgccaacaacgggtaattctagaccctcttgctctaaaactactgtcggagggtaaactccttgagcggggcactgtggggacccccttccttgttcgaaccagggacacgggtgaggctttgagagtcgatgttggaagatgcagaggggtcgggcccctcgggaatgatggagacacaagcgatttagacaggtttggaccgctgtagaagtgtaataccctactcctgtatgtggttgattctggtgggagaatacaaatgctttctttctctgagttgcgacccccccccttcactcaggcatagacctccttttatatcttaagggattaccacaaaggcccaagacctagcttcaagggaaaggaaaacattctttacaggtaattaatgggtgtcttgtcctcccgacgtgtgaagccacgtgagcctcaccgcagcatcggccccatcccatcacgccgagcgtcacgggcggacgcacatgtcattccttcttaattgttgtcgactttcgactgtccggccccacaattgggaggggatctctcaaacggaccagtttgggaaaagctggtgcgagtccaaatgagaggcatgaagccccacattaatggtgacaagacgggggaggcgcaggccacgccctctgctagccgccgtcacatttgtcattccggttgcaagtggcccattagtgtgccgcagctgacaagacctctttaaatgcggtaggctggcgcggggagcacccgcccaggccacatatgtgaaacagagcgtggagggggtcagggtggcccgacacctagaaagaatgggaagtagccgccgctccaactccgggcccgacccccgaggggggcgccacgtgggcttggggcggccttctccctctatacagggtaccccggtttggcccgggcggtgtcgtggtagctgaaggtgcgcggcaacggattagacacgtatggacgatgtacaaaatcgaatacatggaatccttgcttcttttttttattataggtactataaagatagattatagataaaggtaaaatattaaaaaaccaactcaaatatggataacgtaccaaaaatttggtggaaacagcttcaatttttataatagtagatagataggatgtatgcaacgtttttgtggtgttcagataatatagggtgctcttgtggtgttcatattggcatttgagaaaagtgggcctgaaggactgatctgggggagcaatttggatggaaaatttaggcgcactatacgtggtggtcggaaaaaaaatcacgcctactacggggacgatgtaagaaatttttttttggcaaaaacatgttaaatttttataatagataaagaatagacttgatttactcagcctatgatcatgatttttctatccgagtaaagcaatattgatttacttggattctatataaaaaaaataggaacgacatatatattacctgaagctagaaactaaagtttgcgtgtgccttatctttagctcttttttttctctgattggtgcggggacggagtcggataaccgaaaaaaaatcgtgcactgtacggagacgaagtcagataaaaaaatacgctactttgcatgacgtacgaaatctagtggcaaaaataccttgaatttttataatagatattacctgaagctagcaactaaagtttgcgtgtgccttatctttatctctttttttttctctaattggtgcggggacggagtcggataaccgaaaaaaaatcgtgcactgtacggagacggagtcggataaaaaagagtcgtataaaaaaatacactactgtgcatgacgtacgaaatcagtggcaaaaacaccttgaatttttatataactaaaaaaatacctgtacgttgcaacgggtaaagatg

SEQ ID NO: 14280 - DNA, 711 bp, Oryza sativa
agttggcaggtggtgatagccctgaatcccgtcctagtaatcctccacgttcggatacatcatagagctatagccggaaccacgctggcagacaagcaggggtcggtgcctgaagcaacagatagggaattacctttacttagcttaaataattaaaaatacatagagagtcctctctagcctgcctaccatcagttgctgtccttggatagtctcagccttaggtagattacacacattccctgagttcgatatctttttggggtcacctgaaggtgaagtgctacaacggtattccgtgcgcttgcggatttatctgtggtcgtaagaaataccaacaagcatttttggcgctgttgccggggaacggttgctaatttatccgagtctaggtcatcctcatatctttatttttacttcttcttgttttattcctttccttgatggagcaacccacaattcaaaacatttctgctcctcgggctaatctttgtgagtcatcctattcttcaaaaccaatcctttcaaatggctatgaaatcggtcctggctttatagccatggtttgagagcaaaccttctctggtggtattagtgaaaacccatacctccatcttcaggactttgagctagtgtgttcttgcctatccatcataggcatgacacatgaaactcttaagtggaaattgtttcctttttctcttagagatg

SEQ ID NO: 14281 - DNA, 484 bp, Oryza sativa
gttagtgtgggacccacgtgggccccacatgtcaagtgtccacgtcagccttctttccctctttcccctcttctctcccttcctcatctatctctgtctgtctctctctctctctctccctcccttccttcatcatcttcgtcaacgtcgcggcgaacccacggcttggcgaggccgcgctccggcgggtcggcacgtcggcggcggtggtggaccggctggtgaagatgctcacctggaacggcgccgtactctgagctggtgccagcccatacccctccgcttcatgccccctgagcaccacatcggcgccgcacttctcgccgtcgtcgccaagatggtacacatgcacctcatccacacaggtcttggtagccaccatgtaccgcctttgcggcatgcagcgggcacgggtgacctcgcccttgtgcggcaccgagcgggagatggacacggacgaggctgggacggcaccgcccgccgc

SEQ ID NO: 14282 - DNA, 208 bp, Oryza sativa
aacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggatta

SEQ ID NO: 14283 - DNA, 1342 bp, Oryza sativa
tacttattacatgtgtactttaatgttgccaaagacagtgattgataacattgacagagcaagaagacattgtctttggagaggctctgaggtcaattccaataaaagatcttttgcagcctgggataaagtttgtaagcctaagagaaaaggtggtttaggagtgctaaacgttactatccaaaatcatgctctgctcatcaaatttttggacaagttttacaataagaaagatttgccctgggtcaattttgtttagtctgcctattatggttactctgtccctcatctgacaaacttgaaggactcattctggtggaaagatatttgcaaactgatggatgtctttagaggtattgaaaagtgtaatctgaaaagtggaaatacctgctccttttggtatgatgtatgggatgatcaaccccctctttttcacactatgccaaggctttgttctttttctcaaaaccagaatgcatctgtctctgattttctgtccattgaggctgaagaaaatttacactatctttatctgctcaagcttttcaaaagtttcaagagctcacttcttcccttctagatatcgagctaattaatgaaaatgatgtctggtcttacatttggggaaatatgaaatattcttcacagaaattctatgcactgaatttcagagttattaagccaccagttcattttctatggttatggaagtgcaaagcagtttcaaaaggaaaggttttcgggtggctactcatgatgaatagattaaatactaagttcatgctagatcataagaattgtgctcctccggattgtgatctttcttgtgttctttgtcaatcggcagctgttgaagacctcatgcatctgttctttttatgcccatttgcccaaaattgttggagtcttctaggcattacatgggatactaatctatctttggaagcaatgtttataagggccaaattggattatcaggggagctgtttcatggagaaattcctttatgctacttggcatatatggaagcaaagaaatgggttcatttttgagcaaaagatcctctctttcatcacttggaggcaactcttaaagggtgacctcttccttctgttgtttagaatttctgcgagatatcacaatgtaatcataagttagattaatgggttgtaactttgttcttgttttcttaataaagcttttttaacagcgggggcctcccctgctgtgttctcttcaaaaaaaaatcagagatggtaatgctgcccatgatttcaaaaatagatcttctctagctcttaattttgctttgcacccaggcactttggatgagttgttttta

SEQ ID NO: 14284 - DNA, 1259 bp, Oryza sativa
gtgtttaaatctgctggtatcatgtctaccttgagtgcaccttctttaaaatccaatgttgtgcatgcaaaacctcgtattgttacttgtgttgctaaatcatctgattctactaatgtgtctaaacatcgtgaaaaatatacttgttcttgttgtggcaaagatggacatattgttggtttttgtttcagattagctcataaacaaaaaaggagagagagagattgcttttgcaaaatcaaagtggcaaaaatctggtttttcctcgaggaaactggtcagaccggctactgagcagcggtcagaccgggcaccggtcagaccggcccccggtcagaccgtcagtaccacctcggtcaaatcggcctcggagaaatttttcagaaaattctcaaatcgtttttgcacgtagatatatgcctattggatcttctggtcgtgtgtctcagtactggattcctaaatttttattatcatctaacccccagtactaaggctttggtggcaaggaaggagaacgtgtggatcgtggatcccggttgttcgcggcacatgaccggtgataaaaattggttctcctccctcaaaaagacatccaaaactgaatcgattatctttggtgatgcgtctacaagtgccgttctggctacaggtttggttaaggtaaatgaaaaatttgaattgaagaatgtagctttggttgaggacttaaagtacaatttgctttcagtttcacaaattgttgatgaagattttgaggttcattttaagaaaactggaagtaaagtttttgattcttgtggtgattctgtgctgaatatttctcgatatggaagagtgtttaaagctgattttgataatcctgtttcacctgtgataacttgtttggttgctaagtttgataaagatgtaatgttttggcatcgtagacttagacatgttggttttggtcatgtcactaggttaagtggtttggatcttgttcatggtttgcctaaacttaagaaagatcttgatttggtttgtacactgtgtcgtcatgctaagatggttgcttcctcacatgctcctattatttctgtgatgacggatacaccaggacagctattacatatggacactgttggtccagctagagtgcaatctgttggggaaagtggtatgtgttggttattgttgacgatttttctcgatattcttgggtttttttcattgcaactaaggacgaagcttttcaacactttcgtggtttgtttctt

SEQ ID NO: 14285 - DNA, 4351 bp, Oryza sativa
acaacgaaggtaacatctttaaggtaaatggccatcgtttaaaagttttccttgatccgttagaagttgattgtgacttatatgttgtgaatctagtctcttttagcttctacccggagtctttaggtcccccttgatccgttagttttcaatgccatgagtccttaggcctccctctagttatcttaggtctagctttcatggataaaataaaataaaataaaataaagttggctccttggtcttccaaccaagtgagtccttttttgcgtcactctggtctttgtttttgttttttgtgtccaataaagcttcccagatacaaagacaagtgtggggtggtcttgcaagatcaccccagaagtgatgagccatgacaaactatacaaggaaaattgatgcagtcagacccaatgaggggtcagccaaacctccagttcggctgaaccacctctaccatgaatcgtcctctgttttatacagagcgcaggtttgcacaatttttcctttggacatccattctatcttgagcttaatttcattatcaattctaaaatatcgaacataattaaactcaagctagggatggtacaattagagttcatggtctacttgaaaataatatgcatgcctattattcttagctcattacttgttgctggtggtgatatatccaatagggaccccatgttatctaggtaattgatgaatgagatatagtctgatgatagaaatcctactcttcatgttgcacacttgggaattttataaaaagaaaaaaatatatataacgatgataaactcctcattgatatttctattcctactagagccataggttgatcagtcatgattagcttgctacatacgctgcttgtcattacattgagcattgtcaagttttgtgacccttgtgaaatgcgtttcatactttcatggtcaagatcacatgcattccacatacacgcacatatgcttgacttctacactggaagttagcatttctcatttaccgttcatttcatccatagttcacaaaataaatactccttgttatttatgcctcttcttccaaagttctttcaaaaaaaaagagagatggcatggctatgcaaaaaagaaagaaaaaaaagtgctcatacaagtatggagcatgatgatgaacaaaatagaaagaaagaaaaagacaaaaagagatagccctgcgctctccaaaatttcaaaagagaaaagaaatagaggaggaggtatacaaaaggagctatttttattttcctttttccactcacaaattcatcatacacatacacatgcacattcttgaccagaaagtatgtcttgcatttccgtggatcctttatttgactttgcaatatatgtgatacaagtaatgctctactcttttccataccctaagctctacataaaccttattagatggtaggaaaagaaaaggcacagtcatatgcctttgtaaggaatcatacactttgagtgatcaagagaatctattgaggagcaaagtaaagttataattttatgttacttgaaaaaacccaagttgttcttcatgaaaagttagggtgacttgagtcaagatgattccatttctcgattgtccaagattgcatggtcgacactacaaagatccacaagtacaaattgactccccgcaaaaaaaatgatccacaagtacaggtatgactttgaataatttgtttgcatgattattagtaaggaagtcataactttgttgtagagtccatagccttcactcgggacgagcaaatgttaagtgtggggatgttgttgacggtccttaaatcataatatctgactgtcaatacctgcatataatgaaataaaacatggtatccaacgtagtggtaggtattattactaatcatttccactagtattggtgaaatatgtgtatgcgagtattttgagaagaaaacacatccgtcaagcgacaaactgcaccaccgtgcattcaggacacatttacacggattggaggccccataagtcaattaaataactccaaataggcacaactatcatgccaatgggctgagggcctcaaaattagtgtccatgatgaaaaacgggccgaacggagccgtcccgggttcgcccgaacctccagttcggccgaaccattttggtggccgttgatcgccaaatttcacgtggacggtcctgatcacatcttaatggtggttctggggtagtttggtcatttcgcataggctgtaaccgtcatacctgcctataaaaggagcagctcactctcatttccaacacacaactttgagctgaattacaagaggctctattgtatcttttgtacattagaataaggtagagagtgaggggaagctctggaggagtgcccggaagcttggcgctcatccgacttctacctcaacgagtttagcttcctaggaggaattctagaggagtaccggagctgtcggtatactctgcttcgggttcggagaacttcttttataaagtaagcattcgtgtttctttcttctgttatttaattactttgtctaagtaagatagatttctatctttgcaggtttattgtttagtatttatactaagtgctctagtaccaggactccggataaagaaggaagttcctgtgcaagtattagagtagtaattaataacttagacgtggtgtctaggttagagattacctttgtttgttgtgtatcgcatggatttgtcagaggtaggtggcatgtggtgacagccttgaatcccttcctagtaatcctccacgttcggatacatcatagagctatagccggaaccacgctggcagaccagcaggggtcggtgctagaagcaatagataggaaattacctttacttagcaaaggtaattaaaaacacatagagagtcttctctagcctgcctaccatcagttgttgtccttggatagtctcagccttaggtagattacacacgttccctaagttcgatatccttttggggtcacccgaatgtgaagtgctacagcggtattccgtgcgcttgcagatttatctgtggtcgtaagaaatatctacatttggtttatttactccttgactatatgtttagtttgttcaactaaccacatagttaggggctacacctattaggtgcatttagtcgatgcacctaagtttacatttaattatttttcagccctctacactcttcagatctggtaaaagtactcgggagaccatagcgaagatgattgaaacacttagctttggagtaatctagttcgagagaagattatctttttgactgtgaaggtctcaggggctactgtgtatattgtgggtaactcctacccacacggcaaggttatctgactaattataagggatagcttagatctatggaatatgtaacggatcataacgtgaatattacgtttccgtgtatattacggaacggcctagagtcctggtttgataatagatttaggaaacccataccgtatgtgttaaggtttatgtcgtgtaatcctatccccccacaccggtgctatataaggcaggcaggaggccctctacggcatgatttcacaaccagatcgtcagatcaatactacaccaggtggattcaaatccgcaaacaggagtagggtattacctctcattgagagggccagaacctgtctaaatctgttgtctctgcattcatccagttttaggtctcatgcgctaccccctttatattgctgaaatcttgtttcgacactaaagatactgcaattctgagtccgtgaagtagtgcttcatactcagccacattatgggaagctaaaaaatgaatctacaaaacatagctaagtcgttctccagtcggggaaatcaatacaaccccagcacctgtgcctaatattctcttagacccatcaaaatgcatagtctagtactccaattttcgaaggcgtgtcttactagcacttggtccactcggcaacaaaatctggcaaggcttgaggcttgattgaagtgggtggcttgaatgatatgtccaaagacatcaactccaaagcgcactttgcaatacgactagtcgcctcacgattgtgaagatatctccgagtggaaaagatgtgaacaccatgactaagtgactttgaaagtaaagggccaacttcctaatggtattagaacaccatataacaacttttgtacctgaggatatcttgtcttggaatcggccaaaacttcactaacgaagtagattggtcgttaaactttttgaacatggccctcttcctctcgctcaatgacaagcaccgaactcactacctaagatgttgcc

SEQ ID NO: 14286 - DNA, 11714 bp, Oryza sativa
  unsure (1)..(11714): unsure at all n locations
catttataaacagtagttggaagcagtaaaacaattgtaacaattaatcaatattaatcttccactgtccaacgctacaccatgttgcaacaggcccaaccatccacctagactactcaaattcaatagactagactagggtgaaactaatcatggtgaatctggttgaccgcccataaccgcgggcacggctattcgaatagttttactctgatcagaggtgtacaactgtacccacaagacacagccccacgacacgcttccgtgcaacgacatgccaccacgacataccggatagaggccgtgacaggacccttcgcataaccccctctaaccaagcacaccacacctcaggtttcacccccactcctcgcaaggcagcggacagtcccctctcgtgcctaggtgaatccggaagccgcataggccgtcgcagggcctggatgcgtcagctagaggaaagctacactacaagcccagccgttgcccacgttggcttgtggtaagtacgaggaattcttccagggtttcccacaaaccggtccttaagtgccatgggcgcgactagcaaaaccatccacccacaacccaccatttaacatattttaatgaagcgacaccaggatggtggctctaatccaacatcaacactagaacctgaagtctatacattaatatgatttcccccattgtgtgctagttgaactaagcatggctgagcaatccctagtccaatatctagtcatgttatatcccaagctaacaaaggaacatggaacaaaatagcatggctataatagtaggtaaacatcccacggtaacagtataaaataatgtagtatttgaaagaaaacaatagagcatttgcaatataggatcaacatgttcaagtgacaagcatgacttgccttgctctgctgctggaggaacctcggcgactatttcaaagtacaccggagcgttgggagagccggaatctaagcggcatacaaagcaaacaatataaactggctataagactactgaaacaaagaacaaaaccctttttaatggattctatgcatttttcttgatttactgagacttgaatgggcttaaagggagctcggatgaatcagatatgaattttagaagattcactgtgtttttactataacagaaaaaatccttaattgatttattgagcaataaataaatcccgggagagagaggggcggtgccgacatgcgggccccacatggcagtggctgcgagcgctggtccaggggaaaaggggcgacgcaccacgtggtgacatgtggcgccgacgtggcacgcacgtggcggcctcgtggcagccacgcgggcggcgggatcggatggccccgatctaccgcctggtagatcggacggcggatgcagctcgcggccggcgcgcacgggcacggctcaagccggcccggcggccatggcgcgcggcggcgaacggccggcggcggaggacggcggtgtcgtggcgacgcgggcggcgatagcgacggctaagcggctaggcggtggcgcggcggctaagcggcacgggagagagggagaaaggggaggaggggcctcaccgacgacgatcgacgatggcgagcgatggagggcgatggcgacggcgagacgagctccgggaccacctaagggatcaaaagggatgagttagagagggagagggaaaccatggatggctagggcggtgaccgaaggcgccggccatggcgaagctcaccggcgcacggcgcgtgcggggttccggcggcggattactacgaaggaggggtggacgggacggcccgcacgacggcgaacgcgacgacgtcgacgacgcggctcggcacggcggctagcggcggcggcggcggcggcggcggcggaaaggaggtcgatgacggtagggtggtggagtgcacgggagcgggcgattgcaaaacgaaaaagagagagaaggaacgggggtgctttatatagacacacaagggttgatcgtggccgggagaccgcgatttcgccggaggagtggggagaggtggggaggagaaagaggcgggattcaaaaattgaatcctggccgtgtcgagcgctggcgcgggttggagagagggggagtgggcgcggggacgtgggcgcgagggcgacatgggcgacgtggcccggaagacgtggttgcagggcgcggcggtgccggctggaggtgggagacgggcccgacaggtgggccccacctgttggcgacccggggagagaggaggggggctcgggcggctggctggtccgtgtcctgcggccggcccagcagggagggagagagaagagagaatgggcctgtggcccattcgaaagagaaaaagggaaaaagaaaaagaaaaagaaggaaatgaatttttcccgggattaaatattgcttgtgctcaattttaattggttaaaattatttctggagctctaaaaattccactaaaaatcttgttagcgtatttcgacatgtagaactcaagaaaaaaaattcacatgccaattctgattattatttgcattgatttattagggtttactcttgcttttacaccggtattttcttgagaccatttataacttgaatttaggcttgggaaagaacttcagggtgtgacaaacctacccccccttaaacggaatctcgactccgagattcgaaagagctggtgaagaggtgcagatggcgggcctttaactcatcttccctttcccaggttgcttcttcttctgagtggtggctccactgaaccctgcagaacctagtgaccttgtttctagtccttctttcactagtctcaaggatacaaactggcttctccacataagttagatcttcttggatgtcaatatgctccgaatcggcttgttcttcgggtaccctcaagcacttctttaactgggacatatggaacatgtcatggatgccgatcatgttggatggaagttctagctgataggcgacttctcctcttcgttccaagattttgtatggtcccacgaagcgtggtgtcaacttgcctttcgtctggaaacggtgcactccccggagtggagtaacatggaggtacacataatcccctgcttcaaaagtcgtccttgtgcttggtcttgattacaacattgtccatgtaagcttccacgttgcagctaatatggcttgaaaaacatctctgaatcatgcattgataagttgccccatcgttcttcaaaccaaacggcatagtgatatagaaataagcaccaaatggtgtgataaatgaagtcttcaagcagtcagactctttcaggctatctggtgatatcccgagtagtaaaccaaaaagctgagtagctcgcagccggctattgaatcaactacctagtcaatgtgaggcagcccaaaaggatctttagggcatgacttgttgagatccgtgaaatcaacacacatacgccattttcctgttttcttcagaactagaactgggttggccaaccagtcgggatgaaagacttctttcatgaagcctgctgctaatagcttggtcaattcttccttgattgcatccttcatgtcctgtgcgaattggcggagtcgttgcttggtatgattaccgtattatttaacatttaaggagtgctcaatcacctttctaggaataccaagcatatcagatggtttccacgtaaagaaatctttattagcttgtagaaaggtgatgagtatgctttcatatttacaatcaatctctgtgcctattacagcagttttggtaggatcagatggatcaagggggattttcattgtctttgcatcgccttctccagtcttgggtagcttggtagcaggttcttcaccctcagctgatgttgatgcaactagtcggatctcctaaggagcgagtgctgtctcacaggtttgggccatctcacagctctccttatcgaaggtgatggcttgcttgttgtcgcttcgcagagatatgactccgcgttgtactggcatcttcatcatcatgtaggtgtagtgtgggacagccataaatttagctaacgccgggtgtccaagtatagcgtgataagccgtttcgaaatcagcaacttcaaaactgacgttctctgtacggaagttttcccgagtgctgaaggtaaccggcaaagtaatctggccaagaggtgtggatgacaaccccgggatgactccatgaaagggcgcaatactcggcttcaactcagttcttgggatttgcatctcgtctagagtcttggcgaagaggatgttcagtgcatcgccaccatcaatgagagaacgcttgagcttgattgtcggcccctagttttacaacacaggaaatcggatgcattttgttgaaaccaactccctggatcggtaggttggtacacacatcatacatcacatggtacaacagagtctgcacgattaagtcttacaatacttattgatacacgggttgcccaagtgggtcccgaataggccttatatggccgagtacaataccaaaaagtagagaaggggaaaaaggtgagcgtaagagaagctgcggcggtcctacgtctccacaagcatcgactggggatcactcctatggcgccttctggggttcactgtcttctgggatgctctcaaacagttccgcagcgtcggtcaggtctaggagggttttcagaaagcaagagtgagtaccaaccgtactcagcaagccactaccacaacatgcatttagtgcactcaggaatacaaggaaggctaggttcatttgcataaagttaatttgcacaactcttttcacaaacctatgacttagcatttttaactaaaaacaacattaggttggagttatcattcaatctacgagggttcatcccctttccccaaagcctcgcttggtccggctttaccctcgcatgcagttttccctattcccatcattatcatgaccttcccgcccatcgggcaaggtcacaccactttccttatctaagcaagattaaaaactatgaggctagtcatgcatagtacaagtcccgatgctcattaaccgcaagcacgtctattcgaatagatttgatttactcacactgtagtggatgtatgcttttaatcctgcactccgcggcttgccaaacacataagtctagtcccaacacatgagacttgccacggcccagtttttcagtcatcctagcgtttcggcacccgctccaaggactattcacccccattgcacccccggcacaaaacaacacctcgagccggcggtgaggagagtcctggcgctcccgatatctcaatgggttaaattacatataggttaggtgcgttttagttttcccgggtaccatacatcacatcccttcaccttaactcacaacatacttcagaaccaccatgacaggggtgccgccccacgaggatttcttagtccaccaggtctatacccactcgagaagtgcagtcatactcttattgtttcctgcccaacttcttgactcagtctttaattgaccagggacggcggctagccatttctaggaccaccaatattctatccatgccgccccagtcgaaaacattttgttccattaggtttttggtttttgcaaagctttttgtgctgcgggtggtgcacatgtctccacccgccttctggcaatcactctcgatgagtgaccaccaccaacacatccatatccaactactatggagtgtataatcgtctatgaataagcaatattaagcaatgtcaataattgaccacgcataaataatagactcaggcaacaaggatataataaaggtaacaatatcaaggatggttcatacacaaatttaggtacgcattttataattagcatgcaactttatttataaacaaaacatttataaaatgggttcaacatgctcaaggaggggagcgtagtgacttgccttgttcagtcagtagttcggcttcgacaaactcgtatccgtcctcacacacgtagcctgatttgatcgggaaacggagaatcacagtctattctaagactagcggaaaaaagaggaaaaacaaataaaatagcagaaaaagaaaatgctaacccaagctcattccgaagggtttgggataagaagaattttagcgaaaggttcttcaaaattcgacttgagatgaacaagtggtggcccctaaaagatttggaaaggaattacaaaccacaggagagacagaggacccacatgtcagcccatgtggtcttttaacagccctaggcccatctgtcagccttgctttagtggcgcagctaaaccggagtgaggtggtgcatgtgggtcccatggattagtattaaatcggtaattagggatgaaaggaatgggtggtccccacctatcggccgctcaggcacctcccccttcttcctccttcctcctcggccttgcgcacgcatgagcggcatcgccactagggctgaaccatgccggcaacgaggggtttggaagatagggcggacagtcagggcgggtcctatgtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatgattaattatactctctggaattttctcggatttttcggagctcaattcctaattttaatcatacaaagagcatttcagtaattacccacatattaaattaatcattaaatggtctaattataattttgttaagtactttgagtgtccaagtattttcaggatttttcttggaattatttgagcattggaagtatttttaacaattgaaaggtcatctcattggttaatttatttggaaaagtaaataaaagtcctcttcatcagcttgggccgaattcagcccattccctcccttcctctcagccggctgaaaagtctagtttgcctcccttgcactacagtgctccttcttccagctctggacagagccagagccgtgccgtgcctgttgccgccgatccccttccaaaatccaacctctccgttgctcttatttccgaattggttgcgggaatggaatcctctcaatctcctcttcctagtccccaagaaatccccaaaagtttatatggaaatcctttccaatttcgcggttcaacctttcctttttccggcgaagatctaaactttcccgagtttttcccgtcgttgtgggctcgatcccggcctcccatggctatataaaggaccccctagtcgtcctctactcatcccctcaagtcccgtcttccgccgtcgccggaaacgctctccccacgctctccctctctctccacctccggccgccgctccagccgccattcgccgtcgccccggccgtcgccggtcagcgccaccacctctccgcaaagtcgagctctaccccagccacccgttcttttgcgccgaacccctccagaagtcgccgtcaccgtgaaggccgaaccgttgccatgttttgatctccggcgaagctttgccgtcgactccgtggtcgccggacctcgccgtatccactgtcggcatcgcagcagtgaggagaaacccggcagccacctccgcgaagacgcaagccatcggagcaccgtcgtcaccgtgaagccgatctgttccatcttcagtcgcgccgtttgtcgtcgtccgtcgtcgccctctgtcgccgtcgactccattgggttcgcaggagcaaggtgaagcccggccatcggttttttcttcgccgaagattgctgaaacgtcgccgccatcgctgacccgaccccgtcgccgcctctacctcgctgccggccgtctgccgtcatcttccatcgtcgcgccacccctcagtgagctttcctctctccgatgtcgttcaccggtgtagtttatccatagggtcttgatctaatctaatctatttcgcaggttgctttaatcttttatctcggttataaattatttgtaaattgtttaattaatttagaatagtcttttctttaataggtttaattggaattaaattttgtaaaattcgtaactaattcatatgaagtcagaatgaggctgttcaagtctcataattcatctaaaatcatgatttacatgtttgtttactttatatgtattgtttatttggtttttattagtctttttcctcgttttgcgtgttagcttgtcgtttccgtcgtttcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttcttatggccaatttgcattgcttaccctatttcttgattacctcgggttataatttgactagttggatttatatattggttcaactagatgttagatataattgcttagccatgcttagaaacattagcacactattgggataacttatgactcactattatttaatgatggcttaatgatagttcacgagggtcaatcgtgattggttaattaattaaattggtaattaaaatatgattaatggtgggttatgaggacatggttttgaaggtcgtgctcatagcaattaaggaccggttcgcgagctactgttgtgaaacattaaccatgccaaccacaagccagcgtgggcaacggctttaccttttgtatagcatggttcattgcggagcaccagactgagaagtggcggagataagcccacgggggtcgctgggtaatccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtgcagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggattcagaaggagaagacgtttggcttataccccagttgagctgcctgtgggagtggagctgaagccatcgctagaccattattccgctgctgttttcttttcttttgtaagtatgtaatgttattattatgatggatttgtatattaaattgtcagtttgtgtacctcggctgattcctggacgaagattttatgcacaaataagttcggaaattactagtgaatttccgggcgtgacactatggaacctcccccgtgtgtgggtggcggcgtgtgggttatggtgctccgaggcgaccgcaatgcttgggtgcggcggcggcctatgcacacgcatcctggacaccaactcggcgacgatggtggggtgcgtgggtgatggtctgggggtcgggggaggtggtcagggactcgacggagtgtgccgaggttgagaggggatagcggggacgcccggaacgagctcgcaccgttctcacgctcaatgcggcggtggtggaatccggctcgtcgacgataggttgcaagggtggagaggaggtggcggggggatttgtgtgagtttggtggaggttggtggatggttatcccggggtcgggatgaccggtaatgaagagcaggtgactagccacgacagcgcgcatggccgaccggcggcatggcgagggtgccggcgaggggttacattaggtgccaaatgctgaggggtttatcgacgacgcgtggtaagtgtcctctggcacgcttacgtggttcgggacagcttggacggcggtagccgtttggtccgggccacgcatgtcacgaacagagccatggagcgcggcgcgtgcacatgcgtgtcccagtggcacggtcgaaccgacgaccagggaaacgccatgggctcagagggtaaggcgctggggacctaatgtccagccgctacggccagcaaaatggcagccattgagagttgcgggggtggcgtttcacccactagtggcgccacgccgcggcagcagcgacatcacaggaaaaaacgcggttgagcaagggaagggaagggaagggtgctcaccgcgcgacaaccaggaagcggcacaccgacgaggtaccggtcggtgtaggtcgagcgcgcatttcgtcctcgcgccccaaatgttcgaccggtgctagtcggtgttcgtcctggttcaagagaggttcgagggtgttcgagcaattagattgcaagttttaggtgattaattagcgttcaatcgttcgtccagttcatagcgcagctccctaccccccccatcttgctcaacctaagcttcggccggaggcgagctgaggcgaagcaagcggagcggcggtagcccaagcgcaaggagtgatagtggagaagaacgagagctagaggagacagagatagagatggattggggcgcatggcgcggagaggtatttatagagcatgggcatgtgccgagcggatgatggcgcattgaatatggcctccgagtgctgggctgtcgccgttgcagaggaatgttggggaggcggtggcaatgggatggcctccctgtgcagcagggcacgtggcggcgaggtgcttgaccgcgcggggacaaagcgacgcgattcacgtgacgccgtcgcccggggtagatgagccgccgtcgccaccaacctacaccggccggttgcgttgcattgatggtcgcggttgccccctctctccgtgccgttgagtggagcaccgagccgggcggtgtctttgccagagctgggtgtcacggcggcggcaagccaagaagagcttggggaagggcaagggcgagcccgccggcgagatgggcgtggtaggcgtcggaagggatggtggggctgggagcgtggcgccatgtgtgaccgcgtggcaaggcgttgcgcggagaaggggatcgagccccgtcctcttgtggtgtcggctcggctcggctgagctagggcttccaagccagcctcaaaaagaggggaaagaaaaggagagaaaagaagagagggaggagggaaactagactttttctgtgcagggagggctgagggaccagaaacagacttcactgatggtccttagatgaattgggtcagtaacagggggaggaaaggtagaggatggtggaaggtgaggggaaagtttnnnnnnnnnnnnnnnnnnnnnnnnnnnnnnnnnnnnnnnnnnnnnnnnnnnnnnnnnnnnn

SEQ ID NO: 14287 - DNA, 942 bp, Oryza sativa
acctatctccttgcaaatgaagcactctgcatccttagctggccctgtcttttgaaccttggtcttagagttgctagtagtcgtgatctcatcagagtttagctttctcttttgaccactcttcttattgtttggcttgcgcttatgcatacccatcacatggttggagtttttcttaatgctttcctcggcagtctttagcgtcacatgcaattctgccaaggtcctgttcaggttgttcatgttgaaattcattatgaatggctcaaagctgggagggagcgactggagaatcaaatcagtagccaactctcggctaaggggaaagccaagcttatccagactctcggtgtaaccaatcattttgatcacatgtgggctcactggattaccttctgcaagcctgcacgcaaacaaggactttgaggtattaaacctctcagctcttgcttggtcctcaaacatgttacgtagtcccgtgattatcgtatgagcatccaatgcctcatattgcctttgaagcttaagggacatagtagcaagcatgagacagcttatatcaagatattcattgcatcgcctttcatgctccctacgttgagtagcaggagcattgttgggcaagtcagctagaaaaggctgtgtaagcacaaactctttgtgctcttgcctgagaacaattctcaggttgtgataccaatccatgaagtttgttccagtcaacttctctttctcaagaatagaccgcaagttaaaattggatggtgcaggagctgtcatgatctacaatagaaatatatgtgtgcaaaatcagcaccattttacatttaacctttcattaaacaatttaacaaaagatactcccaccatgtattgtgaaacaaaattccctcatttattagtgtctagttagctttggcatcacagctacacaactatcaa

SEQ ID NO: 14288 - DNA, 3874 bp, Oryza sativa
caaacccatcacttatgatcacaaccgtaataggtgcaattattggaagagcataaattacagttaatttttctgagggaatctatcctaccatgttatatcaaatatacaacaacaataaagtaagatagatataaaaaccccaagcgaaatctaaggggcaacgcacacggcggtcacgggatacatagatcacatctacgattcgccatgtaaaaaccttaacggcataaacaaattatgccgaaaccgagtcaatctcattggctcatttttctcattggcgtgcggttccagtggacatcggactatctgatgaacacaatcgcgctcggccttgttgagtactagacattccagtgaagtcaccaacacatataccgattgatctcatcaacccatgcgtctgtcggttcatctcatgttccgatcacctaagaactcatatacaacataatagatctcatccactacatccgcatatcaattatatgcaatgatctagatcataagctatacaaggcggctctgataccactgttgggatacgcgtaggctacgatagcataaatcaaaattttctatcgcgtaaaccaggaaccatgcaagtattagatcatagatcgttaccactcgatgcgttgtgcaacggaagaagacgctgagaagtcgaaggaactctcgcgaagtaacgcgcgtcgatgtagaggaagtaatcgatcgcacctactcgaccttctcctcctcgtgcattctcctcgctgtactcccacgctgattagcaccgcaaaccagcggcgcctttaccggtatccacacgtacagagacagaacgccacaacagatattctagcacccgcgcgcggctagggttttgctcgggagggaagtgacggctagggtttctcacgtgatgcaatgcctccgccggtcacacccctcacgaatatataggatccatcactcgggcctccaaggcccgtaggactcctattcggatccctatccgaattaagctcatattggatctctatcaaatccccttattctggcccattaagcgtgtgaccctgtagattcatatatactcgaccgtaacccgaaaactccttttcggtccacgcgtaaacagcggcccctagcagaacgtattgacccaccgggcatacataaagatcatatcggctgaacctctagtgtatacttgtatgaacccttttgcctcacgatatcgattaagctcaatgctagatatatgccatcctctaatagctcaatcattcactcgaacctgttgatagattatataacttgtgattgactcctcaatcacctttggcatggtcatgcccttccataatctacaacatcgaggggcccaaagatatctctccatcttgattattcatatcccactacatgtttcataacatacccgaaaactacttttatagctacccatttacggagtagcgtttagcggtccctaagtaagctactacatatgttgagaaccatgataatctcaagtctaaggattcaacaccaacactaaatgagattactgatgacacaacacatatagctcttgcagtgtctcgtgttgcgtctatccaacaacatgtgcaccaacatgtgtccacattattaatttgatatctctataccatgatccatgagacatgatcatcaattaatacatatgctgatcagataaacatatttgttccacatatgatatttgatcagggatcctttagaaatagtaacaaacaacataaagagtctcatgaaaggatcacatattcattaaccaataaggagttatctatttcaaggaacaatgtcggataaatatgtaaaaatagtatgtgatacaatcatctctatgattgcctctagggcatatcactaacatatattgtgattagaaacaatggaggggacatggagacacttggagaaggacgtagagccatggaggatcatcgaggacgtccaactcaaggtggaggctcaaactaattcgacctcgggttcaattcggagtccaggaccagtctgcacgaaaacgggcgcccaggtcgcatacgtgctcggattggggtgttctttatatggatggaaagctaagaagataacctttccaatggttctagtcccacatccaaattctttccgagtcaatgggaatcgatcgaacaaattgacatccagaatctgtcctggtgctgcatcaccgtatttgggcttttgggccatgtatcgtgttggaacccattagggttgcgtcgagagggggttgcacgaccctaaactctatatataagtaccaccgccatctttaggtctttgggttttgcttagattaatctgtcaagaacagtttcgccgctagatcggtttgtaagaccacaactcgtgagcttaattattcatctgcaattttggttgttttctatctcgttcttgtttgtcttcttcgattggcaaacagggattagccttctcagcgagatcatccctgtttcgacacgggtgataaccagaggagacgtggtgttgcgattgcggggctcaagagcgtgcgcgttcaagaaaccggatcgatttgtgtcgcgactccgcccaaatcgttgtttatcagaacctttcagaagatcgggaaccctagtgcacaacccaatcagactcgcgagcatctgatgcaggcgggttcaaaggggaggcggcagcatcccgggctcagtcgactgtcctgaggttgaagaagaacagtgccgagggaagcattgtagacttttagagaaaaggaaaaagaaaagaaaagaaaagaaaggaatggagtagcaggctggcatggctagcagcccgagagaggctttatgggccaaaaatgaccaacggcctagagaaaggttttaaaacttttccttctttgaataatccgtgaaatgctatttcattgattaaaaatacttcccttgctcaaataattcctagaaaaatctagaaaatagataatcaaacaaagtatttaatgaaattttatctaactcagttttatgttgcgatttttcctagattattagagtttaacttgtaagcttttaaaataatttctaaaaatgcattaaagaatgaattattaaattaggtgatttttcgggcgtgacaatcaccatctccgatactcagattaccaaatttggttgttaacagtggttttactagcgtcttccaataacgattcctaggcattgttgttttcttctctaggaaattctgcatgaatttcaccaggctgtccgtcttgggtggctccacttcgacctcttgaatattctgtgggttcggcccgtactttattctgaccatggagcattgttccgtcctcggttgaaactcaaacttctcttccttgccgatgatgtggaaacggatacttcctgttcccacgttaatgttggctcccgcggtgctaaggaacgggcatcccaggatgagcggtgtcttttttcccgtgtccatatccagcaccacgaagtcatccgggatgaaaaaatcccgtatcttgactggcacatcttccgctatccctgccgggtaacggactgacgaatgagccagttgaaggtgcattggtgttggtgccaacactgttaagttgagcttgtcgaagatgtcttttggcatgaccctgacactaactccaaggttgcacaatgcctggtcgaactattgtgccccgatcaagcaggtgatcataggacaccccggatctttcttcttgtctggaagcttgtggagtatcaggttgctgcattgttccgtcagcttgaccacctccgttgttgggagcggtctcttgttg

SEQ ID NO: 14289 - DNA, 578 bp, Oryza sativa
gagtccattataaaagttctgcaggatcagccagttgtccatcccatgatgaggacaggcgggcacgtactcctgcagacgctcccatgcttctagaatagactcatctcttgtctgttggaaactagaaatccttcgactaagggcattggttttgcctatcgggaagaatttcgagaggaatgccgtagagcatttatcccaggtgttgacagcagcacgattggcatagaaccactgcttcgctctcccaagaagggagaacggaaacaatcgcagcctaacggctttgggactgacgcccttgatggtgtacgtgctacatatctccaggaactgtttttttttactgaaagtactgccagggctttgcccagcagtttaaattttataaaatataaatatgtacaaagttacaaagggaaggcaaaacaaatatgctacaaagtttgtatccaatcagaaagagattgcttgagtggatctttcattctacacatatgtagaagaacttctttaacaaacatagatttccatgattgaagtgatggctgaacagtttgaaagattaatccatt

SEQ ID NO: 14290 - DNA, 5210 bp, Oryza sativa
aaacaatttgatgagtatgatttttctaatgctcaaatgattaaggctgctagtaataagtgtaccggttctgcatcttttttgtggcatactgtgggaaataagcttgacacttgggatgaatacaaaatactgatgagaaaaagatttgtattttcatactatagacgtgctctctttgaaaaatttgaacatctaaaacaaggtgacaaaactgttagggagtactttcatgattttaaaatttgtatcacttatagtggtttacaagaatctaatgagaacacaatgactagatttttcagagggcttaattccaatattcaggctgggcttgttaatgtgacatataatcatataggccaattgttcatgcttgcttgcaatgttgagcgcaaaattttggaaaacccaatggagcaacaagctatgcttgtgcctcctatcactgatattttgcaggaagttcagaacagtccccaaaatgagaagaacgatatgtttgagatgtcacttccatcactcgcgaatgaggagaaggctgatgcacctacattatctgaagagggcataaaaggtaaattaaatggtgcagaaattactcaaggtgagtatgcttctgatgaattacatttttctacttttcatactagagaagagcaaccattagtggaaccaattgctgagatgcctttgtcacaagttgatttacttgctgttccttgtgatagagtagaggtgtgtgataatgcttcacttatatccatgccacaactagtgaatgaacatgctatttctagtatttctttgtgtgctgattttaagcatgttgttcacattgctaatgaagtaaaggaacgtgaattgctatcttctttaaatactttgggctatgttcagtttgatgatttttgtgagctcgataatttggaggagaaattatttgctaagactgatttgccatgtccaactaatgctatttttcatatcattggcgaatatgatgatagaggaatatgtttggtgcatagagtttatatatgttccgatttagaacctcctgtacatgtggataaaactggcaagctagagagggatgtaatttctaatcatattacttccagtttgtcttgttttgattggatgaaataggttgttttaaatcgaccacgcgatgagcaccatatggaaaaaccgaggacggttttccgtgaagaaagggaggatgatgtgaccatggctactacggatacaaccattgttcacatcatggatgaacaagaagatatcaaggtcaagtcctccaagtgctggaatccgattcggccacctactacactgctgacttcaaacggccgccaaatctccattcgagctccgttttcggcccatgagtacttgatggaaagctctcggagtcctctttccaacggatccagcctcattgtgatattccatctcagttatctgcaattgaagaaacaatgggctgcattgtctgtaatgggcctgtgggcttgtaacttcgtctgggaccccggcccaaggggggctgcgccgcaaacagagggacgacacccttctgacctcctccatcccttaaatagctagtaacccctccagggttagtcgggttttgatagattaaagtttagccattgctacttgcttgcagcgcgcgtgttggctagatcgcccgtctgcttgttcttcggaaccccaacttatcatttgtattaaattcctatttgcaatatcagattgcttttatcttattcttgcttgtttcttcgatttgcttgcaggaatagggttgatctgcaccggcaagatcaacaacccacggagaggtgtattgatcgctaaggcgcaacacaacgtctcgtatggttgtagtcggatcgtcaacgtttctcccaaatcgtagttatcacaactcactgaaagattgggccaacaacagccttgagtgtcaagaggaactcagggttcatcacaatgatattgtaggattgaaacacaagaactaagccaacctgagggggggggtgaatggtcggtatacccaaaaaccgaaaacttttagcggaaataaaagttaccctcaaattcgacggagatcggtctgaccgagattgatctgccagtctgaccgtttgaatgctgtcattctaaccagtatagatagatcggaccgaccgccgaaattgcctgccgcgcctgttgccgccgccggtctgaccgcctcgcccccgccggtctgaccgctggtgtgtcaccggtctgaccgccggtgtgtcgccggtctgaccgccgaaacccggtgaaacacaaatcggagaactcttaaaatagatgacaactttattgcttctctctgtgtttacaaagtgcaccaatagcactccttacaaaaatttcgactaaactcgaaaccctaacttaactctcagctcaattgctctcaaaagcgataccgggaagcctcacgctcccccactatttatacccgaggtaggcagcctaaagccacgaaccaaattcacactagaagtcctaaacaccttaggaaaccctctagtacaagaaacaaactttacataaccactcataccaaatttagacactttccaaattcgcctccgcatcccatacgcacacaatacctccatcgtatgccatatggaatcttcacaaaccacgtgtattgaactatagccttagtgtcccgcaagatctctgactaccacggacgtcgtcttatccctaagtcgactcctggtccatcaccgcaaatactctcccgaggcatcgagtcacctacacatgaaataaacaaagaaaccatatttcgagaacaagctatctccaacttgactcattagtagcaaacaacagtattacatacgtatagtatccttctagaagccataatcatgaaacaatcacggatatccaaacaaacaaaccaaaaccgaaaccgacacagagtcggccggtcagaccgcgggctgcgccggtctgaccgcgtgatacacgccggtttaaccgacaacacatgcccggtctaaccggaccagatccagcagtacctatagatttacctgtgaaatccaatcatctccaaaaccacttcgtgaataaattccaaatatcaaaaccaataatctccaatgccaattgttcatcacagaataacaatcaaaaacacctttgattttacaatctcccccttgaggaacacgttggcaaacccatcaaaaatgttttggtgtttggaaaaataaaaacaaaagtggtaaaaagcacacttcgtacaaatgtacacatcgtgcttgaaaatccaaaagaaaacttctctcacttttgaagagaaagaaattccaatcgaaccaaaaacaacatgttcttctcaacacttttgcttctccaaaaattttcaccttgcttctcccccttttgacaaagatttcatcaagcacaggaattatgttcattaatgtataagagtttagcatacatatagcatatcatgtcttgtgttgcgataaaaagaagatgaacctatctataatatagcaagcatgcaataaagtataaacatgaaccaaagattttacaattaagcttgaatcaacaatcaaaattcatgatttcaaatgatttataatgaaacatcttaacaagcacataggttgaagaataaacactaaacacatataacacatatacctattgcatttatcactctttctcaaataacctttagcacaaaacaaccaagaaaattttttaaccttttcttttcttgagcctttttgctcatatttttatcttttattccgggtacgtccctgtcgtcaagactgtttctatggattcggcacccattattttgctcacatcgaatacgtccttgtcgtcaagactgtttccaagcattcggtattcatttttttcatatttttattctcttttcacaatgagcaattaaagtgatttcaggaataccaattcaataaagcatatatatagagcatttagaaatcaaaccacatgctagcatcaacattgcatatttacttaattcaagtatggaatttaagtgtcatgcatcatctcccttaaaagcaaaatctaaatctcatgcaaagactagaatacatacaagctatgctagagacaaataaaccttcaaagtattgttagtatgcacaagaaaataccacatgtataaacaaagctctcttttctcaatttttctcattgacatatttttgctagataaaaccatgaggtacaaactccccctcaaaacatgccaaaaggatgaattattcccaatccaccacgaagaaaagcaaaacgattagaatccaaaggtttagtgaaaatatcagtaagttgcaactttgtgtccaaaaactgcaattcaacatctcccttctcaacatgatccctcaaaaagtgaaagcgaatatcaatatgctttgtgcgtgagtgttgaacaggattcttagcaatgttaatagcactagtattatcacaaaagagaggtactttcttaaaattaagaccataatctttcaaagtagataaaagccatagaatatgtgaacaacaactagcaacagcaacatattcagattcagcagttgattgaggaacactagattgtttcctagaagaccatgcaatcaataatataccaagaaaatgacatgttccactagtacttttcctatcaattctacaaccaccaaaatcagcatcggaatatccacttaagcatatagaagatgaagtagaataacaaattccaaactcaagtatatgattcaaatacctcattattcgcttgacggcttgacgatgtgaagcacgaggagaagcttgaaagcgtgcacacaaacacacagcaaattgtatgtctggcctagaagcagttagatacaacaaagatccaatcatacttctatactccttttgatcaacagcttcaccatcttcatcaggatccaacatagctgtagaaccaattggtgttgaaattggcttacaattctccatcttgaaccgtctcaaaagatcctttgtgtacttcgtttgatgcacaaatataacttgaggtgtttcttaatttgcaatcccaaaaagtacgataactcacccatcatgctcatctcaaattccctgcgcatagtctcagc

SEQ ID NO: 14291 - DNA, 8083 bp, Oryza sativa
tacattaccttcatacccatgattttgccaaatggattgaactaaatcaaagaaaccattatgctctacccaaaaattttcaaatctgaagatgtcagccttggggatgtcagttccaatttgcacaacacaaggtgtgtgatctgaagtagaccgagcaagtggctttactaaggtatgggggaaggttaaggtccaaacagtagaggtaaaaaaccaatccaattgctctagtagaggactatgctgcatgttactccaagtgaaagcccttcccttgaggggcagctcaactagacccagatcactgatcattgcattaaacaggaaaatatcattcatgtctgcacccggcctatttctatttgtaactgatctatagaagataaagtctccaagatgagccagaggtcatcatcaagaatgttcaactggtggagccaggacaggaagttatctctttcaggagcagtgcagggaccgtaaactgaaactaaagtccaaactaaaccagaatgatttgaggtgaaagtaatcttaacagcaaacctttcaattataatatctgatcccccaaaaactgaactgttctagccaactaaaatgccaccagaagctccaacagatggaaagaaagcaaacttatcaaaacgtttgggagcaaacttctttatgtaagaatgatcaaaagaagatctttttgtttcctgaaggcaaaaaacagcacaaccactttcctcaattttatttctaatggctaaccatttgtcatcagaattcagacccctaacattccaacagaggacattccaatttctcatagccgaattcatttgacaactagtcttaaagagagaaagataacaagcaggaataatccatgcagttcccaagcacaccaacacatagtaccatcatagagtttacataacttaaacacaaaataaaagggctgataaaggaataaacacatgccccaaaagagtgccactagcagccctaaaagtctgatagaactaggcttcatcattggatggtccaattgctttcggcttgatgacctgagcttctcccaagtccaccaagcttgaaacctcctcaagggaagtcccacacatcttagatccaatcttctggagaaaagatatatcacaatcagcaggtataacagatgtaagatcactttcagactcacaagatatatcaggatttaaatcagtagaagataaagaatcagatgggaaaacaattccacttgcctcagccaactgtttcagctttttaactgccttccctcttggctttccaacacccatgtttggatcctcttgcagagtattcttgaaactatccctaagagccagaagtctaccactccttctaacttgagagtcaacaaaaggtgttctcttcttccctcttttcctaggggaaggtggaagactaatctctatttccatgcctgttggagtagaaggacaagaatgttcctccattgagccaaaaggatcctcaggcaaaacaggcatcacagactgcggagggatgacagctagaggttctgggctcaggattatagcagaagattcaaaagaaatagaatcatatggcacaatttcatttcccaaattaaaattaagctttgtaggattaagggctgaatttgcgagagagttggcagaccaggaattgaggcatctttgtaagcatcagcaagggtgaaaattaaacttctggtagtaaccagattccagccatggttgttatcaatctggcccatgttctcaggagcagcttgttcaaggtccatggcctgatggcccacagcagcctgattccaagcctggtcttcttctgcaagaaccacacgatgtgggccaaattgccaaatattatcttgcttacaatcatcatcatcattaccatcaggattttcatcattatttggaccagcagggggaaggtcttcttcagggggaaaaggaaaaagtacgaattacccccctgaactattgggtgagtatgaattacccccctaaacatgaaaaccggacgtttttcaccaccgaggacaaggtcaatcgaaacgaagaacgaggaacatcaaccactaatcgaaacggagaacggctaaaatgagaggaaaagtgcactggtgaaccaaaacggctccaaacttcatcgcggatggaatcctccggggagaaatcccatccagtaggcggcgccggcatgaccatcttctagagagagtcgccatggatgtcgccagagaagagagtcgccatctttctagagggttcaaactattttgatgacgtggctaaacatagtgcctttacatctctaatttttgaaaaaaaaattaatgaatgagatttctaatttttgaaatctcattcattaaaacctcacagtttgagcaatcatcatcattaggaataagagattttaatctagcaatttcagaattaagagattcaatgataaactcctgttttctatagatcttctcacacttattattttttgcactcaaaatattaatagctttcccgaggacgaggacggcgacgcgacggcgaccacgacggtgactttctcgagcgacgacgacgacgggatcggcggcggcgcacggctggacgaacggcgacgacggcggcgctaggctacacggggctagggcgctacgggtggcgagaggcgaaggcgagggtggcggcaggtagcggcgggcttgggggtccttttataggggcaaggaggcggcggcgaaggcccacggtgaccggcgacgcgaaggaaattttagggttcggaggagagagatcgatccgaatcgaactcgaatccacggatttccaaacgatttagccgacgattccaagagagaaaaggtagaggagatctcaggaaacatttcccctcaattgatttcaccggagaaggaaaggcgcgagcgaatttggaaggagatggcggcgtggctcggctagggttccggccgggcgatggcgcgaggaggacgacgagtccgataggtgggacccacctgtcagcggccgagggcgctcgcgcgggcggctgtgggctgactgggccgagggagagagagagagaaggttttgggccgactttcggcccaaagccaaaagaggattttaaaaacctttttcaatttaaattattcatgaaatgcaattctatttattaaaaatacttccttagctcaaataaatcccagaaaaatctaggaattatagaattaagtaaagtatttaatgaaattttatctagccctattttatattggaatttattatttaaaattagatcttcttttctagacttttaaaataaattttaataattccagttaaacaacaatttatatatttaggatttttagggtgtgacatgctgcaatcttattcggcttcctactacattgttgacttcgaacggcagccaaatatgcatatgaactccattttcggtccgtgagtacttgatgtaaagctctcggagtcctctttccaatggatccagcctcatctgactaccatcatgagtgaagcaattcggattagctccccgtccttaaccattccttgactcgtgagagaggtccatggtgaaaaatctttataatcttactgttggtgcaaacattatgcctgcaaccttcgcgctctcgtgtttaggggacgagccgatgacaccaactgtgacataccagaattctaggtcttaaaattttcttatcaaaataattagaaactaacatttccaattttgggagccaaaaattgctactttaacctaggtgaggtcaacttaacttgtacttaagtaaaaatttgagaacaaattaaatcctttccattttcagcctaggacaaaaatgcaaacaaaaatgtgtacatgcatatgcatttagcattagtttgatttgtgtcttttatgtgcatttggattttggttgcatatcatgttgggttcatgaacatgaataaaaggacaacactactagacaaacccatggtcattcttgtgacataattacaaggacatgaaagtgaagtcaaataataacaactcagttcaagtcaattcctaatataagtttttacaaacatttagatgcatttatatagtgagaacacttatataaataaatgcttgcgaattattgaaaataattcgtgcaaggtaaaatcatgggaaaattcatgtagtctctactcaacacatacaattcactgtaattttattcaaattttaacacttaggatgatacctcaaataaatcagtcaaatcaattaaatgatagactaattataatccttaatcggctaaaacataccctcaccataatgtgcattaaactgcataaaagtgtataggggaaataatttattcaaatactaggttatttatcatgaataaatagaatttttccagaatttatctactctgtttaaatctcctaaaaattcaaacaatgatctaccgagcccatcttctcgaattttctgagagcaaaccacataaactttttaagagaaacaaaagaaaatggaaactaggtatcctcatctacctctagaaaaatccacatgaatttatcatgcccaaaaattaaactatagattaacaaagagaggagagagattcaaatcctgaaaatcgtccaaaatcgattaacacccaatctcctacccacctctctcactccagacttgttcccttcgccctggacccacttggcaggctcccttcctctgtctctcctctccaaccgaccaagaacacgagagagaagaggggacacgctctgggcgccggtcgacgcgtggccgagacgtgaggacgcccagttctgcatctctagctttctcctcctcccagttgcatctccacacatcactcaccacccgtgagccaaagaaaccgagagggagagctccagctatcgtcttccctctcctcttcgttgccggccgccaggaagaaggacgccgcaacacatcgtcaagactttgccaactctaactctttcccgttccgtattctaatcttcatgccgaacaagtttccttttgacaccatctcatttcatccactgcagcgacgggaacgccatcgtgcccacgggagcttcagagcgcgcccggagcgccgccgccacgacctcgtcgctgtcccggctgctgtggagcgaatccggccgagccgtcgcgccaaaatcttcccctcgaggtcctctccaaatgccctcaagaatccccaagatccgagcaccgaggagagatatcgagctattcttctccaactccggccgccgagctccatctttgattcctccttctccggtgagctccaagtcgattccatgcacacatagatttcctacgaccactataacatgagagacacgcatgcatggcagttcttgtagtgagtcaagccgacgccgttcatggagaaggagcgccgtcgccgagccgttccgaacgccgtcgtcgacgaccaagcttggccaacctcgtccaatactactgtgagcaccctggagcttctagagttgcatgcatgcattttatccacctagatccggcctctaacgtgacatgcatcactaccccgagacccaccgccactcgtgccgccgtcgccattgattccggtaaccacagatcacgataagactaccattagcttcgcaaagaacccctcttccttttctcttttggtttcatgccgagatctgccaccgttcaccgccagaaagctcgagaacgagctcagccatggctagctctgtttcagctcgaaccagggacctctgtggagaagaaacaaaactgtaggtactactttgtaaaaactgccacacaatgcaacagtcataggactgcggattgattgcctgaaaacccagagatctttttgcatattggtatctcactgacaggtggaccccatgagcttaaaaatctgaaaatctaaagaaaatcctctagagctttatattttcaacagaaaaacatgcaaacttgtaaaattcatacaaagtgaaatatagctcattttgagatgattcaagtttctgtgaactcatagaaggatgagctttaatatggaaacataaaacttggcacttgcagtataaatttcacctctaaaatttatctaagaaaaactacacataaagcatgcacaaatttacaaaatgcatagagaattcatttcaacttaaattgaagcaaactcaacttccacagattcaccaacttactctctaaggtaaaataaaataaaaagatgcacttgctttacaccaaatacctctaaatgtatattctacaaaataactagttttagataagctgaactttaaaaatttatataaaattcatcttacttcctttttgagtaaactcaagttccgcagaataaccaagtttagcacttcaaagatatataataaaaatatatacttacagtgcaataaaagcccctaaatatttatataaggaataaacaacttagagcacccttcaacttctaaaatttgtagagaattcatctttagtccaaatggaatgaaccaagtttcttcagaaccagcaagtaatgaactttaattagttaaattaaaatgtggcaccttctatactaaatatgtcactaaactttaaatagataacataagtgctaatcacatggtattggttaggcaatacatatgtataaatgtatatataaatgtactctagctctaagtaaccaaaataaaacttgatggaccagagaggtcatagttccatccctaaccaccaaaaacttagcacacttagctcatatatcaatttctaggttggtatgttcagtaactaacatagaacactcccctagcttataaaatgtgtagtagagtaatataatctctaaaattgtgaactaagattatattggttgataaaattagtcattttatacatcacaaacaatatgaaacatgtactggacataaaactccaaaaccatgtacacatagaagctacctacctacaacacgttaaaacttgtaaaatacataagaaattcataataactctaaaagttatgaaaccaaatgtattatctttgaaaacacatctctacacccctgagaaatcaaacctaataaaaatcactttgcaaaaatatttcataacactacctaagtaaataccaccctataccgagcaaacttctaaaactcataactgacaaataaaaagagataaaatagaaattctttcacctaaattcatcttagaccagtacctacccacggtgcacaaatcatgcattttagagccttttgggtttttacctattttggtgtttaattgcataacgtgtactttatatagataattgcgtaaatggtgaagaagtgaattaggtgctaacatttcccaggaacaaggcaagttttatcctcccaatatttgatcacattgaatcccatgttttgaggattgaaaatatttgtttgcaaagttgcatgtgaatttagactataacggtatttgaaacttggttatggtagctatgacctaattgctgcatttacttctttgaataattgtgatcctcactgattgtaaccttagaaatggttagagtactttcaaagtgctcaattgggtttatacatgcttacataaaagccttacgcttggccatgcctagtagttgctaaataacttcatgatcactttttaaatgagaatttggggagtattttcactgctggacagaggtgaatatctctgatatttgtgaattaaaatgtgtaaaagtgtgattttagacttgggcggcaagtggtatgcatatggtgctagttgcataccgatagggggagtgctcgccctagtcaattaaggaccgaactttgtgtcaccatctaagtatactgtgcaaccacatgtgctaggaatgggacggccttagcttattaagttgtttaatgtctaacattgcattgggaggccgtagtagtatgaactagttggaatgatg

SEQ ID NO: 14292 - DNA, 6668 bp, Oryza sativa
tttgttttcttgatgggtattctggttatcatataattcccatatattcctacgatcaaagcaagacaacgttcacgtatccaatggaatgtatgcttactatcgaatgtcattcaggtttgaaaggaccttgatgttgcttagaaggggagtgaataggtattcctaaaagttatcacaacttcattagcatattataatgatgataactttcggttcaaatcggaatttccggtatgggattggaagttccggtctcaaccgaaaagttcagtggtaatagaataaaacactatctatgaatttgtagctcgaacaaacaaaatgtatatgaatcaaaaggtgacaaacaaggtatctaagcaagatataaggtcaccaactatattaattaagcatacaagtagattgggtaaaaacaagctcaagcacaatatgagaatggcaagaatgagcagcccaagagaacagacacgttgatttattttccgaagttcggatctgcggatcctacgtctccgttgggggggccacaaaggtgggtctatttcaaccttttccttacgaggttgcgcaaatgctctcctcgatttcactcttcccttgcggaggcgaaatcgatgccttcataaactttccgcgacacacctcaaccttgggtgctcaccagcgatgcctagccatctacgagaccttagtccccaagagtaacaaactcaatcgaagattttcttgctatgaactcgagagctcaaagtattgtgtgaagctcactagtctccaatttcacaatcattcaatccaagtctctccccttctcaaatcccactcacaaataggcaccacaaaggtaggataatggggaaggctatttagctttggatgtgtctaataatgcccaagaacaacagccactcaaaggagggattggtgatatttcttaacgatatttctagaaatataaatcccagtaatggcgtagaaattttcatggtatacttatggttatagatatgtccgcaagcgcgcggatataccattgtagcatttcatctaggagtattccaaggtatcgtatttatttaatcccaagggaagatatgataagagaatactatgctaatagtttatatacttgtatacatcaaggtctatgcaagggttaagtaattcaaagggtatgtgacacacggaagaaagaactaggatactatcactaataatataatctaagctaagtggaggaataataagaaaagaattcattcctatacttctagtatacatacatatttagtctacacttgctagtacacaaccatgcaaccaataacccctaacagtgcccttctggtgttttgagagaccaccctgggttgtcaagttccttacgacaacctgtcatggccttccaacggggttaaatatggagtagtaccctccccaggaatttgtcttatgaatttatactaacgtggaggaatacccgtactgagttgtcactatcagtggctcacctctactgtcccgcagcatatatgcccagataatgatacttaataatctagacaccacgtctatattattaaatactactctatatcccccgagatgacatagagcaaccgagtaatcggacactaaacccacaccattgcacctatctggtaggctagctacagaactatattgatataagtataaatgaaagttggtacttagataatataaatggaataaaataccataaatgtataaaaaagaatattctgttaattcaataagtcttacaaaagaagagtggaaagctactagagccatacccgacttctcctgaagacccgaggattcagaatactattctaattcctactccactagcactaagatactactaaacttgagagagggagagagctcttcttcttgagtgtgtgttgaagtggagggagtgaagtccttatatagggcagttatgacggttataagtgtgcgacatgtcctttgtgccccgtaaccgccatcaggacatcatctggagcgtccacgccaaaaccaagaatcaacggcgcagatggggggttcggccgaaccatgagttgggccattctggtccattttcggcaggtgccccccttaactcctcccttatccaaatggcctagaggaatgtgtcaatcttgtgttcttggcccattcatccataagtctagatctcgacaatgtttgattgattgatcttttattttctattgattctcctgcatttatatgtgcttctcctatatacatgttagtagcatagtatatagtggaggtagatattttatttggaaattatgcattgcaggcatagctagtcttcattaattgagtaatattgatggtcaaaattggtcgataacgaccgtcaacaggggtggaggagtttatatacacgagcctctcagaactagccattgaaggacaagactatgactttcggaatttccgaaaggcctgttcggacaagcccgaaaattaacagaagtctatatgaatttcgcagtcatttttggaatttccaaaaaattttgggctttccgaaatatttttcggactttcggagttttttcagaatttccgaaaagcacatagtaatacgaccataacatttcgcttgggagtctgtttttgataatcttggactctatggaaagccgactcagaggactacccaactcaaccaaaaaacgtctaaaaacactcaaaggatttgttaaatcttgggtttctctcaaggtagcactatgacagatcactttgagcaccgacacatacacaaacacatcgacgttgcatcactcttgatagtacgacattcctgtactcaaatttaaataggaagagaattatactaataggaataccttctttccatcttccttcctttgtcttaagggaccgcaacgccaaaaccgtttcaccatatattcttcaaatgatttatgcggttacttgtagcttcaaatggtctcgcacggtccatcatgataacaccgtcacttcccctttaccaccggatttggttcttcggtgctatgccccttgcttgcccttcaccgccgcatggtgtatcgcgaccccttcaccgtcttgccatagtagccacctcatatccaacatcttcaatatctctactgtgttattcttggtattttaggtgtaatcatatcacttgagcatcaacatcttttcaatccttgggacctatttttctcattgaactcaatgaaattattagtctcaatgatccggttgtcaacctctacatgttgatttaccgatcgcgcatataaaaggataggaataaatcatgagtattaatcaacaccataagtgtcatatactcaaatatatgctcaactgtaaagatccgaattaaataaaagtgaataacttggatcaaatacatgcataactaaggtataggatttgcttcccctaaatgtatgcatacaaaatatttgtgtgaagcaatagtatgcataaaaagaaggaaaaagtacgaattacccccctgaattattgcgacagtatgaattacccccttgaaccacaaaaccaaacatattacacctcgaactattgataccggatgaattaccacctgactcaatcctgagcggtttttctcctatgtggcatacacgtggcgccgacgtggaaatctaatcaacaaaatgaaataaaataaaatattgggcccacctgccattaccactcttccctctctcctctcctctctctctcgggtgtgcgtgaacgagcagtgggcggcatcggcggcgcgtggacgggcggtcggcgtgcgggggccggcgggagatgtggcacggcgggcagcgcgcggcgtggaggaggcgaggcggcggcgaggttctctctcctcctcgttctctctctctcgtctggcgccgtcgggagagctgaggaaggatgaggcggcggatcctaactggtagtggaggaggcgaggcggcggcggaggtgagcgccacggcaaaggaggcgaggcagttctgcctgccgccgtcttgaggtccctccgtgactctccctgtcggcgctatgaacggcagtggcgcacgccgcgcctacgacagtcaggtgcaggcgtcgctgccatgaggccctacgcccaagtcaacatcacgaccttcggcgagctcgtgagcctcctcgtggcggaagccgaagatgaggcgcgcgcctcacccacccccgcgcgccgtcgtccaccgctcgtcgctgcgcgccccgctgcagcctctcgcccgcccgctgcgctcgccgcatccgccctagcacgtcgccatccacaactaatcgttgcgcgccccgccgcagcctcctgcccccaggcttgctctgcctccacctccaccgccggccacccgagctaccgccgaccacctggaggtcaagtggcgccacggtcaacggcgaggaggttggggatagggaagccactgtcggtcacccgagctcgctccgtctctgtcctcggccccgcgcttctcccccacccctgtctccagcacggcgatgtcctccgtcgatgagcgcgtgcgcagtgacgcctctctcgtctctgcctccattctgggcatgctcgtgttcctcctccgtggcgagcatgtgcgctggttggccgccgctgcgagctcgccatggaggcggcgagatcaacggcgagctccgctacctgccttgatgcgctagagatgtagagatcgaagggaaggggcaaagaggaaggggagaagtggaggctcgggctgacagtgggccccaccatctttatttgttgtggctgacaagtgggtcccatatatgtttcttttgttttggctgaccggactgccacgtgtgtgtccacgtaggaccgaaaccaccctggatcgatctaggggagtaattcgtccggtttgtaatgttcagggttaaaaataactggtattggagttcagggttaaaaatcgaacaaccgtaattgttgaggggggtaattcgtactttttcctaaaaagaatgaaacattaggagcttatcctatacaagaatagaatgcatttatcaaacatacgcattaaaagaaatgtataccttcatcatcttcatgttctcaatgtaaagagactaaacaagcaaaaaatgctcaaacaaaacattagtctcatgtgtatattgttattcacatcgaaatattatatatgaacatatcaatatgtacatggagagagagtgatagatatagctttatctccatgtatttcatccttgtaatttaggtgcatcaccaatgaacgtttctatctcaactcaactcatatgaagtctaggaatcagctctcacacactccactttcatatccacatttttttgaccttgaaaactgccagggctttgcctagcactttcatatccaaattagtctcacataattgaatttatcagtcatcatcaaaaccaaattattagcacttgaactttctatctccccctttttggtgattgatgacaaagccatcaggcttttggtattctatatctatataatattataaagctatttcactagtttgatttacatatttcagtcatgttgtttgtctagccttcaatcagaaccccaccggttccgaatattctttcggcatcacaatatgcttttggaatcttcctgacgaggacacaactagctcggatataaccattactaccttatatattaatcaaccaaaggtgcatatgttccatattagatttactagttatatatttgaacaaacgttgctacacaatgagttttgtgtgttttcgtttgcagaggtacttgcttgggtgaaagaaaagaggcgagcgtaaggaattcatggataattaaagaagttgattggggaccaaaccaaaaccttctccaagttcacttccatctcaccacgtcacttttggtccatagaagacaagacataaagttctacacgttttgaattcggatttgggcctcctgatagcatcaacttcaaacgaacctagccgctgatctagaaagaatttcggggcccatgagtacttgttggaaagcttataggcttagggtaaccctaggacatccctaatcatacttaatcagtagccgtcatcgtttagagtcgggttttgcttagattattctgttaagaacagttttgctgctaaatcggtttgtagaaccccaaattcgagtgcttaatcattcatatgcaattgtgttgcaatctatcttgttcttgcttgtgttcttcgattcgcatgcagggattagccttctcggtgaggtcaaccgggtttcggcatggttgataaccagaggagacgtggtgctgcgattgcggggctcagtagcgtgttcgtttagaagccggatcgagttgtccagcgaatccacccaaattgattgtttatcaatacttatcagaagatcgggacctaactttctcatcagttggtatcagagcgcggttgcctattaggtaatttgtcttcccataaccagaaaattgcaacacaaaaatatttattctttacctagacaattttagttgttgcattgttctattagattttgcattgttgaattcta

SEQ ID NO: 14293 - DNA, 9198 bp, Oryza sativa
ttttgtcttaaggagagcaatttttgctctgcattcattcccctaatattccagtgcacattccaagacttgtaattactcatgaataaaataggattgaaacaacaaccaaacagagctagtataactagcctataatgtcatagccaacatagtgctaacaactgaatcaatatatgacaaagtctcaaaaccacttgaccaaacacagacccttatagaattaactaaaaagaaacacaggtctgacaaaaactgtcagaacattaaaatcattttccctccatgtcaggcctgggcaccttctttcttcttgcaccccccaggctggattcagctacctcctcaggagctaggctgcacatatccactcccatcttttgcaacaaagagatagaacagtcagatggtgaggaatcagagtgattatcatcaggggcatattcagcaaaatcagactctttaatgttaccatcatcaaggatttttgctatacctgcaagctctttcaatttatttgcaaattttccccttggcttaccaatgcccattataggattcacttgtagttgtacttcctccttgctctgctgcaaccttgcactctgcctcctgtaaggattatagagtaaggtcttgccatctctttttttcactggagccttaggtagcacaggaagagctagtgcttgaccaacaaggctagaggaaggctgaacagacaaaggcatgacttccagcacttccatagcatcttgggcctgggaattcatggtatcatcatcagtcttagtgggaaccagggcccaatcctttatctcttgtcacgtccagaaattcactaataatttccgaacttatttgtgcataaaatcctcgtccaggaaacagccgaggtacacaaactgacaatttaaaatacaaatccatcctaataatagcgttacatacttacaaaagaaaagaaaaaacagcagaggaattaacggcctagcgatggcttcagctccactcccacaggcagctcaactggggtataagctaaacgtcttctccttctggatcctttttcttcaactgaggttgattgattattgcaaggtgagtacatggaatactctgcaagccacacaacaaatatgcaagtgcataaggataccaaaggatggcataatataggttcatttgcaaaaacatcatttagcaagcatttaagagtagtaaaacagtagagtaaataatcatcaattttaatcaacactgcacaacacacccatcctgcacaggcccaaccatcctgaacaaccatacccggctgtacagatctaactccaaaccaggagctaaacaaattattaccagttatagcatcaataattactgtgagaggtgtgagactaatcacgaaaaacattgctcaacccgcccatgaccgcgggcacggctattcgaatagttttactctggccagaggtgtaccactgtacccacaagacacaacctcaacatcatgtctaccatgcatcgcgatactggaaagtacccgaatagaggctgtgacaataccctctacacaacacaactcaccacagtgcaccgttcctggatcataatcaccccctctacaaccagaggcatggactccccagcgacacccatggacttctcgccgcttctcagtctgggaccccataatgaaccgtgctatacaaaaggtaaagccgttgcccacgctggcttgtggttggtacggttaatgtctgacaacagtagctcgcgaaccggtccttaattgtcatgagcacgaccttcaaaaccatgtgctcacaacccaccattgacaagttttaattatcaattaattatcataacatgattaaccatcgtgagctaccattaaatataatcataaataataatgtagtaagattcatcccattaatgagctaatgtttctaagcatggctaagcaattatatatatagcatttaactgaaccaaaccaatatataaggttcaagctaatcaatttattacccaaggtatcaaggaatagggtattcaatgcaaattggccataacaaaggaataggttcacaccacccggtgacattcgaaaataaatgcacagttgaaataaatagagaatttaaatatatgatcaatatgcacaaaggattgtgtttaggatctgtgtgacttgccttgcaagaatcggacttcaattagtcttcttgaacacttccgatgcactcatgaaccttcgcaacgacggaaatgacaagctaacacgcaaaacaaaaaaaaagactaataaaaaccaaataaacagtacataaaagtaaacaaacatgtagatcatgattttagatgaatttagagacttgaaccacttaattccgacttcatatgaattagttatgtactttacaagataaatctgattttagacttatacagaaagggattaacgatgtcatgacgacatcactgccggcgttggagggtttgggcggccaaaccgagggcaccagaagaaagaacatgacgaggggaactcactgaggggcggcacgacgaagaacgacgacgggagacggccagcgacgagctccgaagggcggcgaggtactggtcgacggcgacagcggctttctggcgatctttagcggaggaaaattagcggacgggcttcaccttggcgctgcgatgccgaagaaggcgacgacgacgtccagcaaccactgagtcgacggcgaggctcggccggaggtgaagtagatcggattcacgccgacgaggagcttccagcgggttacggcaaaaaggaaccggtggccgggcttcttctcctccttgcgaacccggtggtgacggcggcgtccagaggcgacgatggacggtgacgagcggcacggctggagcggctgccggcgacggagagagaagatggctaaggcacgggagctcgagcaaggggtttaaaacgaaagaggagagcctggggtttctatttataggcaaaggtggaggagattagctcggacccgagaggagagaatggcgccggatcgggaagaacagtggctctggtggtagaagatgacactgttgtgacagggaggaagtagagtttttgcttggcggaaaagaaaagaagagagggactagaattagacttttctgggaaagaaggagacaggaaacagagacaggcaaagaggaaggatgggctgaggatgagtagacttttccagtttcagcccgaaaaggaaaaggggaatttcaattacttttccaattaaattaatcactgaaatgatctttgaattgttaaaaatatttccaatgctcaaataatttcaagaaaaatcctgaaagtacttgaacactataagtatttaacaaaattataatcagaccatttaatgattaatttaatatgtggataattactgaaatgttgtttgtattattaaaattaggagttgagcttcgaaaaatccaagaaaatttcagagagtatgattaaccatggagaatttaataaaaattaaatccagccatgctttatatttaggaaattttatttcccacatttaacttcacttgtaaattaatgaacatttaatataaattctaataataatttattaaataatttataaatcctgaaacgaaaatcaggttgtgacatctcttgacccaccaaaggagcaaaatcaaacattgtcgttttgggaaggacaagtgtggtaaaaggattggttgcatgtatggcagcaggaacagaactggaggctaaaaactgatgcatagttcccttttctttgcgcagaagatcaatcttatcattcaggccagacattggataaaaaaatggatgcgcaggattttcacttctagcaattttgcccaacttagctaggaattcctgaacctttgggtcctggactgaaacttggaccttgtccttcctaacaagagaaacagctgtaggaacaggagcactgacatcaggaatagcaggtaccaaagctagcataccatcaggattaacctccattacttggcccattggatggtcttggctccatgcattgtccagctcagcatctgcagcttgttgacccgcaggaggctgacccatctgccaaatgttacctgcatcaagatcatcatcatcattatatgggtcatttggatcatgttgagggcccgcagggggcagatcttcattagggggcaagttgagaaaatccccttctaacaagaaaactgaaactgtccaagactctcctcccccacccatacctactgggtcgtgcagaacaattttgcgcggtacataatcgttgtctttaaacttaggccttatcagaactctccatttcatctcatccctttcaagctaaaaggaaagctgaccaaaagtgattgtagctaggtttagatgatcccaatcaacaaagtcaaggggaaaatccaagaaaagaaaccagccctccctattgtactgcgaggctctccaatttgttccctgatcatgctttacgaaagaaaccgagtgcacaccatcatagataaatggctcactatggaccagagcatctctatgcatagcagagcgaagttgatacatacccaccgcagaagcatgacgaaagctatttctgacctcaaaaagatgctcatcaagaatgtgatgcaggataagcatatggtggtgatcccaatcttactccggcactggcggctccaccaaagcaaggcagaactcctcatggcgatgaacaggcctttcagggaatgtgagatcaactcttgggacacgcaaatttcctcccaaatgcacaatgtgaccttgatggaggaaacgaagggggttagggttaagattcgccattggcaagggaatcggggtccggggaggcttgaacagtagtatcaacagtagattggaggagatgagggggttgcgtgataaccggcactatctctttaggtctccaaataaaattgccattaccccgggagtttaggactgcagtagaattaatgcggggggaaaaaaagactttgacaatttaaccatggagacaggcctagagctgcatgacccatattcatgcaggtgcggcaccggaaaggcccaacacaggcagacaaagaatgccccttctctaagcaacgtccacaaattaaatttgaatttaaaacttgcttaggaaacggatcccgattacctcgctcattttgaaatttgagactagccgccggctggatcaccggagctttggtcaccagaatggtggtcgctggagaaaccacgccatgcaccttcaagggctcctttaatctatcaaaaacactcttcaaaggaatatcactgtgaacagcttgagcgtaagaacgacccggttgtcccagagaaccagagatacgtttcttaggagccaccgaaatccattctttttcttgatcacgggtccaagcatcaaattcccattgccaattaggtccaccatttctccaaaggaagaagcgtagaacaaaatcatcacaagagaaagacctcaaacgataaatccataaacccactggcttggagcagaccaagaaagaataagaacgatctttaagaagggtaacagagagatccacaggagaaccaccaatcacagccctgagggctagagcaacagaagacgttgtcaaacgaaaatttgaacggggaatatccaccgctaaccggaaaggaggcgagctgaacttagcagagaaataaaccggcgatcgaaaacgatgccaagcttcatccctaattgcatcaccgggagagaaattccaccctcccagcggtgccggagtcaccatggaggatcactggaaatcgcccatcagagcacctccgtgaaaaccggatcgactagcttactcgtagcctcaactgctggtttatatgatactcctatctgatagatcatctgaggcgtttcaattgggggagtgcagatgagtattggcatcctcgttaggcttgccacagaacgggctagcatgcgccatcgtgatgagcctagacttcaagtcgaaatccacgtcccctatgttgacctacggcccaatggccacattgtcagcagagggagcagcgaactcacggagagtcttgttagccatagtcttgaaggttggtggcgctggtacggctggtttctctgtcggtagagttttctgcggagcagcgacttgcggcctgacgctccggaagaaagcttctggattttctttgaagttttccggcaagttgataccagtcatgcactaccctattttcacaacaaaagtgaaaacaaccaaggttagcctgcaaaggaaaatgattatacagaggcaaatataaaatattagttcaagtagtctctattatgaatctttctcggcaacggcgccataaatgcttattggtattcccagcaatggcgcagaaatacttctggtatattttggttacagagttcatccgcaagcgcacggatataccattgtagcatttcacccaagagtatttcaagggtatcgtatttattttatcctgtgggaagataatgtagagagaacttgactaataatttatatattacttgtgataatcatattctaagcaggggttaagataatccaagggtagagtgacacacaagcattaactactcattctcataatatattatctaagctaagtggatagaaaagagaaagataatctattcctatacttataaaatacatagtatacatacattctaggtaaccgatatactagctaataccctctatccgatgccctcctggtacatcgagaagccacccctgactgccgagttccttacgacagcccgtcatgaccatacaaccggggctaaatacggaggaataccctccccaaggaattaacttaggattatataccggcacggaggaatacccgtactgagctatcaccatcagcggcccacctcttatccgcaatatataaccccaaaaaatgatatctcgtaatctagacaccacgtctaaactactagatactactctaatatcatcgtcatgacatagagtaattgcataagcaaacactatacccgcaccaaagcatctcctagataagctagccgtatattcagtataacatgaacataatgtaaagtaagtactcatatactcggaaagtatttcaataccataaatgtatttagaagagtattctaataaaaatacaaggcttacaaaagagaagagaaaagctactatagccatacccgaactcttccaaaggcttccgtactcctgatttctactctattcctattccaccagctagatactactaaactaaacttgagagaaatgagagagctattgcttgaggtgtgtgagtgaagtgagaagaggaactccttttatagctgaactatgacggttgtgatggctggaatggtcggtaataccctccaaccgtcattggggcttcatctcaaccgtccagccaagacctggatccaacggaggcgagggagtttcggccgaaccccctagttcggctgaacctggggccggcccaactagcccatgctttggctggcggcctcctctgttgttcttctccgcagacagtgaattttggcccagtttgtcatgtcaattctgagttcttggcccattcatacataagtctggttctcgatatcgtccgattgatttatcgtctgagttgatgtcgattctcctccactttattgttattctctacaaaaggttagtagacctaatattagtgaaatattattattctaacatatttatgcattgcaagcatcactagttctcctctattttggtaatattaacggtcgaaactgatcgataatgaccgtcaacacctgccgttcttgtgagtagcgtcgtgattgttcgcgcacgtgagagagaacaacaaattagatcggtttgtttttttttggccactgtacgtttcacatcaaggcacatagaagagtccatctccaccttgaccagccactacacaagcccacctctctcaaacttgaccgaggctgttaccaccctccacctcatcacgaccatactgacctctccacttcggggtagcgggtatcgagtccgtagttttctctatatcatataattgttaagtagcggatttgagatatttttataaaaacgaaacctacgcgatgtgagcatttcatttttgagatgatctaattttagttttgcactttgcatttaagtccctgtaatattcatatttacatttgagtccctgctcgaggtcggtggttagttcttgttggaaaaaatagtaaaataatataaaaaagaaaggcagaaaggtgcaaagaaaaagaaagaaaaagccacaccaaaaaaaagaagaaaaggcagaaaggtgcttaaaaaaggccgcaccaagaaagaaaaagataaaatattcatcctttgagtatgttttcagagtgtagagttgtgcaatgattcatatctagctcttagtgttgtcgggtgcctacttgagctagagttgagcctaggctaggccagcacattgactagtactttgaactattattcaactttgcattttctgattagcacaattgcgttcctttgctactatatattatgcctcccaagctccacatatatacttctggtcagcaccactttgatccttgcaatcgccacatcacgtccttgaaggtgtcacgaactagccaccggttgtaccgtccttagcattgctgataagacacttgtaagagcttgataaagtgctccattttccggagttgttgagagacaccactacaccgtgtagctgattattagtgataaccttcactgtttgttgctgtttttgtgtttgcaatgacaggtatgggtggcgctcaaaatcagcgataccaacaaggtaacaataatcgcgtgcccgatgatccttgtgctaaggttatgtttaaaataccatctttttcgggttattatgatgctgagaaatattttgattgggagatgatagtagagcaaaaatttagtacccaccttgtgcctgagcaacatcgagttcgacaagctacttgtgagtttaaagattatgcttatatttggttg

SEQ ID NO: 14294 - DNA, 1186 bp, Oryza sativa
cactcaactatttagagaagaaattatttgctagatttttattgccatgaccttcagatgtgattttttatgttattggcaattatggtagtaaaggagaatataatgtgcattgagtatatatttgtttgaatttgaccatacctccttttcatgatgaaatgaattgtctaggggactgcatgtgtagaagtaattctctatctagttgctttagttgtttaaatgagttacaggttggtttgcaagaaggggagtgttgtgattttgaccatcaaaaattttcctcaccagatgttgagatagataaagataagttcaatacactccatgacaagatgaaaccgaggacggtttccaatcaagaaggggaggataatgaggacacaactagctcggatataaccatgactatcttatatattaatcaaccaaaggtgcatatgttctatatgagatttacttgttatatatttgaacaaacgttgctacacaatgatcaaagtggtgctgaccagaagtatatttgtggagcttgggaggcacaatatatagtagcaaagagacacaattgtgctaatcagaaaatgcaaagttgaataatagttcaaagtactagtcaatgtgttggcctagcctagactcaattctagctcaagcaagcacccgacaacactaaggactagatattaataattgcacaactctgcactctcaaaacatattcaaaggatgaatgattttttttctttcacggtgtggcttttatttaaacacctttctgccttgtttttttcttttttaggtgcggctttttctttcttttttctttgcacctttcttccttttctttctttctttagtttttttttacttttttttcaacaagagctgaccactaacctcgaacagggactcatatgtaaatataaatattgcagggactcaaacacaaagtgcaaaactaaaattggataacctcaaaaatgtattgctcatatcatgtaggtttcgtttttacaaaaatatctcaaatccgcataaatatttgatatatggatgactacgaactcatacccaggttcggaggtggaaggtgggagtcgctcggttttctttctcacagcacacgcgcacatacgccacacatgaaaacctaacaaccaggcaactccaaaaccgctcg

SEQ ID NO: 14295 - DNA, 1070 bp, Oryza sativa
ttctatctggagtttgtttgttgttttaccgtatatacaggattttctcaaagtttctaaattatctctcggacttgccttaatctaataaattagtgttttatacactattacagccaacagaaaggcagagagccatatataggtggtcgatggcatcagcaagggacctccttaatcaccatgtagctaatcctctttggtacggcattggatttggggatactcatctttacctatatctttacctctactattataaaaattgaagatatttttaccggtactttgttacgttatccgcgtttgagtcaattttttaattttattttacgttgtctgttaaaaagaaaaaacagtccgactcaaagaggtaaaaaaaaaaagtgtccgactcaaaagcgattaaaaaaaaccttctgtcgtcactcatcagtgaaaataggaaaaaaatcatctagagtccgacttccgtaaaaagtcttgccacgggtattttttccgactttttacatgcgattgagtttttttcgcacgcaattaggctcttggttttttttctcttttttttaatccgatcacgcctccctggcgcttttgttttttttatcaattttttgtcaccggttttttctcccgtgcgattttggtttttctcatctggttttttaatccaatcattcgccgcacgccttccgagttgaacccaggcaccgtgccgccaccatattgattgtgcgttttttcctccaatttgattgcaaaaatcgattcctcattcctcccttatcattttctccattatttttcctttcgattcggttttaatttatcggatttaatctcctttaacaattgcgattcctcattcctccatcatcattttctccattattttccctttcgattcggttgtaatttgtcggatgtaatctcctttaacaattgctgatgatgatggcgatcttccccgatcatttttatcccgagttttgcactttgattttagaaaaaaatgaaaagaggtcattgtggatcaaaaaacctaaccacatttgggtgatcgagaa

SEQ ID NO: 14296 - DNA, 2726 bp, Oryza sativa
acatctacaagatacgattggtggcgaaaagttacagacaaattcaaggtgttgattatgatgaaactttctcgccagtcgccatgctaaaatctattcagattgttttagcgattgctgtctatttcgattatgagatatggaaaatggatgtcaaaacagctttcctcaatgcaaatctcgatgaggatgtgtacatgacacaacccaagggttttgttgatccacaattagttaaaaagatatgcaaattgcagaaatccatttatgggttgaagcaagcaatctcggagttggaatattcgttttgacgaagtagtcaaggcgttgggctttgtcaaaaacgaagaagagccttgtgtatacaagaagattagtgggagcgcactggtgtttctaatactatatgtagatgacatattattgattgggaacgatattcctatgcttgaattcgttaagacatcgttgaaaaatagtttttaatgaaggacttaggggaagcagcatatattctaggcataagaatctatagagatagatcaaagaggctaattggattaaggcagagtacatacattgacaaggtgttgaagaggttcaacatgcaagattctaaaaaaggtttcttaccgatgtcacatgacattaatcttggcaagaatcagtgttctcaaacgactgatgagcgaaacaagatgagtgtgattccatatgcctcggcaatcggatccatcatgtatgctatgctatgtacacgtccagatgtttcatacgcacttagtgcaacaagccgataccaatcagatccaggtgagactcactggatagctgtaaagaatatccttaagtacttgataagaactaaggatatgttcctagtctatggaggacaggaagagctcgttgtaaatgattacaccgacgcaagcttccaaaccgacaaagatgattttagatcgcagtctggatttgtgttctgcctgaatggaggcgctgtgagttggaagagttccaagcaagatacattggctaattctacaacaaaaaccgaatacattgccgcttctgaagcagcaaaggaggctgtttggataaaaaaattcgtttctcaactaggtgtgatgactagtacttctagccctatggacctctattgcgataatagtggtgccattgcacaagccaaggagcctagatcgcatcaaaagtccacacattttatggcggtatcacctcattcacgagatagtgagtagaggatatgtgaagatatgcaaaatacatacggatttgaatgttgcagatccgttgacaaaggcactccctcagcctaagcatgaggcacacactagggcaataggtataagatacattcatgattgactctagtgcaagtgggagactgttagtgatatgccctagaggcaatcatagagataattgtatcacatactatgtttaaatatttatccgacattgttccttgaaatagataactccttattggttaatgaatatgtgattctttcatcagactctttatttgtttgttactatttctaaaggatccctgatcaaatatcatatgtagaacaaatatgtttatatgatcagaacatgtattaattgatgatcatgtctcatggatcatggtatagagatactaaattaataatctggacacatgttggtgaacatgttgttcgatagacccaacatgagacactgcaagagctatatgtgttgtgtcatcagtgatcttatttagtgttggtgttgaatccttagacttgagattatcatggttctcaacatgtgtagtagcttacttacggactactaaactctactatgtaaatgggtagctataaaagtagttttcgggtatgctatgaaacatgtagtgggatataaataaccaagatgggatttgcccctcctatggagagatatctctgggcccctggatgttgtagattatggaagtgcatgaccatgccaaaggtgattgaggagtcaatcacaagttatataatctatcaacaggttcgagtgaatgattgagctattagaggatggcacatatctagccttgagcttagtcgatatcgtgaggcaccgggttcatacaagtatacagtagaggtttagccgatatgatctttatgtatgcgtagtgggtcaatacgttctgctaggggccgctgttgatgcgtggaccgaaaaggagttttcggggtacagccgagtatatatgaacctacagggtcgcacgcttaatgggcctgaataaggggattggatagagatccaatatgagcttaatttggatagggatccgaatcggagtcctacgggccttggaggctcgagtgatggatcctatatatttgtgaggggtgtgaccggcggaggcattgcatcacgtgagaaaccctagtcgtcactcccctccccgagcaaaaccctagccgcgcgcgggtgctagcacatctgcgcgtggcgttccatccctatacgtgtggataccggtaaaggcgccgctagtttgcggtgctgatcggtgtgggagtacggcaaggagaacacacgaggaggagaaggtcgagtcggtgcgatcgactacttcctctacatcgacgcgcgctacttcgcgagagttccttcgacttctcagcgtcttcttccgctgcacagcgcgtcgagtggtaactatctatgat

SEQ ID NO: 14297 - DNA, 1206 bp, Oryza sativa
agtcatctttcaaatgttaaggttagttaactcatgcattttaagaataaattcagcgtgtgcattagaatcattatgaaccctctcactagtaggtaaaggcaaaatatcaattcgagcacgagggttgaaaccatacactatctgaaaaggacttaccttggtagtagaatgtgttgcccgattgtatgcaaactccacatgaggcaaacattcttctcacatcttcaaatttttcttcaaaatagccctcaatatggtacccaaagtttggttgactacctctgtttgtccatctgtttgtgggtgacatgatgtagaaaacaatagctttgtacccaagttgttccatagcgtgcgccaaaaatgacttaagagttttgcatctcgatctataacaatagtagaaggcataccatgcaagcgaacaatctcatggaaaaacatatcagcaatatgaacagcatcatcacttttatgacatggtatgaaatgtgccatcttagaaaaacgatccaccacaacaaaaatgctatccctccccctcttagttctgggcaatcccgaaacaaagtccatagaaatatctgcccaagaaatagaaggtacaggaagaggcatatacaaaccatgtggattcaaatgagacttagctttctgacaagtggtgcaacgtgctacgaacctctcaacatcttttctcatccttggccaaaagaaatgcatggccaaaacatcttccgtcttcttagctccaaaatgtcccatcaagcctcctccatgcgcttcctgtattatcaaaagacgaacggaaccaactggaatgcatagacggttagctctataaacaaatccaccattgatcacaatttttttccaagtacgtccctctttgcaatttaacatcacttcattaaaatcaggatcaagcgcatattgttctttaattgattcaagtacaaaaatccgacaatcaagttgggacaagaaagtatagcgcctagacaaaacatctgcaatcacattatctttccctttcttgcgtttgataacataaggaaaagattcaataaattcaacccatttagcatgtctacgattcaaattattttgagaccgaagatatttaagcgattcgtgatcggactgaataacaaattctttatgccacaaataatgacgccacgtctctaaagaacgtacaag

SEQ ID NO: 14298 - DNA, 11061 bp, Oryza sativa
  unsure (1)..(11061): unsure at all n locations
ataaaaggccttaaaacctcattcattaagcgcatgaaagtactaggtgcattagtcaaaccaaaaggcattactaaccactcatacaaaccaaatttagttttgaaagctgttttccattcatctccaagtttcattctaatttggtggtagccactacgcaagtcaatctttgtgaaaattatagaaccacacaactcatcaagcatgtcgtctaacctaggaataggatgacaatatcggatagtaatattattaatggctctacaatcaacacacattcgccaagaaccatctttcttaggaaccaaaattacaggaactacacaaggactaaggctttgacgtacatacccgctgtccaaaagatcttgaacttgccgctgaatttccttagtctcctctaggttagttcgataagcagcacggtttggcaatgatgctcctggaatcaaatcaatttgatgctctatccctctcataggtggcaatcccggggatatctcagctggaaagacatcctcatactcctgcaaaaggttagtaacaacaggaggtatcgaacgagcaatatcatctagagaaaccaaggcttatttgcatatcaagaaatagcacatatcattatctgaaattacagcaatgtcacatttcgtagcaagcataacaccacccttcaacttaattccctcaaccttagaactaggtgaaagcttatcctttttgggtggaaaaacagatttagccacttgctgattttcagactcatcaagtttcaaactagcagctcgctctttatcagcttctacaatttcagcaggggtaaaaggtagcaaagtaattttcttttcattatgcacaaaagtgtatttattactcctatcatggtgtgtagcatcattatcatgttcccaaggacgacccagcaaaagtaaacaagcttgcataggaaccacatcacaatcaacagaatctgcatatgagccaatggaaaatgaaaccctacaaacctgtgttacctttgctcttccggaatcgtttaaccactgaatatggtaaggatgtggatgtgtacgtgttgtcaagccaagcttagtgaccaaatcagaactcaccaaattattgcagctacctgcatcaatgatcacacgtgcacgatggttgttgatgacaaagaaaatctgaaacaaattatggcgttgcaacctctcaggctactgtacctgcgtgctgagcacccgctgcacaatgatggtcctgtaatccgatgtgtcatcatgaccaaagacttcgccatcctcatcctcaacttcttcttcctcctcttcctctttcacgtcggaggtggtgatgtagccatcttctgtagcaacataggcccgttgactagggcaatctttttctgcacatgcccaaacccttggcaatggtggcactgaatgcgtcccgtcgaggcgatagatgaggaactcttggcaggtatctgcgaagaacctttacctgactctgcttggtggagatggttttggtgccgtagaagctccagatgcagctggtcgcttgctcgctggctgggaatgcacccgaaaagagacagccttgggcagtcccgcagatggcgtcgtgcgcggagtgtatgtacttgccttgttcttgccctgatggtcacgcccctgcaattccttctctgcaagcatagcaaaccgaaacaactggttgacagagttaaattctttataatcaacaatattctgaatttcctccctcaaacaagagtaaaaacaacaaatagcatcctcgaccccctccactatgccacagcgtctcacacccttttgtagctcaccatagtaatcctgtacagatttatccccttgttccaaacgcatcagtttcttgcgcaaatctctatgataagatggaggaacaaacctatcgcgcatagctaccttaagttcttcccaagtagtaggtagtaccccctcatcagacaacccagcccaccacatgatagcaaaatccttgaactcactactggcttgtctaactctatgttgctcaggtataagttgggcattaaactttgttctactgccatctcccaatcaaggtatttctcagcatcataatatcccgaaaaagatggtattttaaacataaccatagcataaggataatcgggcacacgattattattaccttgttggtggcgagtgccacccatacctgtgcggtttgtgcgtaggtgacgtcgtagctgtgcttgccttgtagctggtgtgtcaatatagccactggaatcatacaccgtatcttccggatgagcatcgtcgtcaccactcaccacttcctcattggaaggtgtctccaacgcggcaacccgatcagttagcgtggatatccgtttgtccaacctctccatgtggttcaggaagctgagtttagtgaaggcatcttgcacagactttccaacggcctccgtgatgtcctttttcttggagagttcatagttgctcttagctgacatagtcagcaaaatcctggggactcttctcaccttcgttacctgccattgaaacaccaaaacagaaacaaacggtgaaggttatccctaataatctactacgcaggtgtagtggtgcctctcaacgattctcagcaatatggagtacctaaccaagctcttataaggttcttagtagcaaagcaaaggatacctggaaggcgtagtcagcgatgcagggatcaagaacctgtgctgtccagaagtaaatatgtggagctaggaaggccaaatatatgtatatgagtggtacacaatccaatgacagatagtaatgctgaataaaaatcccaagtcacttgcccttagttgctggtctactcgtgtattagacagtagtggtaacaataatggttcaaggaaaatgacactagtaaatagcaaagaaggacttgcaggcaagcttcggcgagttttagcaaaaacaacaaaaccgaactggcagataagctcaacggagcacgtcgtgagcttaatgcagtagtggaaatcaacttttctttttttttcttttatttttttgatatttttttctttttccagaacacgaaaataggcacacctctaagttacagctcaatcggagttgatatgtggcctatggaattttctgaaaccactataaacaaggtgcaggaacttgtgggctcgaacagacaattttgcaagccaaattttagaatttttttctcttatctgaaaagttaaaatttgcctgattccgagtccgtatgcaaaagttatggctgtttgaagttttggcttctggctaagttttccaaaggggatataacctagcctattttgcggtggaattgggatatggtggcagcggagtttgtaggatgttgtggtgatgcgtggtgatctggaattgggtgtttatgatggcggaaatggctctcaaaggatagggttataaaggaaaaaacacacgactagactaaaacacgcactagaccagcaataggaacttaaactaggactcaaactcaacactacggactctgaaaaagaatcatgcaaaggctaaacacggtctaggttaaggttactaacgactaaattttttttggcttttctgtagactctaggataattacgaaaaacaaaaactaatctagggcaaagaaactgagcgaacctgacggtgaacctagagctctgataccacttgatgtgcactagggttcccgatcttccgaaatgttttgataaacaacgatttgggcggagtcgcgacacaaatcgatctgtcttcttgaacgcgcacgctcttgagccccgcaatcgcagcaccacgtctcctctggttatcacccgtgtcgaaacgcggatgacctcgccgagaaggctaatccctgtttgccaatcgaagaacacaaagaagaacgagatagaaaacaaccaaaattgcagatgaatgattaagctcacgagttgtggtcttacaaaccgatctagcggggaaactgttctcgacagattaatctaagcaaaacccaaagacctaaagatggcggcggtacttatatatagagtttagggtcttgcaacccgctctcgacgcaacgctaatgagttccaacgcgatacacggcccaaaagtccaaatacggtgacgcaacaccgggacagattctggacatcaacttgttcggtcgattcctattgactcggaaagaatttggatgtgggaccagaaccattggaaaggttatctttttagctttccatccatataaagaacgtgtagcgcccgttccgtcgtggcgcctagcgggaaaactatctcttaaaaaccctaattgcgaaatctgtttccttgcttgttgtctatccccgatctatcgtcaaagttcaatcccgaatctaaatccttcccaaatcaaatccctccgcagaagtctattttgcctccctcaggttcgatgggccgaattcctctcggcccatctcccccctccccatctccccctctctctctctctctctttctcccgctctgcccatgagccgcgccgagccctccctctccgctctcgctgccgttcccaccgatgccacccaaatcgccgcgccggccgcgcgcgcgcgcgccgtggtggccgaccggccactcgccgctgccgtccgcgcctgccgcgcctgccgcgcctcccgtgcctgccacccgtgtcgtcgctccactccaaaccgcccccgccgtcatcgccgtcgtcatcgacccggcctccgccactccgcgcgctagcctccaagggacggaggcagagctcctcctccctctgccgcgtcgcccccgttccctccttcttttcccaaagtggcaatgggcaagccccctttcttccttccttttccctttttctcttccttcgctggcgtcattcccctcctccctgtggacgatttggccactagccggagcgcccgatcactggcttgaccgtccaatgtcggttcccctctcccaaaccgactttgtcgcccatataaacccaagctcccccctttcctttcctctaccattcgccctcgctccaccgcgccattgccgtcccctctgtcccgcccccgccgtcaccgccgccgtcacgtgtgccgaagcagccggtgtgcgttaggacgcggaaggggacttcgggcgcgccctcttcttcctctacctcggcccgaggccggagtgatcactcccgtgccgtcagcctctcgtcacagcgccccacctcgtctcagtagtgcctccctccgttctccatcctcgttccatctcctccccttagactcgggtagtagcacgagtagcctcctcgtagctagctagcgccgccccgaccattgcagccgctcgctgtgtgctcgccaccgtcgccgcccgtgctccgtagcgcccgctcgtcgctggcctcgctcggcgtagctccgcccaatccgacgctagcaacggattcccggagtcgcgtagatgctctagctcgcccgaatcggtctcccgtcacaccttcgccgtttcccccttctcccaccgccggttgcccccgccgcaatccgccgccgtcgagcatcctccggcgaatccgagccgttggctcgtctcccctcgtcccgagcaacttcccggtgtgctcgctttcgactgtatcgccgtggttcgctacgccgcctgccaccgtcgtccgccgtccgttccggccgacgtcgtcatctacctcccgccggcccgcgtggcagccacgtaagcgccacgtcggcgccacctcggccgcgtccgagtcaagctgaccccggtccgccgctttccctccgccccactcgcgcgcgcggtccaccacgagccgtgaggctgcgcgtgggcccgccgcaccgcgtcctccgtgaaccgcgcgcatgcgccgcgcctccctccccaaaccctagcacaccctgcgtgcacctcgctcacggtgagccaagtcgccgacaagcgagtcccacccgggaccacgcgggatggacccggcccaccggctctctctctctcctccccgcccgcgcgcatgttttgggccgccttctcgggccggccggcccgttaagttcggccgagccgcccctttctctcgggccgcgccctagccgcctaaggaaagtctaatttccctccctccttcttttcttttcttttctttttcaaaaaggatttaaataaatccttttcctttagaccaaaaatccaataatcttagaaattcaatatcttcccaaccgtaagtccgtttgactctgttcaacttccaaaattcctcaaatctcgagatctatataatggcacgcttagaggtcaataatagggctttatttttgccgtttgctgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattaataggattgcacttaatctgcttgtcccgtctgcaaggcagattggcggacctacctaacttgttgcatttgacccttccatcgaaattcttataccatgttcccttgtaaccacctagttacgcctcggcaatcgtgcactctgcacgagtaacgacggtcgccttcaaacttaaaatctgagaaacatcttgggtaaaacatgggttttataaaagacttggaaaacctgacaccagggtcggtgcttgcgaacctaaatgaatttccaaaatcgcggaccggggaacgtaccgggtgtacggtttcccgctcttgcacttaaggaccgtttccttggaatttcatccgaacataagacaagtacgaccacatgggtggaatgggacacccctggctaagtaactagctaatcgggggagccatgatgccaagagacatgtggattcaacggggtggtgtcggggaggacccccgggtttcttggcacagtatggtctgggacctcatctagtgttggtctgggacccctctcgttggcatatggtgaacctgtgtcggctttccaaatgccttgtcatgaaagccttaaggtctctagtcgtggccgttctgcacgggctggatgatctgggttagtaatgtcgtgtgggtaaagtgtaccccctctgcagaggttattaaactgttcgaacagccgtgcccacggtcatgggcggatgtgaggtgattcctagcgtagttttgtttgactactgctttgtgaaatttgctgatgtggtttgggattgatgtttggaaaatctgcggctgatgggatcatccaggcccaggtggccgtttaaaagccgttggccgggtgccaaccttgatcaattcaaaagactgataccttgcacatacttcgaccagacgagacgcactgtctcatctgtatcgtttgagaagcactcacttagttgtttcagaaaagagtttaaataaaatcaattgcaaaaacaacagcctttccttgaagcctgcattaaacacttatttcccatggcttgctgagtactcccgtactcacccttgctgtatataaataatcccccccagttgttgaagaagatgaagcggatcccgctgacgaggagttcttccaggagcaagccggctacgatgagttttagggttttcggcctagttcccaagtcgcgcctgtgatgtttggtccaagtcttggcttccgctttccttttgtaatgcagttgtgagctcgggatctgtccgcagcccaacatgactgggctcctactctataataaagagacctctgttgctgtgatattctgtcttcctgtgatactagcactgtttcctgggactggtatcgattaacaggttaatttggagcgtcacgggctagttctgctcgggactagtccggggcgtggcaagagatggtatcagagcacaggcttggccctagggcgaaacccgacgtttaggacgaccctaaggatgctaagttcaaaactacttgcgaaaagctaaggctccttttggtttctttattttcaatagtttgttgctaaaatggttattgatcttttctccctctttcaaaattgtagatggcagtgaacgccagcttcagttcccacggttttggcgagggtcaccacgtcgctcagcttcgtgacctcgcccgcttccttggcttctcgtgtcccgagtacacggggtactccgtggaccgtgttccccctcgctgtgagctctgtgtacctttaccctcgtggaggtatacacggagctggcctttgcccacaccacttcactgtggccaggcccactctccagatcgcgtaccaggacctctcctggactgcgcttcgacgcttggcccatgactacagccaccgtctcgggggctctgccttctggcagctcccacgccttccttctggccacgcagacgccaggtacccttgtccgtacagcgagtctcagccagtgctgactcgcatggtggagctttcggaggcttaggccactcagcacgacctactcctcgaggcttaccgctcccttgcccgccgctacgccgctctggaggcccgtctggccgaggagggtgtcacctcagttgacactgtctcttgggactcaggccgcctctgccacgccagccacctgtcctcccacagctctcgcggctcttcctgcactcccagtggcccgcgctcccccagctcgcgtgcgccgtactcaccagtgtactccccctacccacacccagttagcccctcctacacccccggacacaccccagttgcttcctcccgccgtggcccacgctttatccgcactgtgcggaagcatgttgttggttcttccaccgtgttccgcttcgactacccagctcccccaccgccagcggcccgtactgctgccggccctcgacaggttccgccggtcccttcgcgctagccgatcgacgtttcttcgactgaggagccgactacaagaggcagccaggcagacgaggagtagaggaggcagtcttcagcagctgtccgtgtgttaggcccttttgttccgccgccaactcttttggagtcatggcgagatagtgcgtgcgtgtgtttgatgtgggtgttgtttggtagtctggttctcgtaggtggtgtgcgtacagtcaagctcggcgtagctctgtgacttgtccacacccgttgtatcaggtgtttttatgatttgaaaaatccagtttatgcctagtgcgtgctatctgagttgttatttactttgctccttgccctcctaagtgcttatctgattcttacctcgccctcttcggtttagatggctagccgcccccgccgtgctgctcatgcatcagcctgcttcggttttgaggaaggtagagttgagccagaagcaaatcatgagtcagctaatgagcaatctcaccacagcaaccgttcgcaccgtactgcttcccgcaatgcagaagttgagcaaccccgccgcagcaaccgctcgcatcacacagcttcccgtatagcagagatggaacagtctcaccaatctcaccgcgctgctagtcacaattctggagaagaacgcatcccttccccacctcatgtggaaaacaacatgcaacacctgatggcagttcagacacagatcttgcaaggattagccgcggctatagccggctttcagcataatgcgcatggaaatggccaccctcacatgagcaacaatagatccaaactgaccgacttcctgaggtctcggccgccagagttctctcagaccgtcgagcccgttgaggctgacgattggctgaaggatgttgatagaaaactcaacttagtgcagtgtactcctgttgagaagacgctctacgcctctcaccagctaagaggacctgctgcagattggtgggagaattactgcaatgcacaccctgaactcactaacattgcttgggatgagtttgctatggctttccgtgcagctcatgtgcccgaaagcaccattgatatgaagaaagaggaatttaacaggcttaagcaaggcaacaacagtatcaatgagtacctaagtcagttcaacaagttggctcggtatgcccctaaggaagtggacacagacaataagaagatcaggaagttcttgaagggaatcgcagttggaatgagactccagttgcttgctcatgacttccccacttttcaacatatgatcaacaaggcacttctacttgaggatgccagaaaagagtctgccgaagaatataagaaacgcaagtctaaccatcaggggaattcttcccgaggcgcacctcgccctcgctatggtcaacccatgcaataccactagtcggtcactcaagctaaccgccagccaggctacgcccctcgtcctcagatgaaccgctcggcacctcagccacagcagcatgccccaagtggcaatactgcgcccaacagggttacctctttcaagtcaccgctaggactgtcagcagttcagtgtttccggtgtaaccagatgggtcactatgctagatagtgccatcagaatcctaccaacaccaactcagggcatgctaatggcagcactgccagaactcctactccagcagcagctctgtctcgtcctaactctcaggcaagaggacaaggttctcgtgcctccaacaactttggtcgaggccggatgaaccacattcaagctgagaccgctcaggatgttccagacgttgtgatgggtatgttctctgtcaactccgtacccgcaatagttctgtttgattcaggagcttcccattctttcatatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14299 - DNA, 529 bp, Oryza sativa
cctacgagtgctccacctccttcacggcctccccctacgcttgccgccaagaaaggaccaacggaatccaacactagtaatgcatatccacatgatcataatcaaggttacaatccttttataagttcaacaaatacttctaaaacacccaaaattgatgaattagaagattttgtcatggcaaagccttctagcttggctaatggttgtctgcaagatctaaatcataatggaattgggattggacaagattcatctacatctgctgcaggtttcatggattgggctgagctaaaacactctaaaggggtgaaccaagggaactttgattctttgttcgctagcagtcagtaccaagaaaaagagaaagcagtgctctatgcttctggaatggaaagcagagatgaggaagaactattagagcatgagaaaaaacaaagagaaaaggaagaggaacagagaaaactagaaagggacagggaggaagagcttgagagggaaagagaaatgatgagaagaagggaacatg

SEQ ID NO: 14300 - DNA, 519 bp, Oryza sativa
gactgattatttcgccaccatggctacacaactgtgtcgctatcgctgggcgccttcatcttcactaatgacagaccatattactgttgactggtttcttcgcctccacggctgtgcgacttcatcacctttgattggtgccactgtctttaccaccaccaatatctttgtcacctttgatgggcgatgtcatcccctcgttagtcatctcgttttcatgccgactacataagctaccatcaatggacaactaaaactacaacagaagtacatgttacatgcttagggggctcatgaactcaagcgcgatgatcataccttcaatttggacttgtcccacatgcatgcaacataaattcatgatcatgagtcaatttcttatgctcaacgagtggactattcgttatttcccacgagggctatcatctgagtatttgtaagagtcaggatttaatttttacatctactgaggtacactctatgaggataaccactcgatcagaagccacctaaatgaga

SEQ ID NO: 14301 - DNA, 1118 bp, Oryza sativa
tatttggccacctttccggccagagccaactcggcctgctgtttgttgccccagaggaggacaacatggagacgatcgtcgcgcatgatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattca

SEQ ID NO: 14302 - DNA, 36367 bp, Oryza sativa
  unsure (1)..(36367): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgattaaattgatataaaacctgtagttttgtgataactttgttactaaatctgtagttttgcgatagtccaccttatatttgtacttctgtgataaatttagtgttaaatctgtagttttgtgatacatcataattaggtcatctatcaaatggtgttcagtacaggattatattaagatcttttcactaggaccatgcaattggtcacaggaaaatggaacacatgaatcagagaagatccaagtaatcaagtttccaacaagccagaaagctagaaggcataacataaattggcacatattacacagttcagaataggttctgatgtacctaaaatgtaggggggaaagagaataggtcgagtagatggcaacaattgtctaacaaagatagaatatcttacttgtaacctgaaggtgcatgtgcaagaacaatgcgctgtttgttctcaattattaatcttaagtctcgccgtgcagcttcaagatgcatataatcgcggaactgatcctgttaagatatgaagagaaagtacaagaagagaattgcataagttgatatttttgtttgtcatacaagcatggttctgaaagtaccaacagcaacaaatggactaacaggataccaggctttactgtagtttttttctcactaacatgcacatgtttagaatcagaaacatgtgcaaacgataaacaaaaactaaattcataaaattgtatcatcatgtgcttgacacatggataccaaaccaacttataaaaccaaaactgtaagtacgtgaggattaccttagtaaaacctgggcttgcaattacagcacattggactacttcaaaatcaatatgcttcaggaaagcctgtaggcaaattaagtaatgcatcagtccaaattggtttcattaatattatcatttccttgaggaaacatttttcatttacttgcaaaacatgttcaaagaacttcttgagggcctacaaaagagcaaaacaaagtcagttgggaatagatagaacaattagattacacaatatcagaaccagtttccataccgactcataaccagcaatcgcagggccatgcttccgaggaatagatgtttcaatacgtgctctggttactgttatgctgtttagataaccatagctaataagtcaaatacaatcaccgcaagaggtaactcaagcctttaaaagaatagggaatcaaacagggctactattaagataatactctttcatcatcacaattagcatgctatcatgggaagtacaataaaaattatcttggtcgtgccatggcacaatgagtcaatgactcaacttaccttctaccaatgaggaacaaatgtgcaagtccttcttgcatgagaataactgctagatcagcacttgcagttgggtctaatagaggtttagatgcactcagttagaacattgcatttctcaagaaagaataataacagaaaatatgataagttgataaaacaaaagtagaagtttatgtctcaatagaaatcacaagatagatatcactaggggtctcaatgcatattcaagatgatggatgataaattgattaattatcaatagttctcattaataggtcaaagtaacaagtttgcaaaggttgtcaagcactcctggtatccgcggtacaaccataccaataattttgcagagcagaagatggaacgcaaacaatatataaacactggacataatggcacatcaggtttgaaagaaaagagatactctatttatgagtgagtttctctgcattaaaatctattcataagaaggggagcaatatgttcaaaatctctgataatcaaaatatctcagaggtgatggcagaaaaaatggagatatgtgcaatcagtttatactgattattatggttggaagacagcttgaaattagggttaatacttcgagatatttaggccctcctaacaggcaggacccggatgggctttcctgctaaacttaaggtcctatttgtaagcttaggcctcttcccacaaattctccagaaaaaaaaaacagattatgagtttcagtgagtaactaagtatcattgtacaatcaacatagtgccaactttgttggataattcatcaggactgaaaaaaaacaaccacatgtttttttcccagtggcttaagtaatctagatgaatgggcatatcaagcattagcaggctaaaatttgaggtacaggtagcattcctaatgtgataaccatgtaaccattcagatcaatccatcatagaatataagagcaataagacaggaaaagacagatggaatgtacagaattagaagatagtaacatttcagttctcacataccacatgcttgttggatggtatcaagagctaaccaatcccaaagttcctgcaaaagtagaaatagcaatctctcctcaggtaagctacaacagaccaaaagaaggtacattctaaatggactaccacaatttacaaaaataaacaatggtgataaaattttcaacaacgatatgtatctgagaatagttggggaacattatcatcagccactgaaagaaggaaactatattatgtcaataatcgttatgctttccaactcctaagtagtcatcgtagacactatgaattaccagaggctggaaaagatacaagttccatgggcagggacaaaaaaaactcatatgcaagtgcaagattcattaagaaaattagggaaagaaaaggatagcagtctgatgaaagtgccaagtttttttatataactgagtccatagtaatgtttaattgcaaagggatatttgtataatataaatattgcaaagctaaggaaaggtcccattgtcaagtgctattaaaagaaatgaaccaaatttggccaacctagttgttcaagatatatgacagtaaataaaaaagcatgtgcacagatgcctgcatatcctatttcacttataggttcagttaaaaaaagggcaagctgcaaatgggatagaaagtttatctattaaaaatctactagctcaaagcaccctgtttgtagcactctcaggtaggcctgttcacaggttgggctcaaaccgatgaacataccaaaccaaaccaactgaaaccagttaatctcttgtatatataggtaggttgggtttcctccacaatccatcaaacactatgactccttcatcttcttcaggacctcgtcctcgcacgcaggcagagccatctttgcaatctcaagcggtggccgtgtccacccaccggcaaagaccttcacagaggccatgtcccccaccgatgtccccgatggcaatgtcccccacaagcgacgagttctccagagccacggccacatccccacacaattgacaagtcccaatagtggccatgaccccaacccctcgatgggccttcaccgtggccgcgtcatctcacactcgaaggcgacttcccctcacatgcgacgatacatcgcgcgctcgatggctgcacctctgtagtcggggcgtcccttgcatgttcaacagcaactcgtggacgtggctgcgtccagtggcctgtcacaatctttgtgtgctctgctgtgcttcacaggaaaggaatgccatggccatttctagctcctctgcccgaaggactcttgatctgcttctttctcttgttgaggaaacagtttaacccgtgaaaccagaccatctaaaccgtacttctttgggctgggctgggttaacatgctaaatcaccttaaaccatcgatgaataaccacacttttcaggtaaggcttaacaaatcccacatcagcttggaatgtgccggatattggtgccatattttaaccatttagaatcatatccaaattttgaaccattagtgtagtgtttaagacaatcctatccatcattagctgaagactataatgtggtcccctagtaaacaggtaaaggcagtttgatcaaattttagggcataccttcgtcaaagtaaattgtctcttcagctcaagctccacagtatgaaactgtccaatcttcacatgatcgttctcagttatattttttccacgtacacgcaagacagatccctccttatcataatctacagactatgtgcaaaacaaaggagcatgtcagttatcatcaagaaaataggtaagttttgatttggaaacaataaggaacaaaactaataagagcatcactggctaaaaaactaaagacagcattattttttagtatgcaaggagaaatagatttctcgacctcttcggctgtggtgccacttagctctaagtaattcaaatgcttaagtgacgatgcttgttgcttgacttggggggtcccattactccattatgcaactctaaattattatttttctaaggcagaggcagaaattttgcatttaaaaagtacagaatttcactccaataatattatgtttaggtcacccattgtacagcctttgcggtttgttagattgtcaatctctttccagttcacgcattgtgtaggtaaactaggctctcttcccaaataatcaaacaatgacagtgccactcaagtctcaaattcacaggttgcaatccacataggttacatctgactgtaatcactagtataagcactcagtgcagatagaaggaagacagatgatatatcacctcgactacaatttccaactttaacctcacacgctcagcatcacgtcctccagatgccatctctctcagaactttcctgggaatcaacaggataaaaatatgtttaaggggattatgagttctcactgtgcactgaaggatctagatatattttgatggagaaacatagaagttcacaagaataaaggggacagaatcttcaagtaacacaaactacattaccaccaaggttgaagtatgagtatgatcaaagcctttcaagtaattttacatatctaatttttctataatcacataaaagcataatggcattgagaaattgttaggtttagtttttttaataaaatggatgtttaaagtaaacgaaacagtaacactaattccagcacttccttttcttcccgcaatcccaattcttaagtcccagtccaagagccaaaaactatttatcacgtagtgaaccatgccttccctaagtttacgccaaaattggaagtttggttgaaattggaacgatgtgacggaaaagttggaagtttgaagaaaaagtttggaactaaactcggcctaaatctaagtgccctaattcctctaccagggtaggactaggacatcgaggatagttcgaaattaacagctcaaaattgctaaaccgaaataaattactctggttactaactgaaccaacactacacaatcactacataaaacggaggaactcacctcacagtgacggactggagggtatcccccggaacaataaggttgtaggcatgccacaggtcgtcctcctcctccggcaccagctgcgctttcacaataaatcgatctaagtcatccaatcagcacacgaaccacacaacccccacaaaaggggatcaccaccgtacccccaaacccaaacaacactagacctagtgcaagcgatcaaacggagagcgagatggggaggggaggggagggttcacaccttgacggagccggggccgttgcgggcgaggttgcggtagacgagcttcatcgccggtggcccggagctgtagaacgcagagatgcttggctcctcgtgcgggtctcgctctcggcggcggcggcgcgagcggcgggggggattttgcgacggcgaggggagggatgcggcggaagctgtgtcgacagcgtgggatgggatgtgaaaccggacacggaatctgtctccctttctgttacgacgttatatacatggggccccaaagaccggattagctgccggcccagccgcgtcgacgtctataatcggagtccaactccacattggactcgagttcggcccatgattagtaccacctcaggtctggcaagtgttactctctagttttaatgcttgaacgccgttaacctctagttctttttattttaaaaagttcatgtttttttgttttactataattttttattgttaaatatactcctaccatgacttatatttttgtatttttaaaataaaattaataagacatatatcgaagacaccaaaaatcaagcgcgtcaaacgttaaaaaccagagagagtaggcgttcacaactataattgtgtgtgttttccacgtgcgtgcatgagtacatcgatcgaatttagcccctacatattttcaaagcggtagataatactttgactttggtcaaacttaaaaaaataacttaaaaaattaagcgacttacaatatgaaatatgaaatgggtataaacggaagggacagtaacaaacagctatcattatttgtcagaatttctgagtagctgatactttggcaccccatctgtttctaaatgtttgacatagcacatatttgatcgttcgtcttattaaaaaaattgcgaaatatgtaaaactatatgtatacatgaaagtttgtttaacaataaatcaaataatatgaaaagaattaataattacttaatttttttaataagacgaatggtcaaacatgtttaaaaaatcaatggcgtcaaatatttagaaaccgaggaagtaataaccaacatcttatgtttatcattttttctgcatatgtattgtacagttcaccgcgcctttttacttcagatgaaatggcacactgagctagctttacatttcgttctcgatgaccaggctaaattactcgctactagctagctagctagccaagcctctttctgatgacgccttccaccgagccgacgaacgcgaacgtgccgacgacgaagcagacgacgctgaacgcctgcagcgcggcccaccgcggcgtccacggcgagatccgccgctgcacgcagtacatctcgacggggaggtagatggcgagcggccagaacacgagcgcgccgagcacgcccagcacctcgttgaagtaggggaacaccagcgccagccccgtcgtgctcgccacgtacaccgtcctgaagcacacccgctgcaggttcacctcgtacctccccgggccgccgccgccgccgccgcgccgccacgggaggatcttgacggagtacgacctgttcacgaacgcgctgttcggaaagctcgccgcgaagcaccggtcggcgaacgtgaatatctgctggctaaacatctgatgcatcgagttcatgcaggattcgatcaggatagttttttcagagaaaagcaatgcgattttggagaagtttgagtcgcagcttcacctggtagccgccgaggaggtggagcacgatgcaggcattggcgaagtctatgagccagtagggctcgtagaagccgaagccggtgaggaggttgcccggcgcggcgttgccgaaggcggagtagccgaagcagccgacgcagaggtagaagaaggtggtggcgaggaccgcgatcacgttgcccttctgcatcgtctcgctctccggcggtggcgatctcagcgtgtcctgttcggtccatcagtctcagttcagatgaatcttgactaatttcagctaaaaagtgtccaaaaaaatgtctgcttttcgtgttctgaaattggccgtgcgcacctgtatctccaggagaacgatggtgtacgggtaggcgaatgcgatgtcgccaattgcttgagccactcgccaaactttctgcattggggtggccatcgcaacaccggcaatgttccctttgacagttccatcacctgacacgaagcaaatgcaccaagatttacacagtttccggctaattaattaagcactgctgaattgtgacatcggcatcaatcaaatggaacaatcaagctactataccaatggtcttggcgaggccgaggccgaggccgatggtggagtaggcgaaggacatgatcgccgcgacgacggacagccacgccatcttgtggaaattgggtatgaaggacagcagcagctgggctgctccgaagagcagcatgtagaagtgttcaccgttcgagtcgcagggagcgtcacggccttcgctgtggtagcagttcgccctcttaattgccctgtcaacgggaacaagttaattaagcacaggttgaacaaacaacagtttaatcttctacttgaagatctgtatgaaaaaaaaactgtaaaattcacctcatacaagttgccgtagtgattgtgtaagcaattcctatcccgtacaagttcaggtactgcagcaacccacataaccaagtgtgcttcctccctaaacatattgccaagttgccacaaaaaccataccattaatttactgctacccaatatacaatccaaaagtggtatctatatttgaccaattggacttcctgaggaaaagattggctaactaacttagctgaagtaggattaatcaaggtacttaattacctaagtgaactctgacggcgtccatgtaggagtagttcctctgcatcttctccgagccaggagacctgtagcagtgcgacagcaggaaggccgagatgtaggtgacgaaggcgaagcacaccatggcgatggggccggccacccagccgagctgcgcgacgctccacgacagcgccagcacgccgcacccgatcaccgcggtgataatgtgcgctacgcacgtccatagattccctgaaagttcatcgaagaagaagaagacaaggaaaattagaagagaagagctcaagagcaccttactacttgccggcatgcctgaattctcgtcgatgaaccaaacagatcgaacaaatctcggcgacagagagcgtaccggtgcgttgtgggtggccgtcgtcgtcgagcttgggagcagaggccacctcgagcggcagctgcggcgccattgtcaaaggctcagtgaagccttcaaatttgactcgttggactacagggaggactgaggagtgaacacgcgagagctatacagtactactatatactagtccactaaccaattaagctagcgttgtcactggattggtgagtgatttggataaagaaacttgggggataactctgccgtatcgacagccggaatcgcgccttgttttaagtacaaaatggcacgagcagacgaggctgctgctcatgttcgttgaatcattgtatagtagcctcctgacaaatccaactgcagcacagcctgtatgtactacaagaacacacgtcaaaattgtcggtttctaggagcgcctgtagtttgccaaggcctctaaactgcatattagtactacctccgttttttaataggtgatgttgttgactttttcttacatgtttgaccattcgtcttattcaaaaaattttatacaaatatataagatataaaccacacttaaaagactatgagtgataaaacaactcataacaaaataaattataattatgtaaattttttgaataagatgaatggtcaaacatgtgagaaaaaattaacggtgtcatctattaaaaaatgaagggagtagtactgtagtagtattatgttataatcgagtcacaggtttaataccaaacctagccaaccaaaaatttatgttgattagaaaggatgcacaatataccacaaacattttgacagtgactgactgggaattagcggcacggttatggatcattttcaatgcgcatgttgcttttttcgtggatgaattgaacattgcttgcttacaagtcactgggctcgttttcatggattacgggtggggtcaacggcacctcttcttgtcagctgctttgacaacttttttctgtatacgggttacgagggctgaataaagccacggtgtagaagatcagggtttctttttttgtgttcatatatgatgtcttcacatctctgggcataaaaacaggctgggagcaaatctcctttccgatgacgatgaggtggttggtacttctacgtggtagtgatttgcggcctttttctttgtttatttcctcgagattattattatttgcctatatagattggttctttgatatatgtgaaaatatagtatggtacaatgatacatgtggtgcctacatgagaattatgtgatactagtctgttaaaaaaaggtaaactctagctatgagcttaggcacgagattcgtaactaggattggacttttttttttgacagaggggtagacggtttttgataattcgggatatgctcctctctggacatccgctatttatgttgtgacatgctcattattgcaaagaaactagagaaaaaatgctcactatatactatacagagaaacctgacatacatattggacagataaattaacaatttttaagaaaatatttcctccatctaaaacacatttttttaagtactacgaatctaaaggcattgctaattttggagggtttcttggaagtgtagtgtggctccgctaccgccctctcttttttttttggtagtttccctttctttcaccagttgcagctctgatttttccttttctttccccatgacataggcatgtctggccgtttgtgtgtgtaacaaaaactcttttgtttttaatatattgacgtgcaatccttttgcacgttcgtagtactaggaagtgtcccatctgtccaaaattcattatattctgggatggatggagtacctaaaggtacgatattttctactgtaagaaattctgatataaatgttgatacctcttgatattttgacatataaaaccgtatcttctaatgtaaaaatttatggtgtaacttttaatacctcttagtaatttgaggtaccaatagtggctcggtggacattccctcgttgtttgcatgtcatccaaatggctataaaaaatttaacaagatagattaataggtatgggataaatcacttaacaaacatgcaagttaaaatttaacttttacaggttgcaacgaaaaaacaaattaaactatggcttaacatatattcgcactcaaatttataatctgttgtaacatatgtaaattaaatttgagcttgcatgtttgtggagtgatttatcacatattaacatgcaactagcgaaaggataaccccttaagagttaatagtttcccatatcagggtactaaattttacattaaaaagtgatacctcccggtatttctcgttgactgcaataccatttttgttcattctggattcaaaatcatataattttagattcccctatttagcttactagtcatataaactggtaacagaacatatataatcactctgtcaatggtggaaaaataaagaaagacaggtatatacagaacaatgcttaaacagagtcaatttttcttcttgataatcagttcgtggcaccagaccagaacctgcctgcaaaactttccccaaggcaatgggagctatctagtgggtgcttagttcagctatcagggttgaatggaatccttctgcgtttcatgtaattttcgcacgctttcttgagcggatcgcacgagtgcgcttttgccaactccatgatgccgctcgcggtgtcgtcgccgatgaagcggcacaggttgctcgcgcacatcagcttcagcctctccatggcgtacatgtcggcggcctcgaacacctcccgcgccatggcagccgcgttccggcccttgttcgcctccggcggcaggctgtcgtggtagacgtagtggagcacggcgccgaacgcctccgggctcatctcccggaggcggatcgccggcgagctcgcctcgttcccgacctggccgtagaggagcttccggaagtagagcgactggccggcgagcgcgaggcggtgcgccccgaacgtcgcgtcgccgacgtggatctccaggtcgaacggggcgtcgccgctgaggaggaactccatggcgttcctggcgtggcacgacggcggcacgggcacgcggacggggccgccggcgccggtgacgacgggccggccggcgccgcggcggcgctggatgacgtgcatggtgcagcgcaccgtcagcgcgtcgtcgtggatggcgcccagggcggcgccctccagctgctcccgggcgatgtacttgcggatgccccacgagttgttgcggttgtcgaacctgcacgggcgatcgatccgcacgtcgtggagtacggcgccgccgccgccgccgccgccgagcagcgcgaaggagaactcgacgtggtacacggagccgcacgatggccggtagagggactggaggaagaaggcgacgtggtcggacgtgtcgctgttgtagccgtcggggtagaagcggacgaaccactcgcggccggcgacggtgaagttccgggagaggacggaattgccgacgcccttgcccttgacgccgctgtactgccggatcgtgaactggtgcacgccggtcaccctcggcacctcgttcaccgagcccgacacggcgtcgtcgtgctcgtagccgtcgtcgtcgatcaccgagaagcagcaacccatctcgccgctggtatagtcgcgttaattagggttttagccgcccctggccggtcgtcgatcgtttcgatatcggtaagggaaaaatagcctgatggagatcgtaaaggtgcattacatgcatgcagaaacggaaaagcggaaacgtcgccaagacatagtagtaagatatatatattcctagtataaatacggatcagatttcatatagagaaattaattaacgggctccttttctttctctgcataggctctgtcacgttcattgcccacgtcgcgcacaacctttgtcacgttgacgtaatacgtagtatatatattttttttgttattactccatccatttcaaattgatctacatatagtatttttgaggttatttttaaatgatttacatatttgaatttatttattaagtctattcgttatttgtgcattgaaataaatggacattgatgcatctatccatgcacacaagtatttataacccacatgcaatatcttgatttgcaattggctagaaaatagtggggatggtgtatacattgagtttgttgctagagtaaatatggtatgagagagttattagtttttttggtcttggtgtatctatgaaatatgtagatcaatttgaaatggagggagtactgcgcacaacgtacatgaggtgaggcatgaaaacgagtcggctcggcaccgtgaaccgctttgtatcgcatcatcagattaattggtgtacgtcttgacatcgacaaggtttctatcagcctaccaggaaaacgaacttagctttgtgaacagtgcgaaggctgatgtgagaagctagttcagtgttcgtgcgcgaagccgcgaaccccgtgtgaccgtgtccggtgtccccctgcacgcggctgtccacacgtacgattgatggcgccgacagcgagagctccaccagattaccggccagagagacaccggctgatgatatgagcaacacggcagcctcatcgtccggtgcgtgtcacctcggcgtacgtgatcggagccgacggtgtacgtaataacgacgtccgccatcggcgacccacgcgttggtgcatgcgtcgccacagcgaaatcggcggcgttgattttcggccggagttggaggatcatcacgacccaagctaggggggtggcgcgcgcggtacgacgtacgtgtcggccggccggctcgtttaattcgaggcggtgcttggctgcatacgtctccttttcgccttgaagcgttacggcgcaacagggtgtccggcatattgaccctgacaaacaagtatacggcgctgcatgccgccccttctcacggccttctgcgtcgtcgagtttgtcgtgccgtgtcacctattccttccgtataaaaaaaataaaaaaaaaccttgaatttacgtttctgtccgtcttatatgaattttttttataattagtattttcattgttgttagatgataaaacataattattattttatgcgtgatttgtctttttattttttttcatatttttttcaaataagacggacggtcaaacgttagatatagaaacccagggtttgtcttttttgggacagagggagtacgggtgggacgctgaagcatctaggcccccggtgttaattttggtaattaatgacaagcgctaattgtggactaaccgttgtctttgagctatacattttaagttaggtccacgtcgaatgtgcgcatggatgattatcgatggattaaaattgacgtcgcaaagcaaagggaaagaagacggtaaaactagcgctttaatttagaattgatcgaggtgtagggcgatcaaatttgctagtttatttttagtttcgccgtactattaagaggggtaatgacctagcaaagagataattttaattgccacattaggtcattatgcatttagacttgtgctcacatttcacacacatacacacttcactgggttcgggctgaccaggggcggtcagaccggccacatagtaggggacttcacagggtagtggcggtctgaccggcgtgccctggccggtctgaccggccgcaagaaggcggtctgaccgacgcgtaaggctggtctgaccggcggcacatgcgcggtcagaccggccccctggaggccgggatggtgctgctcgggatggccgatacagagccgacggagccgtattcggtcagaccgagccgatggcggtctgaccgagccgaggccggtctgaccggctaccccatgtcggtctgaccggccaggccgatggggccctttgacagggctacaacggctagttttctagccgttgcagagtagcacggtctgaccggccacatacctccggtcagaccggcagagcacagagttaggggatttcgcccccaacggctagttttggtgggtgggagtataaatactcccccaccagcagcaagggggctctcttggcacccaattcaattgcatacaccccatgcacctttctcacactcacttgagctttgtgttcatccatctagtgtgttagaggattgtttagccaagagtcaagtgcatttgcttccattgtagagctagtgtggcacttgatcatctccacgccgggtcattgcttgttactcttggaggttgccgcctcctagacggcttgtggaggagttgcccgatgacctctccgagaagattgtggaggaggcccggcgccggtttgtgagtgggttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgtctcaacggggagtaggaaaccggcgagtttccgaacctcggtgaaaaatctcttgtctccttgtcttatttgattgtcgcatttacatttgtgcaatttacttttctagagacatacttgagatcatatcatcctaggattgcaaaactttgacataggagtgtgatttactttccttgagatataattgaaccactatcaccctaggtttacaaaacataacttagttgcttagttagagttcacccttaccaagcctagcaatttaggttagttttgattaggtgttatttagttttaaatcgcctattcacccccctctagtcgatatctcgatcctacagacgcgtgccaagaaacattcaaacaagtctgtgaatacagttcagtattacatttacacagcagttagcagtattgctatctaggaattttgctcatcctagatagcaatattctaggatgaaggtaggagtagcacgtagcagagatgagagttgagaccatcacttcgaatccaccgagacggccagtctgaatgtttgctagagagagtatttcatttcagtttgcattactgtttgtatatctatattcaaaaggattttgtatatattacgtactaattctccgctacttctatattcaaaaggattttgtatatattacgtactaattctccgctacttctatattcaaaaggattttacacatgctatttttccaaataatacttattgcactgttctttgatctgttatagattttggatttgcgacatgttctatttactcaacccaaaacccatgagcattatcaattattttgacaaggttgacaaaggcttcaaccaaaagagcttacgtagtactccatcatctgctctttttcctaaccagatacagatgatgatcgaaaataccccatcattgagtacaccattgttgaatttctgagcgtgagcctccgcaactcgatgtcgaagttaaacaatacggtacgctagtcactagtacggggcggcaggggataaatgaactagcggacatgcacgcaacgcacgaatccagtggcgccaccacacggggaggacggtgatccatcatcgatgttctcgaaggatcccgcagaaaaccacgacgagccatgttagctcacttaaaaaaaaaaaagcccctcaccccctcgacctcgcgcttttcgcatagccacgccacggcacggcatctcagggcccgtatacatcgctggcaaaaattttcaccaaatcacatcaaatatttaataaaatattagtaaatatataaaaaaataactaattacacatattgtgtctaaattatgagatgaatcttttaaacctaattattctatgatttggtaatatggtgcttaaatattattaatgacagattaattatacttaataaattcgtcttacagtttacatgtggaatttataatttattttgttattaatttatatttaatacttgtgtgcgtgtgtattcgatgtgacacgccaaaactttacatccatggatataaacactccctcaccctctatcgggtgcaaatacgcggaacaccaaggacctgggtgcaaaaacacccatcaccctcccccgacgaagcaagagaagcttccactagaaaatggcccaatcccgtcgcccccttcccctcctccgctcctcccaaacccaaatccgccaaatttgactcgcgcgaggggcccgattcgtggggcgcgcttccccctgctgctgctgctgctgctgctgggattcggacgagctggtcgcgttcgcgttcgtgtgatctaggggggggatatggggtacttgagctccgtgatccccacggatggatcgccggtcagcggcggcggcctcaggtgggagcgattgattctcgggacgcctctcctgtcctctttttgcgcttttttttttgggtctgattcgtgtttgctttacccgaattctgggttttttttttggagtactccatctagtcaattcgattgtctagcttagctctggcgactagcagtttttgttttagataatggataatctggcaactagtagataatggctgaatgtttagttctaatcaattcagtacggtccaggcgtgtgatacgttgcttgctgcatcgcacgaatttcgtataactgctcgcgtgggtttcctttgctttgaacacgctgtttaagctcaaaagcaaggctggagtatgggataagctatgcaatcccatttttgtttgttttattagtactttttggtgggactataaacaagataaatccagtttggagttatgttgtccgtttaagtaggatattcatatgctacatacctgatctgagcataagcagttgcgtcgaataaatttggacggttattctgaatacagactaaaatgaacttatgtgatgttacgttggagaattattaagtgtagcacgtcctaatgggcatgatagcaaaaggtaagaggccaccttagatgtgcttatacattctatgggttgagatcaaggaaactaatgagtaatgcacggtttgggcatttggtactgttagttgcaagctggaagttcgtctccctcatttctcaaatgcattttctatgaatatgacatcttgcatcatgccatgttagttctttcagtaacagcatatacaataggtcatgttgttgtagctcaccacacaacacaaccggttctagctttttgaaccagtgaactgtaataattgtagtgcctgcaatctggctgcgtctggaagtttaggagtagtgactttatgaataatattctatttccaattaatcaacgttgtcatggtagcttgattttatggtgtaaatgcagttattaggactgttgctctcctatttgctcaacatttctcattctttttttgccagccagaatggtaagtttagctatgggtatgcgagctcccctggtaaaagggcttccatggaagacttttacgagacaagaattgactctgttgatgggcagattattggtctttttggagtttttgatggtatgtatgaatttgtcacattcgtgcataatctctacccattgataattctttatcattttagaaaggaacatttctaagattacactcttccaagttttagacctttctcttttgtaccaaaagaacataccatttatgtttcctttgctaatcttgtatagtataaaaaagctcaaaataattcatttgccttgtaacatttcttatttccgcagttagagctagtatgacggtgagaagtccatggagaaagttttaaagattactcatactagggcacaatgctttaaattgaactagaagtgtggatataccaagctcttgagcttattttaggaaaaataaatgctaaacatacagttcattttataggtcatggtggtgctaaagtagctgagtatgttaaacagaatctcttcagtcatcttctaaggcatccaaagttcatcagtgacaccaaagtggcaataggtattggtttgttctctttccataattcactagatgttgagttttgtgtatagaattgacagaactaccacgtgatattgtttgctgtagatgatgcttataaaagtaccgacagtgaattcttagaatctgacagcagtcaaaaccagtgtggatcaactgcatcaaccgctgtccttgttggtgaccgtctctttgttgcaaacgttggagactctagggctatcatatgcagggggggaaatggtaattgacagttcactgtaccatctcttcagcttcctggttgcatttacttgatactttctgactttatatagcatgacacattattttttttcttttttatggtatgcttaaaaattcaagagagccgattatgtttggcatattctattattaatagagacctctcttaaggtacgaatatttttgcttgttttgttagaatgttgtatttaccactgagcatctgcattgtaccaggcatgagaatcaagatttgttggtgatgaaatgagtgccatgagaaataatctgtaggttatctgtgataatttatcagttcttcacatagaagctctgctggttttttgcagctatagctgtttcaaaagatcacaagcctgatcagacagatgagcgacaacgtatcgaagatgctggaggttttgtaatgtgggcaggtgctaagcactacattatcttattttgtatatgaatggactatgatcgtgttcctaatgatggtattttgttccttaggaacatggcgtgttggtggtgtgcttgctgtttctcgcgcttttggtgacaaactcttaaagcagtatgtagttgtggatcctgagattcgggtatgcaatcctgaccaatttaatgtttgttatgtctacttacctctcaaaatgcatatgtaggtatcaccatgacagtaggtgaacgtttggaatcatgattcccttgtgtcattggattgaatgtcaagagtgatattgatagtagttgccatcttaatcatgatatacttattgaggggatatttgtggcataaattttcgaaggaaaaattaaggatggctttctaccagcctgaacattttattgatcaaaatttgtaccaagttacatacatattgtgaagaggtacgggggatgagggcctgagtggaagctaaagggtcctatatattacaaagtgcgagaaatttgttcccccaatctagtatacattgccagctaaaactatttgtgctgcgatgggaccactggaggtcttccgcacagcgtcttgtcgtagttgctgaaaactttgttgttgaggcacttccagatattccatagcaaaactaatagggcggtatgataaacgaccagggacatattttgtcttcagcattgtttcatttttggcctttttgttatcaatgtcttacagctgcacttctgatctgttctactgccagcttcttagtcgacctgaagaaccatttcctaatatatgttgttaattttttaggcttcagaataatcatcctttatattcacctttcacaaatgatgaccttgttcagtaatgcttttgtgggtcataggaggaagttattgatcactctctcgagttcctcattcttgcaagtgatgggctgtgggatgtagtaaccaatgaggtaaattcaagaaaatgaaaagagaagatttttatgtatcttaatcgtattccttgtgcttgatgtagcccccttttgcatttgctcttatgcaggaggctgtcgacatgaccagatcgattcatgacccagaagaagctgcaaagaagctcttgcaagaggcctacaagagggagagcagtgacaacataacttgtgttgtcgtgcgcttcttgcatgggcaagggagtagtggatatgcttaaaaaacaactggtaaaagttacccaatgtagttgtgtaccaccatgtatacatgttttaattcaaatctcacggggttaaatggagagaaactcggagtaggatacgtgtattctgatggctgaagtaagctgaagggtgagtatgccttaggttaacaataagtttgctggtgaccgatcaccatagttcgttgcttttgaccctggatttgatggtcgtgttgtattgctacgggagactggatcgtttccctaggttcaatgtacgtggatattactcctctatttatttgtttgtatcctccacttccggtgagctaagtttgactttgtagccattcttgttattactgtagacatcagtgagacagtgacagcattatgtatctctgcagtttggtgggttggaagagaagtagagaatccatgctgttctacatggccgaaccagattcagattgcagagtttatggcagagcaaccacatctcaaactgcatgttttttatgtgtgatgctggacgccctggagctctccatcctgaccggccgtccggcggtgagaatcgagatccgacgagaattgcggcgtgtcgtgcccgtgtcgagggcagggaagccggcaccacacaagatatcatcgaagacagatcggagcgtttgattaatcatcaaagacagattggagatggtggcaaagggtttaacagttttggaatgttaataatcatttctagatgattagagttccttcaagtatgttagagggcaaatacagccaccgttatcattgaaggaaaggcgccctgcgccttgtgacctgaacttttcgcagcctaagaagaggcccttctcagggacatgttcagtacatccatttttggcatgccaatgccccatcgatgatttcttttgaccggtgatctacacaggcgctttcacaaacacaatcctcaaaatccaacactttgccagttgttactaacaagcaacgccgttcctgcccatgtgatcaccagcagaaaccatttgggccccgacggccatatcttctgtaatatacaatgactagttagaataatagctgaagagaagtagctgaaacaaatttgaaagactgacaaattttcaatcaaaacatactgagtcacatccaaaatttctcaatgtttgggcagaatttgaagttccaggtttcactctttctaattattgggttgtgtataaaaaaaccaaatatactaatgtggctaatactcatcacccttcaaagatactatttaacagtgcaagtagagtctgccagtaacttaccactttcactatctgatgcatcgtcaagtctggctatagcatcgagtaatgactgctcctggtcctacaaggacaccatttgacctcacaactctagacgaaggatatctataaggagcttttctccatcatacataattctgtagaaaattgcataacaacagacaagccaactcacttgcaaaagtttcttggccttttcgatctcacccatatttggattggacaaaaccctctccacctgggttggaacatacaatagtgaggtaaaaaaccaatatctgaatgcataatatctgatctcatgagataatttacctctatgacaacacttcgagtgttaggtacatcaatgtgaccaatattcctgttaattccattttggggaggagcactatccttagtaggctcatttcgagaaaaccttcctcctcccctacttgccattgccattgtaccgttgttgcctgggtgcctcctcatcccaggatgaggaccccaaccatctcgatttgagatgccttgatcatcaaggtcccatattatatcttcaggtgccaactgagaaatgatttatcatcttcttttgattaaatgttaaacaaacagtggcaattagccaggacgattcaacaattttcatgttctagctaaaaacaagtaaaacttaataaatttataacagatgacatgctattcaacaaactctatactctaataactaactaaattttagtactcctaccggttacactacagttcagcttcagaaacctagataaccaaaggttctaaaatttaggaaaaaaatacattttgacttctaaaactgtcccacctgacaaaacattaaaacccactatacttgaaaaaaataacgtatctaaacatctcctcaaggcggccctgacggtggtcttgccaccaaggcaaataatgtggcccatcacatggtaatgactccgcgaacaaaaaatacaaactcatcgcaaaatgggtgtaaggtgtcataaaaaccctcttttacatccagttccatgactactcaggcactagccatgctgctcaattccaaagtcctatctagtttttactctcccaaatcttatctagcttctacttaacccccatgaccctcaatttgttgaataattgccgcatcatcagctgcagtggtaagatactaagatcatattccaagttgctccaggggagttacttagaaggtatcacatagttttggtaggccatctaaactattgtaatttcctgcagaactactatcaacgtaattatgacaataaatctgcagcaacagaaaaatgtttcctgtttaatttctatgttattgggcacgcgagcagacagtcactagtttgtcattgcaacaaatcaaatgtaacataaaaatatgaatatcccacggccacagatcaagaaagaaaaactttattatggattagtaaaaaaacatctacagatagaaacaaggcaatggttgaaaatactgcttacatcactaagtctgactgactcccaagtctgggctactgtgcccatgtcatagacgagagcatgtttaccctgaaaagtatcaggggtgtccataagcttcgcttacttgacaaaaatgcaaatctgcagcaagtagcaaaaataatagtgaaattaaacaacaaaccgtagcaggattatagtcagttatagtggcctcatagaagttattgtcatctggccatcttgtataaattttccggttaatcaatgaagttggatccgcggatggcacagcgagtggtgtattctgtaatgcataaaaaaagaactcatgatattactactatgggaatgcaacaaacatgacttgtcgtattcaaaacacaccgtcctagtcttcttgccctttgttcctgaaaatggtccccactttgtagatgaaggaactgagggagaaggcatcgcaggggactggaggccagcagaatgtgaaggaatagaaaggggtgtcctttgcctctttgcagctgggccaggttctgtatcatgaaaaattctgctgccacgatgctgtgcactcagggatccacctccctgtctaaactccctgcaaaatattgcgaaggataaataaattactaacgaaaaaataaaatggttggtttaaacatgtgcatgaacaaaaattgaatgattgtatgaagacctcattctgcggatggccacatcttcattaactttgtttaatagttccctgtgttcatcatcagagactcttaattctttcctgagttcagtgatcaaactttctttttcctggacaaaaaatatacattttttattctcaacacaaaaaaggcatgtgcaaagaatggctactaaaactgttagcacaagattcttttttttatacatacatacccaggatatagcatcagattgcactttaaatgctctaagaacaccagtgtacgcctcttgctcaacctgatgtatttcactctccaaatcaccgtgcggcctaatgtaagaaaatggcataacagatgccctgccattcgcactaaaagatcgcactcttaatcctctattttgtgttggagggagatcgtcgtcagtccctgaaattttgatagaatgaacagacaagtcactataccatgaaattcactatatgagaaaaaagacataaatattttgtgaactacagggttcaataactgcccacaacaattgggcttcacaatttggcaagataagccagaatctagagctggccgacgtcatgtcatcagtctgcaccaagggtttggcagcaggatctttctctagttgatcaggaacgcataaacagaaacagtggtttccttaaaacttcacataatatcagaaagataaaaaaaaaaaaggtccatctttattagaacacagtaagcagatccacttcagaagcaactattgccaacctcgtctcaaaggctttcatccatagtggcagagtcttaggccatggttcataaaatgcatagtaaaactatgaaataaatgtctttcactgcattgaccgcctcaattacaaattcataataaccaataacctgccaacaaaacattttttttcttacaatacctacgcacctaatcaaccgatattactgaagcaataattttgaaggaaaaaaaaagacacatgttatcgaaacgaggcagggacgcagcagacaaccaatctgacggaaacaaaaaaaaaacatacaaactacaaatcctggagagggcttaaccgcgcgcgcccaaacctaccagcacaaaaatcctcctaacccgacgcaactcaccgctggaatcgtaggggttattgtaccccatggccttcatgaacacccgccgggacgcgcgacggtgtggaaccctagaaaacccgccgcggcgcgattcctccggatccgggcaccgcggcaacgccccccgctcgaatccggagatgcagcggccggatcgagcaccgcctcgaccgattcgggaggtttagggcttggaatcggatggggatttggggggcgatgggaatcgctcgtgtcggggagaggagaggaggagaggacgactaggtttagccacgcgctgctctgctcggctcagctcggctcggctcgggctcgagccggaccccgctcggctcccacgcgtgcaacgtcggctcgagcttaggtccgggccgagcgagggatgcggcggaagctgtgtcagcctgggatgcgaaacccaaagcccagattagctgccggcccagccgcgtccaactccacattggactcgagttcggcccataattagtactaccatctttagaagtaggcttttgtcggtccatgtccatccagactaatctcaggtctggcaagtgaattactctctagttttaatgcttgaacgccgttaacttctcgttcgttttatttaaaaaaagagagtataatatatgggcgggccctaaacttatagacatatgtcatctaggtccccaaactcagaagacacatttttgggtccctaaactcgcttagccgtacattacctgtccaaatagtatttgacctagtcgctcgccgacatggactgccagcgtggaggggcagggacagctagggtgtgaaatatgaaaaaaaaaatctattccctcatcatttcattcgccaaatatcattttcagtacatttcagataattgcacattttcaactagcctgaaggtagtacacatcttggtcaccacaacaaatacacaacaagctactacacatttcagtcctaacaagttgctctgcagcatgttcatgtccctatgaagtctgaacccagctcaaccaattcatttctctgcacatgcacaacaggagctggacattttgcatggataccagaagctgcaagagccaagatgtcctgtatttgtcaaatactccttatattgatcctcccaataccaaaactcacatccatttccatctcaatgaaaaaacttgcacatgtaaactcaaaatgcttgcaagacaccaatgctctacaacaggagagaagaaataacctgatgtaaaagatgatgcctttattctcagctgtattaagagcaattaatcaacgggattccatgtaaccacaccagccatttgcgcagtagttgtaggacatgtagttgcgctcgggctaggcgacagtgccgagcttggcgtcgtcgagctcctggtggatccgacgaccagggtttcccaaaccgccgggcccggggttaccgcgccccggcggtaagcatggttaccgcggtaatcgtgaaaaaccatacgaaactatgtaaaatttatcaaaaatttaaattattttttaatttatttgaatttaaggaggttaccgtggtatttttattaccgtacccccacggtaaggccggtaaccgctgtaaccgcgcggttaccagcggtattgtaaaccttgccgatgacggccacacaccgacggagttgttgttggtgctgtagccatggtagaacatgacgaatcgcacgcagctctagttgatcttgacgtcgtcacagcgtcactagggaatcaaagaaggggatagtgaatcgaccaagagcttgctagggatttcgttgctcagcatggtggggaaaaaatggggacaggggattcgatatgatttctaggatgagggaataggggggttctttgcatatttgacaccctagctgtccccgcccctccacgctggcagtccacgtcggcgagtagactggctcaaatgcaatttggacaggtgatgtacggctaagcgagtttagagacccaaaactgtattttctaagtttggggacctagatgacatagccttacaagtttaggggccgcccatacattttactccttcaaaaatctcgtgcttttttgttttactatgatttttattattaaacatattcttactatgaattatatttttacaataaaattaaataagacaaatggtccaatgtatatccaagacacctaaaatcaagtgtgtcaaacattaaaaaccggagatgttatacccagttttgcaccaattttgatagatgaggtggtataactggttttgcagttaagggggacgatttgatcaggggcaagagatgagggaggtaaaatagacttgttccattttttttattggcttcattatttagcaggccggtccaattcattcacccgtgctgaatcgggctctttttttctttttaccaggccgcctgttcagcccatgcttgtacacattcagggatgtatcagcaggcacctcagcttgacctcaaaagaaagaaattttggttcttttgattttttttattggcattaacaaatatcgctataatgttagacagatatattactagtttataaaatacatgaagtaagtcggaaactaaacatctctccttcaaagagggtgtgagagggatcaagagtatcctaattatcgcaattaggaatggatccaattctgttgagtctgactcattgtggtcatttctcttttaacaaaccttagttataaaaggattgaacttggatccatttatggatccaattctatttagtctgactcattgtggtcatttctctttaacgaaccttggttataaaaggcttgaacaatcgggatccaattacttattacttatgatacctagttgatattaatagctcgagatttacgtcttggtcaagcgtgtgtgtgtgtgtgtgtgtgtgtgtgtgtgtatatatatatatatatatcgatcgatcctgactccatgagcgtaagaatatgctataatttttaacgatgatatataatcatatagacacttttttttatttgatagtacaatagtataatccggttacagcttagatagatatcctgcatgcaggtttattcagtatacaatacatttattctggtggaacactcttaatttgtgccattttattctagcttcacgcatggccagcgcctactcacgcagcaccaccatcggggcgccggtgtagaacgggtacacctccgacctgaggaggcacctcggcccggcgatcctggcgccgtcgacgttcgccgggaacgtgtcccaccacctggcgacgaggccctcgaggcagccgcggcacgcctccagcgtgatgtcgaacgcgcactgcgccgtcgcgtacaggttggggaaccccgggtcggcgcccacccgctgccccgtcgcgaacagcttcctcgcgatgtcccccgccgcgtactccgcggtggccgccagcagccgcgtcaccgcgcggtcgtaggcggcgacgtcggcgccgctgctgatgttggtgctgctcatgagggtcgtcagctgccccggccccaccttgtcggcgaggaagtcgtccttgtcggagaggcgggcgtagcactcgttgtagacgagggcgacgtccttggcgcggcggcacgcgctcccggcgtccctccacacgctggtgccgcagtcgtagcaggcggcgcgggagatgtcgccgcggcagaggaggaggccgtagacggtgttcggggcggcgccgttggagcccgtggagaagaggatctcctgggaggaggcgccgtcgcggagggtgagggccaggttcaggaggttgttctcgtaggcgctcccctgctcgtacgtgccgtcgccgcaggtagcccacggctggccggcggcgagcgggacgaccgccaccgccgccgccacgaggagaacgagcaaagtgcaccgcgccattgcaatggcagtgatcgttaagctataggttgatggattagcgatcgatgtgtgtgcagcaaagcgtcgagcattgcatgcatatttataggtacggtaacgtactaaggtagttttggacgacacgcatcgccaacctatcgttttggatgaggctctaatttgtcgagatagctagctagttggcaatttggcgtgtgctatttgccgataactaaacacacagttccacaaaacaagctgaattggcgccgattttatgtacgggtttaactgtttaagaaaccggtcaaaaccgttggttctgatttcaacatcgatccagccaatgagagaaccacgcacggcagctgcgctgatctttgatagcactagttcaatgttgcctagtcggattaattcgctggtttcagacgaactatagaggaacagcattgactgttaggtacattcgtcgcactcgcacaggcgcacattcagtggatatttcgttactctactttaattaatttgtagtcaccaaactgaacaccgtctccgatgtactagaacaaaaggatatacttaattactctacttaatctactttttttgtttgaatcatgggctgcgtgcctgcgttctatggtctgtgcaaaggtttaacgggcactttaacaagggctatgtttctatggtctatgcaaaggttaaccgtgagagcccatttttactcaatcggaaccaggtcttctgatgaagaggatttctacatcaaaggggatatctgtgccggatcgttgtttacccagcattcaacgacagcatcaattcatagtttcctaccctctcctccgtcgtaatttggcccagaatcctgcggcaaaacgacggggtttcttgtagcggcgtacgtttccccctggttggctctgagctaggccgaacgactgaagagaagctaggaaccagtgctgccattggatgcggaatgaacggtgatcctacacggatatccttctaacatatagatatcctctatatactaaatgatctggttttactaagtggtctaaagtagagatggcaacgaactggattgtctcggtggaataggaatacgtcttaacaagcttaccgggtctaaaatggaacaaatatacctatgcctgctcgtcaagtacctaaccgaaagtccgaaacccagtcagtacttgtggatattttgcaaaacgtgacataatatatcaaattgatagttaaaaaccatcaacaaattcagagtttagaccatcttgcaagcatcagcattcaacagctagcacaagcaatgaacatgtcggggtcaggtgatcctgacaattttgacgaaatctgattgcttgtacatagaggataacgcaatggtttaagtaataagtatggtcaatatataatgacaccgtatctcaattttctatacaagccatcgcttgtgattaatattatacgtgtgttttgtttttattgtttcttgactggcccccctctcctatcatgcataatcctgctccgccgttgaggaagggaactgtacagtgtactgttccggaaactggatagctttccctacgttcaatgcactacgtggacatcattacttatccattcactctgtttcagcttataagaactactttaaatttaactaaaactaagtttgttgaaaaaaaataatactctctctgtcccaaaatataagaacttatgattacattaaatatttactagtattacaaatctggacaggcagcatgtccagatttatagaactagaaaatgtcacgtcccatactaggtttttatattatgggacaaagggagtaacatttttaagtcaagataaatttattgtgaaaatatattcaattatttattgatgaaactaatttagtattataaatattacttgtctataaatttagttaaaattttaaaaaattaactttgaccaaagttaaaacgtctgaaacggagggagttctcagtatggtcggtattagtatcttgccccaccacttccattgagcaacttgactttgcagccattgttactgtagataccagtgagacagtgattgcgttgtgtcctgtgtaagggtctgattttgtttatctattctaatcttgtcactgtagagtagacaactactccctctataataaaaacattggtaaactatgtcgagatttaaattcaaaaatagttttttatggaggatgtagacattagtaagactgattttttcattttttgtaaggttggaagagaagccatggcatattttttttgtctatgcatcttgctcactaaataattattaccgaaaattatagaaaaaatacatatacatataataaaattgaagatgagccaggacaaaaaatagtatcggattatcttattcagttggaccacactttaacgaaaaatttcgggctgctcatcgttataagctggtctccctctcaggttgaattggcgaggtgggattattttttgctacagtacatcgctgctgctctgctctctctgctctgcttgctgcgctgctgcttgcatgctactgtgggctgccttttgctgctgggccagctagctactgggctgcatgggctggcctgctagctagctttgctctttttccttcttctcttctcttctttttctttttcttttttctctaattatttgcagggcgttacaagatcttataaatagataatagtactaaaagtgcatgtacagtttatttattttttttaaatctttggtgatatttattactagttgatatgtatagtgtgtgcacacggacacgttcccagatccagaaacggtttggggcaaaaagtatagaaaaaatgtacttgttcgtatgtataagcagatgctggaaattggagcatttttgagacaaggcccatgaaaatatttgggcataatagcatcttatataatgtttttgagagaaataatctcaagcatacaacaacgtcgtcagctcataccgggccttggcagaatacacgagttccttcagaatcctttttttttttaaagaacctagcgagctggttttatattatagaagaagtaagaaaacaaaaatgtataaaagggactattcctgtctacacgctttagaaaaatagaagcctactctcttaacataatacattgcactcccttggcgcctgccatttcccacaaatgaagctcatctatgatcttgctagcaagtgccggcggcgtagactcagtgcctctaaaaatgcaattgtttctttctatccaaatctcccaaagcgtggccaagaatactgaacgcagccttttctgttgcaacttttctgcctcatctgtttgctcgcgccaccaattgaggagagtatcgtctatggtcatattgaggaaacgtgacagcctgatcttgcgaccaatgtcccgccatacctgctgcgtgaaggggcactccatgaagaggtgccgtactatttcaagatttctgaacacagagttggcaaaagtaattatttggccagcccctgcattgcaatcaatccgtcgtccatattctattttttgccagcaaccacacgaagaatttgtgtttacccggtgcccaagtcttccatacaagctcggctgattccgaaaatcgttttgcccatgaactgcatggcatatgctgatttcgccgtatacatgccgctggctgaccaccgccggaggattgtgtcatcagccccttcatggatcacatctcctgcattgtggagcacttcccatacacatatatattcctgaagcaactgtattgtcaccttccgcggatatcttcgatccaagcattattggttattgcctcaagagtcgatttgttcttccttttggagtgcttgaaaaggtttggggctagatatttcaacggctgatctcctatccagttggattcccaaaattttgcctttcgtccatctccaactgttaccttgatggcggccacgaacagtgcacaatcggtgagggcggcggggttcctatccaagatttttccgggcttgtccactcgtaccagagccaagagccaacatagcctcagcgatcgtgaaaatttctcgaagcaacgtagttccttcaaaatctgtttccatgcacatcacaacgtacggatcacgatcattactccagaatctgaattctgaaatttccacaaaatggatgaactgatgaagggaagtccagcctcgatccaagattcaatcacaatgtgccacatcggtttgttaagatggtcgtaaacagttgctggtcagaattcttgcttttccttttacaactttttttttggaacaattctgaagaatccttgtcccctgaaggcagaatccttgccttgccttgccaaatggtttagtcgatgacttgaggtccttctaactgttcattctgattctgaacagtctacagattaaggtgaccataagttttagatattattccaaggcatatcaaggaggcccaacctggaggatgtagaggccgttggtttttaatccataactgaaaaaaggactacctattgatacttcgacaaatttatgtcttcaaatcttacagaattttcaactaatggatatagctagttttaaataaaataacaaaaaagagagacaaatatgtcaaaaatcataaatttagagaaaagaactattgtaaaaatctagttttggtgaattgtaacaggatgcaagtgctatgtaactgagtataagtgcactgtaaatgagtataactacaagttagatatacaagaacacaaatcttaatataaagatcctatgaacgaaaaagtaaaagatagaaatataaaaatctgtcgcaagtgaaatactagcaaaaccgaaaaaaaaaatcaaggagccccaacagaatcctcactaaaaacaaaacgagacaaaggacggagaaacactgtcgggagaaaaactcggaagacagcactgaatgtctgaatttttggacttcttttatctaaccatcagataaaacaggcaactaaaacgaaacagcacaaatttaagagcatggaggactcagtgcacagtacgattgtgatcatcaagggcatgcatatgagcaaatgccatgtttaggttcggcgagcgagccttcgttgtttccatcactgtcctccatggccgtgctcacaaatagcgccaacttaaatcagcaaattaacgaaccactgaaactctgaaaacatacgaagaaaagaagaaaattctacttacaagccagaaattaaactcagactcaaaacatgaaaaaaaaacacaaaattaaacctagcacataagagaggagaggataatgatgaatagatggtaattaagcaggatgggtgatttattactccctgcttaatgaacagagcttagccttcttatatatagcactggtatcagcaggaaacagcaaaagggagagaagggttttaatttcttggcgcctacggatttgcgttaggtgagctaatcgtgttggacttttggtacaaagataagagtttaaaatcagagcatgcagaacacgaactattccatcacctaacctaacagtatgattgctaaagctcaaagtcgatatcatacagtattccctcttgctactaagtgatttctgccaattggttctgaaagatcaaattgccgttgttgtgttaacatcatccatcatgttgagactaattttcttagtattagttgccttttggaatagggtaattttatcatcttaaaaaaaatgccgggagatactacacatagtgtaaattttggtacctcgaagtattttttttggtgtaaaaattagataccttgaagtattttttttttcaaattgctattgttgtgttaacatcatccatcatgtactccctccgtccaaaaaaaaaagacaaaccctgggtttccgtgttcaacgtttgaccgttcgtcttatatgatttttttataattagtattttcattgttgttagatgataaaacatgattaatactttatgcgtgacttgtctttttaatttttttataattttttcaaataagacggacgatcaaatgttgtacacggaaacccagggtttgtcttttttttggaacggagggagtaaaatttaagagcaattttaccatccaacatttggtatcttgagatactctctggtgtaaaatttggtacctcgaggtatcaaaattttgtgtgtaaaatctggtaccttgaggcatcaaaaaattttgtgtgtaaaatttggtacctcaaggtatcaaatgttatatggtaaaattgatcataaaatttcactttggaatatgttcaattcatttccaagaatgcagttggcgtaaagtacaaaggcaggttcttcggaagaaaagcgtaatttgcttgagtca

SEQ ID NO: 14303 - DNA, 13155 bp, Oryza sativa
atttttttctctttaacttgtgcagaaattggcaatgcagctctgcttctgtggccgcgctgagctgcgaggtgctgggtgcagcggcgctccagtccatggaggctagcgagacgcttgcgtccgatgccgccattgccgattgcttggcacgggcgctgcggcgtgggagccagcgagtggcagaggctgcctgtaatgctataatggatctctctgcttcttctgctggcagggagcatcttgcgggctctgctgttctgcagagcatattgtaagcatatttactgattgatctgattgttttttcaaattcaatatgtatttcggctttagtagcttgtgctatactgatatatactactaaatgtcaagaaccgcttgactcttatgttcacaagatcaacttaaccaatgtgcccatgtatagatcaatggcaagtctgcagttattatgataaacttcctctggtagcatgttaatatgttatgatgaagatggcttgatagtttataactagatgggaagcattgccaggccttttaaatatgatgaatatcttcgactggttgaattcacttcctgtagatatctattttctcaggtggaatttatttctggagtcattgatatcagaagcactgagtgctcaaaaagtgcttctaaagcaaataaatccttctacttgatggttgacacattggtattcatggtgaattcctgtcaagttgataccttgcataatctgcaacaggatgtagttagaaaagttctgcctttgttgcataaaatctggaagaatgttgataaactgggatcgtcaactgactgcatcaactcgaagaatcaacttcaaaggaaagaacatgagatatctgaagctatttttaggctttcaatgaatattgcctgtccagcccacctggaacctgatgaagtcagacgaagcatttttggacaatcggtatctgactatgaaaattttctcctaaactactgggagaagtcgacttacttggtcactaggaaacagaagaatctgcatgtggatagtgtattcacttcactgcttaatgaatttgatctgaaaacacctgatactatcatccagtcacttgtaaatgggattgtttcttgccccgctattgcttcagatgaacttgacattagttcatttctccgtgaggttcaaggttccttgggtgccactgtgaagtataggcaagatatcagagttgtaagaataaatgaccaatgtgatcagacctcaataggttatgcgatggaggaacatttctttgatgatgggatgaccttccaggatgcagatgcattcgttgaaaaatgtaaggatgcatttaaaaatggtttctcagttgccttgcgtggtatggagttccgttctgaaaagattgctgctatagcttctgctgtagctgatttattcggtcaaccttctgtgggagctaatatatatttctcccctccaagagctcagggcctggcccggcattatgatgatcactgtgtacttgtttggcaactgcttggatgcaagaaatggatgatttggcctgacacaaagttacttttgcctagactatatgaaccttttgaacctttagatgacttggtggatgattgtggtgggaggatggaaattttgcttgaaggagacataatgtatgttcctagaggctttgttcacgaggctcacactgatgttgatgttggtggatttgaagtgaactcaactgttgattgctcactccatttgacccttgctattgaggttgagccacccttcgagtaagtactcttcatatctatgtaaaattctcagtgttccatgtctagtgtttcagcatctcactattactgttgttgcaggtgggagggatttacgcatattgcccttcattgttggacggagaaacactggagctctccatttgttaagtcccaagaggaggcacgaacttcgttatttgctctcctgttgcatgtggcaatcaggctgctttcgaaaaatgatgcaaccttcaggaaggcatgcatggttgcagcaaagcttccaccatctagttcatgtacgacaactcactcgaaagctctcagaagcaaccaaagatcattttttgatgagataattaagaaaatcgacaggagctgcaacttcaaggaggcattgatgtgcattgggctcgcagtgagagagaaaaacgatgagcccttccaatggatgtgttggctccggcatctgccgcaacacggaggcacaaatgaccaagtcgatttctgcaacattttgggagcccttgaagagcttcttgaggcagtcagctgcaaccttgagcaatccttaactgaatttacagacttcaagttgaaattttgtaggtgcgtagcgtacgaagacgcgtgtgagagctttgaaatgttgcttcagatgtatagaacgactaggaatcagtacacgaggggaatgctagcattgcacaggaagcatgaaatttaacttctggagtttggagaattccctcctgacagataaagttcagtgatcagctaggtgtatcatttctccctgactagaaaatctgtctggaaacatttgccccacctcaatcatccacaattctgattagattttaactcaactatcatggtcttttgtcttgtggtcttacagttctgattagttacaacttgagttcactattgtcatgatatgactaatgataaaaaatgaatcacttgctcatgctgcaaagctccacagaatctctctgctcaagtctcacactctcacatgaccacctgatctactgctacaaaactgcaagttgataagcaaacaaacacaatttgttgccaccgaccagatggaatccaatctatgacctctggaccccaaatcaacccgttggcgctgcacctgcaaagagatgacgtttctaaaccgctaatctcctcccccaattattgcaccatctgagggtcagtcataacctcagtgacagtcttgtattttctgaatttctggctgcatccccccccccccccccccaagattataaataacaaacaaatactaaatgtacaatttgcaggtcaatgaacgctgcacataaacaacaataaatgggtcgctgctgcgatcggaggtagacgtgacaaggagagccgcatcttccatatccaggagaagagaaaagatttgataaatcgaagaagaaaaaattttggggaaaattttatcctggggacgcttggattgtgtgctggttgcctccgatggtcgcaagggccagaaatctcgtccacccaaaccgcggggagccctatcccctcagcaaaagccaagatgctgctgttcccgcccgccactaaaaatatttatgcacctcctcgcattaaaaattccatcgacgtcgcctcctctcctcctcctcctcgtcgctgcattccggtgagtccgtgcaatgcctgcattttgtgttttcgtgctcggtttcgtctcgtttttgctgatgacaatgttgtttgtttgatgcaggttgagtgagttggtgattatctgtagggggtgaaaatggcgcaggcggtggtgccggcgatgcagtgccaggtcggggccgtgcgggcgaggccggcggcggctgcggcggcgacgggggggagggtgtggggagtcaggaggaccgggcgcggcacgtcggggttcagggtgatggccgtgagcacggagaccaccggggtggtgacgcggatggagcagctgctcaacatggacaccacccccttcaccgacaagatcatcgccgagtacatctggtactgcaaatgctgcatctcacagtgacgcttctgttcttggtttgacccacacaacagtagcagtagcagcagtttcagactttcagatttcagataagccaaatccgcactttttactagcaccaatttagtactactgctacagtttgtaggttttgcactgcaccgttcgattagggaattggatggttgagatatgaatcataggattagctgtgagcaaacattagtagagtacaagttttgccttaaaatagataaaagtttctcaagcatggtggtggctggtggtgactcacactagctgcttttcagttcccacacttgaataataatacttcaggagtgcgaatccccgatgcgttttcctggtgaaagcagcaatatattaacgaatctgcaatcctttttgccacattctgcagggttggaggaactggaattgacctcagaagcaaatcaagggtatgcacttggtatcatcattatcacaaatgttcttgttcttggataaagataccagtgctgtctttaggaagagaagttgcgtttttaggggattagcagtgtacacagcgcctcctttcgttatttactttctacctctttggcccttgaaagaaaaatcgaatgcctgtatttcagacaatatcaaaaccagtggaggacccctcggagctaccaaaatggaactacgatggatcaagcacagggcaagctccaggagaagatagtgaagtcatcttatagtaagaaaaaatattgcagtacatgtgattcttcagtaaagcattctagatttctaattctgtctcttctcttgcgctgtcccccctgatttcagcccacaggctatattcaaggacccatttcgaggtggcaacaacatattggtaccatcccttctccttaatgttttatccttttcaaatgtgcttttcatactaacctgcacataaaagattagctgtgcaatggttagtggcgcatgtgaaaaatcgcatgctagctgatacaaaatctgttgtttcaggttatgtgtgatacctacacaccagctggggaacccatccctactaacaaacgtaacagggctgcacaagtattcagtgatccaaaggttgtcagccaagtgccatggtaactaaacatcaagcacttttgtgctataaattacaatagaaaacatggtttttccatctacttttgtttacatgtgaagttgagacattttctatgcactatttttctaggtttggaatagaacaggagtacactttgctccagagagacgtaaactggcctcttggctggcccgttggaggctaccctgggccccaggtattatactgaacaagaatggagctttgttgatcagataataataaagataaggatggtttaagtccatgtgttgtgtatgcttaataaaacactatcatgctggatattacagggtccatactactgcgctgtaggatcggacaaatcgtttggccgtgacatatcagatgctcactacaaggcatgtctttatgctggaattaacattagtggaacaaatggagaggtcatgcctggtcaggtatgtgtgttgttatttgtcaattagttttctgaatcagtggatatgttttaacttctatgaagaacaaatcctagtgtttaacaagtgaaacttcacaatccttattcatgcagtgggagtaccaggttggacctagtgtcggtattgaagctggagaccacatatggatttcaagatatattcttgaggtatttcaaataataataaaatatttccctacataatgaaattttggttcaaataataataataaaatatttccctacataatgaaattttggttttctctcttaattttcaaaccatggtttaaaaatcaagctgcatgcatattattgccaagacgtttacatgtgcacattttgtgatccaccttgacattcttacaaatcgcttgttgaaagccatcatctttgttttgttcaaaacatcagaatgttgcatcctatgaatggctatacttttgcttatatcaatttctgcatcagtaaaagcacttctaattatcgtttgctcactgtaatcagagaataacggagcaggctggtgtagtgcttacccttgaccccaaaccaattcaggtatgtcctagtaaattgtccccaactttaaagccaatcaaacgttaaaggagactgaacatatataatgtactgacagggagactggaatggagctgggtgccacacaaactacaggtttcattatcttcttctgatgttaaagtatcctgcagcataagaacaaagcttagaacacttaacacagctttgctgacatttttcctttgagagaacaactttgttgaccgaactaatgcctattcagagacaaaaataaattccttgggaatttgataggaaagaaaacatatgtgtaagacctaaaataccaatccaaatacggaccgaatatcaagtgttcgtaggtgttaaatctattatatctataaagtaatagaaaaagaagcctccacgtttgctctcacggtctagaaaatcccccgttaatcgaaagaaaataagaaaaaaagaaaaatagaagggtattaggattaggttttgtgttaacggaaaaaaaaacaaagagtaaacggacaaaaaaagttggaaacggaaaaaaaaagttggaaacggacaaaaaaaaatccaatcggacaagaaagagagaaaaaagtgaaaagggacaaaaaaaaagaaattccaatgttaatcaagaaaaagagaaaaaaaataaccattgggtcatagtagatccagattataacagtttagatttaatatagggtgtgtttggattccaattttttttctaaaaacatcacatcaaatgtttggacacatgtatggagcaataaatgtgaacgaaaaaaaaaccaattgcacagtttgcatgcaaattgcgagacgaatcttttgagcctaattacgccatgattttacaatatgatgctacagtaaacatttgctaataacagattaattaggcttaataaattcgtctcgtagtttcctggcagcatctgtaatttgttttattattggactacgtttaattccttcaaatgtgtgttcatatacttcaaaatttttacacctaaacaactaaacacggccataatagttatataactaatataaatctttttttacggaagcttaaagtaactataggaatcgaagtaaaaaaagcttgagatggaaatgaccaaacaaaccacatgcacaagaaaaaaggaaaaatagaagggtattaggattaggttttgtgtaaatggacaaaaaaacaaagattgggtgtggtgtaaacagacaaaaaaaaagttggaaacggacaaaaaagaaaaaatagaaacgggcaagaaagatagaaaaagtgaaaacagacaagaaaaatagaaattccaatgttaatcaagaaaaagagaaaaaaaataaccattgagtcatagtagatccagattataacagtttagatttaatatagggtgtgtttagattccaaaaaattttggcgaaaaacgttacatcaaatgtttggacacatgtatggagcattatatatggacgaaaaaaaccaattgcacagtttgcatgtcaattgcgagacgaatcttttgagcctaattatgccatgatttgataatgtgatgctatagtaaacatttgctaatgacagattaataaggcttaataaattcgtctcgcagtttacaggcggattcagtaatttgttttgttattagtctacgtttagtacttcaaatgtgtgtccgtatacttcaaaatttttacacctaaacaactaaacacggccataatggttatacaactaatataaatcttttttttacggaagcttaaagtaactataggaatcggagtaaaaaaaacttgagatggaaacgatcaaacaaaccacatgcacaaagtttatttctaatttaaccaattggattaagaactaatgcattaacttatttaagtaataagggcatgtttagatccgctgacaagttatttcactctgtcacatcgaacgttttaacacctgtatgaagtatattatgaagtattaaatataggcgaaaaaataactaattgcacagattgcgactaatttgcgagacgaatcttttaagcctaattgctacatgatttgacaatgtggtgctagagtaaacatttgctaatgacggattatttaggcttaataaattcgtctcgcattttacaggcggattctgtaatttgttttgttattagactacgtttaatacttcaaatgtatgtcagtatatccgatgtgacatggcaaaaattttcacccctggatctaaacacagcctaagaaaattggactccgcgtttgctctcatggcctagaaattctcatattaatcgaagtccatatagaaaaacaatttacatagataattaaaaaataatgaatattggaagagaaggctagagttcatactggtgtacaatttataactaattgaaatacggaatcagagaaaaataataatagagtccatatagaaatacaattttaaatagcttaaattcgaaattaaaaaaaggaatattgaaagaaaaaactccatatcagtatacaatttagaactaactaaactttggaattaaaaaaagaaaatataagtagaagtttgagtctatattgaaatacaatttataaccttaatttataaaaataaaaaataaaaaatattgaaataagagtttacaatctatataaaaatacaatttagaaaaaaaaatgaaaatttggaatagaaataaggaatattggtagctagccgcgcagtttgcgcgggccaccatactagttgttattgaatacaaatccagaataagcctgtattcacttcgattgactgaatgaatgttctttgtttctcaaacaattgaaatatactgattgtcttgcaaatgtagcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatgggtatggtttcagcggcctttttatatctttatgttttaatttctatttttaagctatactaacgaaacatttcattaaagggtgtggcaaaccgtggatgctctattcgggtggggcgagacaccgaggcgaagggaaaaggtatatgttcttccatgtcccctgaaattgttgtgtttgggattcagaaaacactaacatccactggtatattaagcaaccaattgagccctccaaaaccagagtaacatagtttttatagcaaataagcacatcatgtagtaactgcccctattgctcatttgtacttccgtaattcaatacttcgttgttacgctccaaatatttcaggtttgagttgaaaatacaaacatttttttttctgaaactatgaaagaacacaacatcagcaaatgcatgtcttgtaatgttgttttcacaattcacaaatgtgcaacttagtatttgcatttttcaactcaatcttattaacttgcccttacaatgctaaatctccttgctgataggctacttggaagaccgtcgcccggcatcaaacatggacccgtacgtcgtgacagcgctattggctgaaaccacaattctttgggagccaaccctcgaagcggaggttcttgctgctaagaagttggccctgaaggtatgaagaacttggacgatgaatcggggcaaataaatcccagcaaaatttgtttgctgcccaccagtcttgatcttgtatttcttctgtctggggattggtctgtacaaatctgcagtttctagaaaaccacgccaccttccattcgccagttaacattttggttgaacaccacacttgatctgggtctgtattttgagtccatttgtgagtgacagaacggatgatgaaacacatcagggacacttttaagtttcttcagtcctgcgtccttccctcgaaataaaaatgtttccttgttttttatcccgggctaaacctgtagttgcgatgaaaacgtcactattggagacttggagaatataatttgacagttgacactcgaccatcatggactggtgttagttctcagctgtggtcagggttcacctttctgatcgagtgcctgacctgaatccgtagcggaatgacatttttcaccaaatttcgatcaaattttggttgaattttactgtttcaaatttgaattctagaaaaccattcgaaatttcactcataatcttctttcatctaggggtgcaagtgggtcacccacgaacccatttataggtcaaaataagtgagttcgcgggttagtttagcctataaataggttttcgcgggtagccacttgcacccttagtttcatccctcgtcaaaacatctaaattttgcggtttttggttggttttcgtcgaaaacttaaaccctggctgtgtcatctctgcagctagctaacagcaatgcatgaacagagcaatggcaacacatacagaagaagcagcagcagaacatcgatcgatctcttgcgaagaagggtacatgtaatttcatgacgaaattaacagtccaagagagtacttagtactagtagtactcctactaactaagctagacaagaagattatacacggacaaacagagaagctgacagcctatggtttctttgggtgcttgcgtttgggtggagacggagagtgcatcgccaccccgctgtaatcagcgctgtcgatcagcccttctcttgcgccctcatcatcatccacccaacctgccttcgtctctgcagtctccttcgtcgtcgcctccatagccactacctggacatggacacaccatgagcttgacaattatttcttgtttttcatctgcatttctagctgaagatggtagtgcacaatgtgctattcactgacattaaaaaaagattatgcagcagaggcaggcacaagaaaacacataaaaattcagttttgcattttatgaacatatgaataatgaactcacctcatgttgctccttgtgcttgccttcatgccggtattggtgtcctgacaagccttctcctatcagttctctgcctctgcgaccaagaactcgagccacttgatcttgctgcctgctcagtgaagaagcagcagcagaagagacatctgcaagatttgctaggacgagtactcctgagacaaacactaagcagagtagcttctgatcaataaccatggttgtgctgatgactggtgacaactaactactggaaatggagatggagagaagatgaactgatgaagcgaatgctccctctacatgtctcctcgaggtttatatataaattggcgaaggttgcagcgacagaaatgggccatggtgtctgcactctaacatatttgcaaaccaggccccatcctgaataatactacttgcaaggaggttagttcacaaaaggctaagctagccattagcatgattgagatccatactccattatgcaaaacatgccgagacatagggcactattgccataatcatgtgtagtttgtggaccataaacgtcacatgcatgtgagtgagcagatgtttggagtgtacagtagttgtgcttattaggtaggggcagaggggacagcaacatttggctacttgctgtaggcttctttgttactaattttttgctcattagatccctgctaaatctgacaaaggtgaaggtcatgaggacccaacacccaagaaaacacccaaaattctgactattgaccaatgctgtctgctctaacagcatgatctgatgacccatgctagctagctgctcaaacttttcttctcatcacggcatcacgcatggtgatggtgtctgaatgttggcttatctcctccatcctagctgcatggacagcatggtgtcgtcagatagtaggagcttgatttgatgttgtctgtcagtgagtgttgcagtgctaattttgttagtaatcgtagacttctagcattgatagagatgagcatatacaggctgatccttgatgatggcagtttattacatatgatccatgaacatgtaactagtgctatatgagacaacaagttagtatatatgcatcacaagaaatggtcctgagaggctgaaatctgagctaacatgaagcagggcaggtgagtgatggcccatggctacaaggatttggtgcgtgcctaaatgcagagagaaggcaattccaaaatggtgtatctttcgatggacacatatgtaggctggaggaatgcaaggttggcagcatgtattggcatgtcattagctttgtattataaagctgatgcatctcattaatgcctggattatactgattagagtatggcatgaggtatgcagtatggggggctcgagacagggaggtcaagctcaggtagggcttcttttatcagaccccagccttgtctctttgctggtcacggagctggccatctctctggattatgtgtatttatgtatggacatgtcaactaaaatagtcgtcagcagccaacagcgttactgttgattgtccgtttggtcatcactaatccatttcctggctgcttcccttgtgctttagaatagagtattaagcgagaaactaaactaaactaagaaatcgaacgaattgtttggtgttgattgacgccagtgttgattgattcgcaacggcctcgcgcatgtaagtaggacgaggggggtttactcgaacggtagtcgcatagtacatggagagttgttcggtgtgagacgagcacgtacgcacgctgtcatgggtggatgggagcacgcacggttgccgttgcagttgcaggcgtgcagcgggaattttttttatttttaattttttttattaaaagttttacaaaaataattttctattttgaaaattgacggaagtagtcgcctaccgccctttgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaattttgcag

SEQ ID NO: 14304 - DNA, 5281 bp, Oryza sativa
  unsure (1)..(5281): unsure at all n locations
ggcatggaattttgcaggcggcccccttgccgccctcggcgagggcgattttgtactgtgcggggggccgcctgcaaatggccggcgagggggcatggaattttgcagncggcccccttgccgccctccgcaagggcgattttgtactgtgctctatattttttataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgtgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgaaaatcctgctggacaaggaccatcagtttcgtacaggtatttaacagtattaataaaaagtaaagtaccgtgtgggcgagggatcgacgctccgtgagaggaagaggtggcgaacgcgcccgaagaggtggcgaacgcccctgcggagctcgtggaagcgccggtcgtgcctgcgaacgtgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctagggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccaactggaggtacgacgtccacggcgctgcgacaggagaagacgcgcatgaccgcgcgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcatgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaaagacgactgataaacttataacgcagcgaagttgcactaaccccacgtcgacaccagtaagtccccatcgtgggaccgtcctctggccactgcgcgctgcgaccaaccccatagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgtagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccgatctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttgaactaagcgaattactaacacatattaaacaagagtacaaacaaacaaaagtgtttactccgaacactcatcacgataacattatgatacaacaccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgtctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgtcatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgtcataccgagatccatcggtgtcgaacaatagagaccacttctccttaggctcattctcaatccactgagtgaaatttttgatggacgaccctgacctccttctcattgttggtgggtcatcatgtaatgcaccaagaggtatgggaggctcgtcaccttcaactagtggactgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcac

SEQ ID NO: 14305 - DNA, 16586 bp, Oryza sativa
  unsure (1)..(16586): unsure at all n locations
catacctcatctcaatgatcttttgtttggctctccaggcctttgcatagcttatggtgtacttgaatttgttctcgatgtgcctaataattgattttggttcaaagccaatgttaccaacaacactggtgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaattttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggtcatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctaacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcacaaaagatgtatgggagcatacctgtgatgaattgagcgaaccagcagggcttcgccgctccccttctgctgccctcccctctctctcttttgttttttttggatttttagtgaatataatgaaatttcacagaggagggactgggctttatagggggagaggcaaaaatcgccctcctccagggcggcaagggggccgcctgcaaaattccatgccccctcgccgcccatttgcaggcagccccccccacagtacaaaatcgccctaacggagggcggcaagggggccgcctgcaaaattccatgcccccctcgccgcccatttgcaggcggcccccccacagtacaaaatcgccctagctgagggcggcaagggggccgcctgcaaaattccatgccccccctcgccgccaatttgcagccggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaaaatcgccctcccagagggcggtaggcgactccttccgtcaattntcaaaatgaaaattatttttgtacacttttaataagaanaattataaataaaanaattcccgtgcagcggcatgggatatttgattagtgggaatccttgggccgattccacgtacgtttccactcccagccttgcccatatatggtgggctttggggctttgcaccgagccgtttggtggtggatcatcggcggggcacagcgcgcgggtgggtggcgaatttcgcgtaccgcgccaaagcgtttgacgtctcgtttctgcacaacccacacgcgagtccaggacggacggcccagcggctcgcgcccaggacgaacgcacgcggtccaccagcgacgtgcttcctgccgtatgggcttcatgcgctgcacccggcccctctgtttctcgcatgcacagcacagtgcagcgtcgtcgttgtaaatgcaaagtcctgttcggcacggctgctcaagcttcatttttcttatagttgtaaccttttcatctaaaataaaagtaaaactggttagagagctctcacgaaataaatgagagaggtggagctggattcatactactctatagatctacttcaaccctaacttatagatctactccaaccccaaacttctaaaattaaatttaagggatagagctttaccaaatatgtccgtactaaaggagaacccagctcgtagggggtcacaggtgaaaggactggattccagccaagcgtacacataactgtatgtattctaggggattgtccaagcttttataaactggattttcttcgtttatgaatgaacagatgatctctgatggcccgggaaaagaaaatgcaaggctaacgagaaaagatatccgatggactgaacaaatgcaaggcctggccggcttcgtctctgtggtcaacggacaaacagtgcgtgaaaaagcagctagtgtccagagcgcagctgagcggctgacacgaaacagttatccgaatgcgggcctacacagtcacagatcgcgtcaattcaaggcttccagttccagcccatgaagggtgtacacacatctcgtaaaagggaaaaatatagtaaatgaagagttgaaatggctgcagtcctacactcctactagcatgaaagttgaattttgttcctcgagataatattctcttattttatgcacggtgtttaaaaatttataaaaaaataaaaaaaaatactatgatagatcaatactccctccattctataatataagacacaactatttttttttatgttccataatataatacatacatgcatacatacaattaattaggacatattcttcattaaattattgttttttttaaatccttcaccctcaagatctcaaatttattggatacatgcattatatttattaggttgattcaaactaggagatgataataattgtttcttgatctttgggttaagggtggttgtgccttatattttggaacggatggagtatatgatatatctttgtatgcaaatatgcaagatgaaattcgatttatacgatttgaaacaaaaacgatcatgaattacagtttcattcatagttaaatttattatttttgtttttttatgagtcaaatttaaatatgcaggtttgataaatgatatactccctccatctatttttgatagtcatatttctaaatctgaaaaatttatttttgataggcatatttcaatccaacagcctattctcttaatgactttcttggatttaacgcatgactctctattcttccacacatgattggttacatgggcattgagaaatgtaaatattaatgaatcgtttgtttacgaggaatgactagtaacatgtttaaatggatgataagtaaaattacttattattggtatgtgttgtcgattacatattgatcgatcttactaaattattttaaattttttaatgatttttgagtgacatgtaaaataagagaatattctcttaaaggatgaatggagtttcccctactagtatgtgtcacccccaaacactttcagttagcaagctgtcattcactgatactccactatatcagaaaattttggtggaaaaccacttggccctgccgctaccgccgctgcttctaccgttacgtgaatgccgggctacacgagtcggtgttttttggccccatattatctgatacccagcacgcctgcgccgacaggcgatcggcagctgcgcgtcgcgcgcatggtcggtgggacggtgagcgccagccaagtgcccaagaagcctgcagggtccgcagcttctgcacttgtcttcatctcactcacccacagtacgatgatgctgatgcacagcacaacgacttgctaccaatgcttaaagctttgaaatgcctctgcgtgacatgctatatgcgcctttatttttttctttttcacagatggatctcatctatccggttagtggcgctgcatcatgcaatgcatgcgaccgtgtgctgtgttgtttgcttccatccgttcccttagccaacctctgcacgatacgtggtggacgacgactccactacccctgcattgcagcagcagtgtactagtgtgtgtctccacgaactcactggatcgacggaacagagagagtatccatgcattgtactactaggattatttagctaggtccactctaatcgacaactgctcgatcggttggcttgtgctgctgtgcaacgcatggctgccttgcccatttgttgtaagcgattactctgtctcaagataagttaatttttagctctttctattgatctcaaactaaaattggtttttaagtaatcattgcatcaaaaatttatgaaagtagaagataaatatattgaaagtagataaagtggaaataattgtattgggatttgataaagtggaagtatctaactttttaaattttacacacatgtgtggatggatgaaaaataaaattattttgaaacggggggagtagtaaaattcttcccttatctatactattataaaaattgaagatgtttttgctggtactttggtaggtcattcgtgtttgagtcggtttttaagtttattcgtttttggaaatacggatctgtgtttgagtcgatttttatgttcgttcgcttttaaaaatacaatagatgttttataagaaatctctttaaaaaaaactcgcatgctaactcgggacacttttaaaaatataaaaggagtcgtataaaaattattttaaaaaaacttgcatgctaaattgagataagagttggactcctaattataacttatgattttcaaaaaaaatatccaagcaaattcccacaaggattttcaccctaactaaaccgtataacagtgataataaaactaaaatagccttcatccgtcgtaatgcatggcattttttctagtcacctaaaaacgaaattgaaacggttcggtttttgcagaaatagaggggagaaaacgttgtaccaaatgaattaagcctatgtttcacagccaggcagttgggtcgtctctgcaacagtgacattaggcccctcgattctaggcccatgtagattcaattaagcaggccggcctataaaaaacccgagctttagatattcattttctaactgatgatcacatttactcacagattcacagttcaccattaaaaagatgggattgatgattacagttctgtcttctgccatcatatatagagataaaggcgtggtttctttttatcgctctaaggtgtactctttacgtactttccgtcccttaattaatttgcttatatattcagcatttagaagatcataacaaggacaagacgacaaccaaaaagaagacacgcaaaatgtgcaaattaaagatgatcataataaatgtacgagatatgatataaagatgcatttaaccaaaagagatttactggccccaaatcaatcgaaatgatcagcacgtactaggtaccactgtggtacggtataatgtggcagctgacacacaaaacggcggcagaattgtcatactacttggtgatcatatctaataatcctagctttgtctatgtatgggtcctcaaggttcttgaaagggataacacattgtggtcatagtcatctttgattagcaggtacctaatatcataccttagcacatgcacgagtacctagcatataagggtaatatacaaagtataatacatagactctccacatattcataagaatataaatgaaagctaaaacaatcgagtggcatgactaactagctcaacccgtttgatttagggtttatttgatacagtttcagcttcagctctatttatctatcttagagttgaagcccaaccaaataagagtggagctggttagagtactctcacaaaatgaattagagatgtggttgagtttagacagtttcacaacttcacttcaaatttaacttatgaaattaaatttaggtgttagtcctaccaaataggcttagatcgtcgaacgtgttattgctacatattatagaggtaaatcaaatattttgaaaatcatcctttcaaaaaaaatattgaaactcaaatttgacaaataaattaaaataaatattatatataaagaatacaatagaagaaagttttttagaaaatgtatttttcaaaatttagagtaaataatatatttaaaaaatctaacgaataaccccaaaagatcacaagacaccatggaatcccgtagatcttctggattagctgaacactgcatgcatgttgttgctaacgctatcttaacagtgcagcactgcagcacacagtaagtggtttggttggtcaaaaacgtactagagccacatttacaaagcaaaatgccacgagtactaccgcttgctccaccttgatgttggattagaccacagggctgacctagctaaaatcaattccactgacatggacaactaggcactagctaaagaaaaccctacatattcatacacacgtacagtacatgtatagtagtaccactgtacatatgtgtaccaggtaacaggaaatccttgtacatatacagcaaacagtaggcattgcatattgcatcttttgccagtaaaatagcctgcaaataatgtactagctagtaccaactgaatgaactgataagttcaacccaacgctacatacttactccctccgtcaaaaaaaaaaactaaacataagaggagatgtgatattttctagtataataaatctgaataaagggctatgattcattatcatagaagatgtcacatccttacctatctaggttgtgttttttttacggagggagtatgtccggtgtttttccaataaaaaaatatatatgtccaacttagagcagatgaaaaaaccatcaataagtaaaaattcgtgaaaatcggatctaaaaattctctaatatgaaaaggttctagagatatgtatagacataagatacattcccaccaaacctaaaatccaaacttaactttatttgagagagagagagagagagagagagagataaatttcgatgaatactgtccttttactatccatcttgtatggcacagctgttctcatcttgtatggcacgttctggatcgatcgatgggagaatgagacagggaccgatggatcatggtcgtctcatggatggttgctgttggtttcgttcacctacaaaagcctgcagaaacgacccagaggaggaggaaacggggaaggtttctctgttttttttctctagcaaaacaagctgcttgctagctactcctctctgcttgctgtcgcactcacaccgtgcaatctttcatcagctcatcagctgcacagcccatctctcgctgacccgtttttgtcccctgttttaatatacacacatctcccttttttttagcttgtgcttgctatattgtccaggtgtgatagtacttgtgtctactacatgtaggagcatatgcatgcaagaatttgtgtgtgtgtttctctctatctctgctggattggatacaagaagtaacaggcttgtaccagaagcaaaataaccggccgggatggccataaacccttgtctgtggcattacctctctctctatttatgaaccatgatgcttgtatatttattggcatctaaaagtggtgagaagtgcccatggggcatgtggcattgtggcaaccatcggcagggccttttgaaagcttgttttgaccatgcaccggcgatatagttttagccacaggagtcattacgacccagcctttactactactactacatcgatcgatacgaaaagagaaaattccctatatacccttgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcatcacaaatatttagtaatttattccttattggttttcacaaatcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggcatatagggaattggcccataagaaaatgaacagataagcacaagtattttagttaccattgttcatagacatattcaatggaatagttgtctgatattaagtcccctttgaatatcagaaataaaaaaaacaaaacaaataggaaaaacacatggttataataggattgcaaaacacggaaaaaacacaggaataaccgcttgattggaccatagaaaaaacaaaggaatcgggagatagactgaaggaaattttccaagagctttgagctcttgctaagtttcctccaaaatctctataggattatccattccataggaatttcaaaggactatatatgattcaatcctttgattcaaaggcatttatagaaatttttcctataggattgaaatcctccaaaattcttatgtttttcctccaaatcaaaggagcacttaggaggagaaaacttgctgttagatcctatccttttctgattctgaatttttgtttccgcagtctccctagctaatcgatatgtttcatgtaaaaatatatatatatacaaattttcatctattttttttgtaaaacaacttttcaacttcttattcctcccgtatcaaaatatagcaatatagaattagattagatatatccctcgtacaccctgctctgaatgatagtgttgatatacggcgtaaatccggatgattgatgctagggtatgtctattttaggatgaaggaagtaataattaattcatttgtttatacacttaaatagctaatagaaaatcatatgatccatcaacctatcaatttcagctatccccttaaagatgaacaccttttttaccattgtgtgagatactgaatccagctctggatgagaaatagagatgtggagcccctgttcaccaaactttccatttcctccccacctttttgctctgaagaaagtggcctttgtgtagttgtgtgtatgggtgtttccttctcttctttctctttaccaatccctccctctctctctctctctctctatacacagcagctgagacagtggcagggaggagcagagaattgaagatccttaaatgcggtttggtggcatccccccactggcccatcctccatcctttgctcccaatatcacatttgcgttttgcattttttgcactgcatttcattgcattgccacaccagtacaccacccccacctacataaaaacccaatggcaatcttgcaagaactaacctttgccaccactgatccctgctgctactcctcccatcttttacccactttgactccactccacctagctacctagctagctcgcaccttcttcttcgtgttcgttaagcttgccgggcttaccggcaaagaaggtcgtcggcgacgcgatgatgaggaggcggtggtctcgcgcggccgtcgtcgcctgcttactgctgctcgccgccgcgtgcgcggagtcggcgcgcccactgccggccccggccaaggcggcggcggcggttgtcgtcgtcaggccgaggagcgcgttcgacgtggtggtggccgggctcgtcggcatcgggctcgggcaccggtggcggcccggcggcggcgacctggtcgacgacgagaagcggcgggtgccgacggggcccaacccgctgcacaaccgatgagtactacgtggtacgtgtacgtacgtatagctagctagctagcctgccgcggcttggagagacgcgtccatgttatatatatttccgccattagcgtgggcgcgaggagcaagcaaagctccatcgcagagtcgtcatggcggcggcgacgacgacgaggaggagaagaggaggagaagaatgggaaggagaagagaggagttcgtccagtattgtttcccttctgcttccctttcttctttgtccctcttctgatccacttaatttggttttttttatttttttttcttgattttattttgatttttttcctctcttgtattgattggtttgtgaagtggacagcaaggccattctgttgatcgaaagagagatagagatatgagtatagtgtttcttgtttccatatccatctcttaatctatagttttcttgatgattgtgttgttatttggtagtatatattggtacatgcatgctcttgtgtacaatcacatagttgacttccttgcattaattttgggtacaaaatgattaattagctaggctaaattactcaatgaaaacaatcagactactgcatctttgcaggggagtcgtagtgggaaaaagttcacaaaagaaacatcttggattgaagtatacgatagcttttaaaagagaagttcgtcgagaacgcaatggattaaaagggaagtcttgtgggagaagagatgactgtgtgaaaaaaaaaatcaaatcttttttccagaagttaggaaatgatgaacatcaatcgatcaccccaatgtgatgaattcccttttgaatttagcatgaatttcttgtgcctcttttctttattgacgaaagttttgaaccccatttaatttctattgagtctttcatacactcccttttcccaatttttgcattatcatttcctccaattaatttaaggcaacgtcaacgtggacaactaaacaggaaattaaaacaggaaaagcaatgagtgcatgcatttttctctcgaattccaaatatccagtgcatttttttatacgtagatatataagttcagagatacagtttactactaaatcctaagcccttatggatacaaatatcaggaaaaaaacaagaatattgtcaagaagtgaagaaaaacaaaaggaaaatccaatgcatgcctgtccaaatttatttcatctagttggaaattctgcaaggtttcataaatgttggatgtgattggtgggcagataatccagatgtgcgactactatttcagcccagtaattgctccctatcgcccacacaaatctctatcacacatcgatctcttgtcagcactgaagcccagcgtttgttgatatctcaacgccaagactgaatcttcttcctccagggattagttgagactgttcggggaattatgaatttatgatccgtcgtttctgtcacatttgagtggcttaatctggtgaacgatcgatgaagtggaggtgtttgatcgatgtgacgccgttgcaattattttgtcatccttggtgctcgccagaggctctccaagggcattctcaacccaataattagatggtgtccatagcattatataagctgtcacctagaatgaaaaataatgtggcaattgaataaacgagtaaagagaaggaaaccatatcttgtatgagacatagtttctacacaatatccaagacatcatgtgagataagtagcattaaatttaagtatgaaatagtggtgtttgcattagaagagtagtttcgtactagtttcgtgatgatgtggagtttataaaaaccatgtatagtgtcttgggttaggaatagcctaattcccacggagtatcatcaagaggctgtcctcctacagcactcggacaacgagttgcattgatgtcacagctgcttgctgtgcaggttgataggagtgtgttcttggttaattaggtttgcttaaccgtgtaatgggtctaatcctactttaaattgttatattttataacggagggagcatatatttaaatatatttttttctatggtgttgttcttttcagcgtatttattggattattaaaatagattattcgctcaacacttaattttttttataaaaaaaatcttatgttctattaattatatcacttattttgagctatttggtacatttatttctcaaaatatttaaccgatccctgtaattaagtagataacccatggcaataatccattgaacaatctaagtccatgtttgattcagcttagaattatgataatctaaattattaggagtaagctgaaataaacaaatagcttattatgatatattattataatctataagctagattactataatctgataatccattataaatgtgcattttctagattattgggtgactaacagctaataatccagagaatcaaacagctaacaacttattctatgctggcttattataatccaacttatagcaatctgattcaataatctagattataataatcttaagctgaaacaaatagggcctaaatcaaatggtagagacagagatggaatgctattttgttgttttaatgaaatatctgatatcttttactagtaaaaaacagaagaataagttgcaacagaatgacagatgcatgacaattggcaaggacttggcaagaaatacaaggacgagtacgtgctagtacaacaccaattagctggaggaggtagctagctaaccaaggccttgtttagttataaatttttttttaaaacttttaactttttcatcacatcaaaacttttctacacacaaacttccagactttttcatcacatcattttaatctcaaccaaacttacaatttttgcgtgaactaagcacaccccaagtgcagtgcagtgtcaaacaaacagctcaggaatctcatcgacatggacccttctcctacatgggtacgaacagtatccatccatccatccttgaagccagcaagctgatgcagcagtgctgctcgcatcaattgcacatgtctgcatatatatctgtcccagcctctccccagcttacatctgaagtctgagcaacatacatacacatactacacgcgtttcagagattattggtggacggatgcagcaagcaagccgggaaagactttacagaggacatcatgatgtgaaaacggaaactttacgctgcattttcgactgacgatttcctctcgcagctgctattcaggagagtcttaactactagcgcagtagcgctccgctctctatctctgctcgtctctctactgtaccaccggtgaggtgaatggcgtgtagtaaccttctccatttttaaaatctcgcaatttctaatggtaaccgtacagtttttgttgtaaccgtgctattaccgtatagtatatcattacaccgtgagataatgataacccgtaaccctcattaccggattaattagtaaaacaataagagaaattcaagacgaggaagcaaaggaggttttcagtgaaggtggtatatatagatcagaagatatagatccttcgcataactgccaatgcagtagcagtgggccacggtttcccttaccgccggtaaccgcgcggttaccaggcttaccgcgggggtacggtaatataaataccgcggtaacctctttaaatttaaataaatttaaaaaataatttgaatttttgataaattttacacggttttgtatgattttccacggttaccgcgcggtaaccgtgcttaccgccagggcgcggtaaccccggccccaacggtttgagaaaccctggcagcggctgacatccgagttcatgtctataaatcaatagtatttgttactgcaccaacattaccgtagacaatcctcactggtatatcaggatcagctgcttgctgcagtagagagggaggccgggtggccagtgagtcaatacggtagcattgccatctcggcagtgctggctggctggctggctggacctctgccttttgccgttgctccctgcgactgcgagtgagtgcccccatgcttcggtctctagcgctgtctttaatgggagtggggcgagcaacaaaatgtgtttaactagatttgtttcaccccttgttttttttcttggaatagtactactaataatgaattatattttgtccagatatgacatactttagtactataaatctgaaagtatatctatttagaattatagtattaggatatgtctaattcaatattagggcatgtataaaggtagagttagatatgagcgctacgttatctagagactagcatcctacaacagttagagacaatatggtctctaattattaatatatcaaaataccttttcatactcttctattcagacttgtagtattaggatatgtctaattcgatattagggcatgtacaaaggtagagttagatatgagcgctacgttatctaaagactagcatcctacaacagttagagacaatatggtctctaatcattaatatatcaaaatactttttcttactcttctttcctttttttcactaccatgcaacaaaatttgctctaataaatgctaagagtcgactttgagccgttgtcatgcataacaaccatactcatttctctttcttccatatcatcaaatttacttgcatgacaatatagagagaccactaataaatacagttgtatatgatcttagttagtattttatgagacgaagaaagtagaagtagagaaatcatcgtcaaatcttaagcggccctcagattcaaagtttcaaaccagtccttgtctccgataaaaagaaagattcagggcaggagcgttaaaacaggaggagtaattactgcctacgcccataaatggcgttagattatcctgtaatggtaaaaatcggaaccagaggtacggtcgatgctcttctctcttttgccgtgctacattgtcccgttgtgtttcgaactaatcccgagtattatggagatgtttggtacagtaagatattgtttcctctcaacacaacataggagtacataaaaattactccctctgtctcctaataaactcaattttctctccttccgtttattttaaaataagttcatttattattgtatagggtttattaaagtaaaaaataattatagtggaagtgtataaaatagataataattgcatttggaatttaataaagtaggtatattctagtcttttttatcagtatgtgttagatgcgtgaaaaatgttttttagactaagggagtaacaacaacgtgttacttatatttatgagaggcagtaatattatttaacaagggcaaatgattgggggaaaacgagaatgctaaaagaaaaatatataatattgatgaagaacttaaatccatgatgggagcactggtggagaaaccatctttggtcggtcgaccaaatttcacaatagtctcgattccattaaaaaccgggactaaaaacgatttttagtcccggtttaaaaacttttgatctttagtcccggttggtaacaccaaccaggactaaagatgatttgtagtcccggttcatcccctgtcagatgtatgtcagggggtcgagaatctttagtcccggttgatactaccaatcgggactaaaaattaccacttcaccaaccgggactaaagatcgagtgatctttactcccagttggtattaccaaccgggactaaagatcgatctttagtcccggttgaagttatcaaccgggagtaaatatttctctcccacatccgatcggttaagtcccagacagatatt

SEQ ID NO: 14306 - DNA, 9921 bp, Oryza sativa
actagccattagcaaatcaacaacaaaataataataataaaaaatctcgaggaactgtcgcttcccctctttagtctcggttggtacccctctttactcccggttggtaacaccaaccgggactaaagattgatctttagtcccggttatttaaaccgggactaaagatagcgatttttagtcccggattcgtagtcccggttggaaaaccgggactaaaggggggttatcaaccgagactaaaaacagtttctccaccagtggagaacatatttttcatcctccattactctctaggcaatgaatactggatatttcggcacggtattctcaaaagcaactttggtcagtagtctattagataaatatccaattttgttaaagtttttttaaaatcaattatacaaattgtttctatgtttttaaagtaaatactttaaaagttatttataatgagagttttaaaagtttaacattagttttgtttaaaacgataattatttttaagctgaaaggagctcagcacgcaaaacaaagctcgtattattacatgattatttaagtattaactttttttaaaaaatagattaatatgattttttaagataactttcatgtagaaagtttttgtataaataacatcatttaatagtttgaaaaacgtgcgcgtgaaaaatgggagaggtggattgggaaaatgggtgaagaacacagccctagagagaagatagaggcgctagggtgagttaatttgggcagtgcataggtgaaccagtgaaggccggccaaaaatagaggcagcaaccagtgggagaatgattttgaccatgatttcaattctttaatggttgttgaatgcatcaatgcaagtgtgttcaaactacaaaatctgtcatgtcgtcaaccttccttgtagctcactcaaattatcggaaatgccaaccatcattttggagctttctctgcttgtattgaccgtttcacaatcacatcatgaacaacaatgctgctcccaacttttaaagcttaaaaaaatattcctcgtcctactccttccgctgagaaacattaagcatttcgagctccagatatcagattacggtagatttgaagtttgtatgttaaaatatatcagagtagtttaaaattttaatttttatttaaaataaaaataatttgatttatccaaatgttatatacacgtaatatgtatagatttgtgagttaggaataccctgttttataaaatcttatatctgaagttgtgctaaagagggcttaataaaaaatatcttactcactgtattctaaaatataagacacattcgccttttccaatgtttataatacaagaagcgcatgtattaactatgaccttctctctcttttattccctccgttccataatataaggcataactattttattttggatgttccataatataaggcagacatgcatgcatacaagagaccacctatatatttgtcgacaaattttctactaaaaatttaatagatgtaattatagtacaatcgtagtgtaattacactgtaacttgtatgtaattatactgtaacttgcatgtaactatagtgtaacttgtatgtagatttgttctggtgaggaagaaaaaaatcatagcacacacatatgtgaaaagatttgttcccacgacctctattttactgaaataacatgttaccgagagattcttgaaagttacatacaagttacaatgtaattacatgcaagttacagtgtaattacactacgattttactataattacatatgataaatattagggggagaaatttgatgacaaatatctagcaaaatcgtgcatacaattaattaggacctcttcttcattaaattattgcttttttaaatcatccaccctcaagatttctaattctattagatgcatgcattacatttattagggtgatccaaactaggaaataataataattgtttctttgtctttgggttaagggtggttgtgccttatattttggaacggagggattagttcttttctaaaatcctctaccctcaatatttataatcccattggatgtatatatgcattattgggttaatctaaacaagaaggtgatagtagctttagattacaatatagcagcggataacccaaattatcagtccctagtcattcatgaagaatgcagtttttttgaatgagcaatacaaatttgcctctccttccttttcccactcttcttatttggtagtagtactactctgtacaaaactaatactattgtgcaacaaaaaaagcaccatataatgtatagcatttgtgcttgattgccagcaagtcagcaacatccatggcaggtattgctgagacacgatctcgctgtaggacgaaacagttcttaccattccatcatcaccaatggcgacttcaatatatgcgtgggtgcgaccatttatatgccacagctcatgtcgtacggcctgtcgaccatcggcgacggcgtgccgagccagtacgccgtcgacctcatctccgccgccgtgtccgagccgccgccgttgttcttgtccttgaggctcttcctgtccaggaacgccggcctcaccggcgcggggatgacggactgctccgtcgtcttcatggtgagcattagcaccacctccgacatcgccggcctcaggttcgggaatggctgcacgcagagcagcgcgatctggcacacctgcatcacctccttctcgtcgaacccgtcggcctgcagcttcgcgtcgaccagctccagtatcttggattgctcgtacagcctccatgcctgaagaagattcagaatgagagagattcttgtgacagtgtcgtaaactcgtagtaatgtggagtttgggttcagaaaaaagattcagacatgttcaggcaggtactgcatttcgttcgggagagagagatccgtgttcttcctgctgctgacgatctcgagcacgagaactccgaagctgtaggtgtcggctttcactgtgagctcccctctgatggcgtattcaggcgccgtgtagcctctgaaaatccatggatcacaaagttcttcagaaacaaaatttacaaccttgtcatggctcaggtgttcagagctagctagctacgggttaagcgagctgagtactatactttcttcagtacttacagtgtgccggcaaatgccgtgctgaggtatgtctggtcctcggggaagaatcttgccaagccaaagtcactgatcttgggctgaaacttatcgtccaggaggatgttgctcgccttgatgtcgcgatgaacaatcctcaggttggactcctcgtgcaggtactgcaggcctctcgcgatgccgatgatgatctggtgccgcgtcttccagttcagaaatggtgcaccatcaacacctgcaaagttaatggatgtgtaaaaatgtggatcaagtaaacaatgtttttgcttgttcttgacagtttttaggttcaggatgtaatgcttaccaaacagtatcttgtccaagctcttgttcttcatgtactcgtagacgagcagccgttgctggccctccgagcagcagcccacaaggcgaacaaggttcttgtgctggatgctggttatcatgttcacctcgacgaagaactcggactcgccctgacctgacttgccgacgctcagctgcttcacagcaaccttcctgccatcgtctagtttcccctgataatgaacattagcattgcaaacaaccataatgcaatcagaaattgctgtagaatggtaggtgatactgatacagattcagtattgttttgtggcgtttcttggcagaaaaaagtgtaccagataaacaggtccaaagcctcctctcccgagctgattcttctggtggaaatccctcgtggccttcttcagtgttgcataatcaaagtatgttattgtgcgcagattgccgctcatgttgccgctgaaatactcgggtacctctgttacatggacagaaagagaaacagcagagttttatacaaaaattatggagcagtttgtgttttattgttgatcagcaggtttgatgagaatgataggttcacctgacggagccctctttggcctcatcaatctcctcatgatatctggcctgaggaacttccagcagataccaagtaggatgaagatgactatgatgagaatcacgatgaaggccaggaagaccgcactcgcatttgggttcgccattgttgctgtctatttctgcacattcatccacccaaaacctaacattttcagctgaaacttgttctaaaatgttttcgtgccagttacttagttgcctgtactccgtacaagcaaagcagaggtgaattgcacatatgctcagtgacatgccaaacaaaaaaaatacagtaaaaacctgaaaactacttaaaaaaattactcattgtgacatgaacaaatctcatatatccatttatgtatcctatgttagttttcaggttaactcaagcctgaagtaattaagggtaggaacctaataaacaacatgatagaaaacgccatgaactaactaataccacagatcagccatgtcgaggagaaaatacttcctctcaccactatactagactcatctatttagttcaaagaaaactgtagttaagtcatcttgtacctactgtacgtacctttgcagaacagtcggtcgatccaacggcgatgatcaccggacgcgccgccgaagccgtcgccgccgccgccgcttcgtcctctgtacgcagccgtaacagctgcaagtctgcaagattgcaatgcgaggcttccaatgccgtgtggcgatggaaggtaagcagagctatcggtttctccgaggcgctcgcgcgtgtcgtgtgtccgatccgatccggtcgtacttcgcgctggctgcatgctgccactgccggccgctagctagcaagcattcggtaggcaaaagctcgcgaggatattagagtagcgcgacagcgacgccaaaggcatttgttaagctcaattgctagaaaacttatgcaagttttttttttatgtctctaaaatttttagatttgtgaccatatgatcatcttgagatttgtactagaaaattagcgcgcccgttggtgcgcttgctaatctaacctgtatttttctctagcattatgataatacttatacctttataagtagtatttttatttttacgtcgtggaagaattatagttatatacactacgaatcgatgaagatcatattttaaaggatataaaaatttatttttacgtcgtgaaagaatcatagttatatgcactacgaatcgatgaagatcatattttaaaggatataaaaatttattttcttttctaaagattctgcctcgcttctaaatttaagagttttaaacataacctgttagaatttgtagaatttagaagtaaacaatttttatagtgtttaaaattgccactaaatattctaccttttctagacacaaaggatatatagggttaagttacctatttctaattctaacatgtctcatgtcgtatttatcggaatttttctccctgactttcctaaaactgcaaaagttttgtaattaaaaaaaatttaacaccttatgtatttgtttataattcatattcctttttatatgtaaagttttttttaacatgtttgtagagcgtactctctctttttatacatattgtagcttttaaaatgatattgaagttgcactttaaacattaatttatttcataataatcgatacctatgaagtcgaaataaatttcacgttacagcttatatgtgcctaagtaaatatacttatatttcgctgagcttttgtattaaaatattacgcatggcatccaaaactgctagacagtgctgtactgctgtagctgtttcatcacacacactgttatgggccaatttggatttttttggctgtgcgtgcgatggaattttggcccagccatccaggcaaaaacgtattacgggagagatcgagaagggtaccctgccggcgcgtccgcacgattacgtgcacgatttaattcacaagttgcccgtcttattatcgttgctccacgtgtcaacaaattactcgaccatatggaccaatcagattgtataaaacctgccggctttagatatatagatagatagatgtcacgcgtaacatctacgtactaaccaaccaaattatggttgaatataagttttaaataagttataccacagttacagtactataattatcgtgtagtaattatagtatagttataatttaatttaattatattatagttacatcttaatgtttttcgctgaagaatattacctcgaacaagtttggagtttttgttggcgattgattagtggatcgcgcgacgaacttgttccaggccggtagttgtggcctgtgggccggccggtgaagacgcatggccttccacggcccacggaaatcttgagttggtgtccgcatacggcccatcatcaaatctacagcgcgtgatgcaaaattggaataaggtccatgaacagtaacagcattttccaaccagcaaccgacaaaagctgatcgttggattgaaatacagagcatccagccacaggcgccgcccccactcacgcgacgcgaaccggagaaatataaaaaaatcgagcaaagtcatttcaaacaacgaatccccttccccggatcaagcagctagggtttccacctctccctcccccaaatcttctccatggccgccgccgccgccgccgacgcatcggccgaggccgcggccatcgcgcggcgcctggcctcctgcaacggctccgcacgggagcgcgcggtgcggcacctcctctccaccttcctcccggcctcggctccgcacctctccgcctccgacctcctcaagctctggaagggcctcttcttctgcttctggcactccgacaagccgctctaccagtcctccctcgccacccgcctcgccgccggcgtctcctcgggcccctcgccggccgccgccgccgccttcttcgccgcctacctcgccaccctccgccgcgagtgggtccacatcgacacccaccgcctcgacaagttctacctcctcaaccgcaggttcctccaccacgccttcctcctcctcgccgccaactccttcgccgccgacctcacctcccaggtcgtatcgatcctgtcggagaaggtactccttcccgaggccgacaacgtcgccgccggctcgccccgtgggcttgggtaccatgtcgccgaggtgtttctggacgagctgtcgcctgtgctccctgtgagcttacagacaatggaggtgttgctatctcctttcttcgctgtgttggagaagtcatctgatagggtgatggtggctaaggttaagtctagtgtgtttgagaggttcctcgagagcggcaaacaattgctcgagatggcgaagaaaggcgagggggtggagaaggggagcgcagacgagaagattgggaaggttggcttgctgtttgggttcagcaagaggttctcagatattggggcgaaggcggagaccgtgcaagcaaaccgaaaggtgctatttgggctgagggatgcgtttgtgaaggttgagaaaggattggagctctctggggtcgagattgctgtgccagagttcaagagtaccgaggtgacaggggtggagaatggcatggatttggatgaggtgaaggtggagaagaagaagaagaaaaaggcgaagaaagcttcattggtggaaggtgagacagagggggccaaggattcaaagcaagagaaaaaggtcaagaaggagaagaaagagaagaagaaaaagaagaaggtagaggttgttgatgagggagatgtcacggaacagagtacagacgctcctgcagaggaggaccaacagatgggtgatggtactgaggctgttacatttgatgagacattgatgtccaatctccagaagcagtttgagaaggctgcagcagaagctggtatggtcaatggaggcagcagctcaagtgctttgcccgctagtgggaaagctgcaaagaaaaggaagagagcaaaatctgcagataggttatcggtttctgatggagacgatgttagcagcgaaggtacaattatttcccaggatggggagaagagcggtaagaaagtgaggttctcgatgaagaataatctagtttggaagcctcacaatcctttgccgccgcagtgcttgaggctgccaccatctgctactccaagagggagtgcactaaaaaagggtgttctgcctgggcctataaaagaaacgcctacgcctgtgaagaagactaagccaaaagcgaaatctgcaaagaaggtcttgaagaagccttcctcagccgcgaagcgcttgcggaagttgcaaaatttctctgcatgaactcttttatgaattgacactgcagtgatcatgctttctgcatggtgtgtcttttcaaccgtgttctattattacttaattcttcacctaggttagtcttatacgctgttgactatgcaccaaatttatatttatggattgtttaatgttgtgttatgtcatagcgcattcatgataatcatgtgggtgatcattctttggaattagcagtagcaattttgatctggatagtacaagtctgaattcccatggatgtcctttctgttccaactatatatcttcctccattaaaaaaactatacatcttcctgttttctttcacaactgtggcttagtacagagtactggttcagtgattctatatagatgaatcgcttccacaagcttattttcttattgatgatcagacaggcggattcttctgagcattatgatgttccatttgacataagattgttaacatcactggtgtttggcatgaaggcctttagttactagtttgcatgatgaagatagctgttgacatagtttgtttctttcagtacccagtaactttgatggggaatgttctgtctgcatatggtacacaagaatgagatgtgtatgaatgataattagcactacatgtttctgtatgtgaaaccgacctactactgctagatatagatatcatgctcaattgtttctgtccaatatctccgtgatccaagaaagttactgaaatcaagattcaagagcagagcgtttcgaagaggtgagttgttgggagaacatgagcagcatatgttatactgtattgacttcctcagaagttctgatttctgatatcttgtctctgaaaatcccttttggctaaattgcgcctgcactggcaatagacgctgtgctgtcgcaaccggggctcgtcagtattaatttctgctactgatttcacttgtttttcttgtatcagtatcaactcattaattttctcaacagcacgttgcagagacagctatcatcggtgaactgcgattgtgatgcttgtattataattcgtattcgtattattggattctttcttgtggtgaatgatactgctacttggccgcactatttcgtgaaatgtgcatgttgtgaatgtagtagtatgatcaatgtcaagcaatccagaaccgaaaatcaaccactgaaaattgctgtgatcaaagatagcttcctagagagagcgcgcacggatcacgaggcttcagcagcggtcaagatgacactgtgatcgttggcacaagtcgctcttgcttagagagctagagttagttattgtcgtcgtgtagaatatagttagcgaaatgccaggatcaattcatagacgaaattgtagattgcttcacttggttgtaattccaatgtgccacatgaagaagaagaatcatcacaaaggtgaaaaaataagagtcagtagtcacaccaatccacaaccttggcag

SEQ ID NO: 14307 - DNA, 33147 bp, Oryza sativa
  unsure (1)..(33147): unsure at all n locations
caagttttggttcttgacccgtctctgattcctgatgtggtggatgtggttattggtgatcacttgtatgagctgtcttttagagtagaacctgaaaataggcctgaggagcctgtgcctatggagatggagaatttggatgatggggatttggaaaagaaaaaagaggggaacatgaatcaggatctggggaagggggctggtttatttgattcaggtaacagctctaagatgggttctggtggtcaatttagtgagaggggtggtccttctgctccctcttctcagctaaatctgatacctgaatctgatgacttgactgtttctgatgaagaatttgatggtttagatgaggagactataatggttgacaaggcccagattcaggaaagtcttgtggcaaagctctctgctatccctgaggcagtaatctctccatcaaggaagagtaagagaagggcaagtgatagcgattagcttgttcttgaaagggccgaaaagttgaaggctgataagaacttggagaacctgcaggctaaaggtaattcagttaataatgtttcttttacacaattttcaaatgatcaaatatctgcacatcttcataatcttggtgttataccttctagtaaaaatgttgttttagatgatgtaattaatgatttgaaatgtgtagaaaataataggataagcggatgtgcttgttcttctattaatcaagtttgtacccctaatgttgatactgagtcattagatgaccagttggaggataattttttactacaacatttatgtagtgaaattatggaagaggtcatggattttagcgaggactgtgagaatagtcttaaaaacactttaaatcctatggcatcttctcctaactctaagaaaaagagtaaaagggggaaaaataagaaaaataataaaaatagtttcaaatgaagggaatcttttggaattgtgatgggtttaaggacccaaaaaaacataagtttatttctgacttgaccaaggaacatcagcttgactttatagcattgtctgagacggttaagaaagaatttactccagctgcacttaaaaatctttgtgctggtaaggagtttttgtggcattgtaaacctcccagaggtaggtctgggggtcttctgttaggcatcaatttactaaacgttgatattggtttaattgatgaaggtgatttttatattaagttccaattatgtaacaaagttgataagttcaagtgggctttagttttagtttatggaccggcacaaaatgaacttaaggatcaatttcttgctgaattagttaatttgtgcagtcatgaatccctaccaattctcattggtggtgattttaatattttacgtagccctgatgaaaaaaataatgacagttacgatgatagatggccctttctttttaatgctattattgagggactgtgtcttagggagttacaaatgtcaggtaggatttatacttgggcaaataacttagcaaatccaacttatgagaaacttgataggattttgatgtccactgagtgggaacataaatttcctttatcctcggtggttgctcttaatagagatatttcggatcatactccacttcttttaaatacaaactccaccttttcaggtaatgcacaacatagttttaaattcgaacttggttggttattacgtgatggctttgtagatatggtaaaggaggtctggtctagtgtacatgagggtaatactcctatggagcaatggcaggcgaagattcgccgattaagacggcatttgagaggatggtgtcgacgtttgatgtcacgactacggtatttggacagtatggggatcgttggtgctaggatatacgcgagactgaggtaaaagagatggagacagggatttttatacaggttcggacccctgagttgtcaggtaataaccctacatcctgttggccggagtcggagttgcttttattcaccataatcacaccagtacaatatgtggggtagcctatctaactgttgtcgacatgtcggtctgaagatctgactcgtagtcgacaacagggtagccttcctcctcgaatccgtgcccggcgaggtcagagatagtgctttcgtctctcctgacggtatccggagacaccgtaggggaatagccatgcctatccctgaagtcgatatccagcggcgtgtcttggcgtatgtaggcttgtatgttgtggcttctggtgggtgtatgttgattgtcatgggtgtcttccatggtggttcctctcccctgtcctcctaggggggcttgtatttatacccataggtgtccccttgtccgagtagaactagggaaaccaatatggatacaatccgagtagtccttgtcgtttcaatgtagaactctggttgtctttccttatccggaactccctcctatatccgtaggttgtttccgtataggacatggtatgtggtgggtcctgccgagatttagtcaactactattaggtatgtggtatccataaccataacagatgggataaacatacaagtggtatgtataaaaaacaaaaaagggagattttggataggttggatttgttggataaaaaggctgaatctattcttctaactcaggaggaaattgattttagatggttttgtaggaatagattatctactcttatgagagaagaagaaattaagtggtattaaagggctaaaactaaggatattttggagggtgattcaaatacaaagtattttcatttggttgctaacggcaaacataaaaaaaccagaatttttcaacttcaagatggggatcaattgataaatggtgatgcaaatctaaaatcacatattaccacttattataaaggcctctttggtcttcctgatgattctgatctccagtttgatgaaaataattttgtggatatcccacaagtatctcaattagagaatgaagctttaatacaagaattcactgaaaagaaattaaagaggctattttccaaatggaacataataaagctccgagtcctgatggatttcctgctgagttttatcaggtcttttgggatgtcattaaggatgatatgttggatcttttcagatattttcataatggtactttgcctttattctcccttaactttggtactattattcttttgcctaagtgtgatgaggccatgaaaattcaacaatataggcctatcttcttacttaatgttagttttaagatctttaccaaagttgctacgaatagaataatgagtgttgctcaaaaagtgattagccctactcaaactgcttttatacctaggagaaatattatggaaggtgttgttattttgcatgaaactatgcatgaattacatcgcaaaaataaaagtgctgtgatttttaagatcgattttgaaaaagcctatgacaaggttaaatggtcttttgtacaacagacgctcagaatgaaaggtttctctcctaaatggtgtgagtggataacttcttttattcaagggggacatgttggtattagagtaaatgatcagaccggtaataattttcaaacttacaaaggtctaaggcaaggagatcctttatctccaattctttttaatatagtagcagatatgcttaccttattaattaagagggctaaagatgctggttcattgaatagggtagtccctcacctagtggatgatggtttatctattttacagtatgcagatgataccatcatatgtttggaacatgacttacaacaagcgaagaatcttaaattgattttatctgtgtttgaaaagttgtctgtcttgaaaataaattttcataagagtgaattattttgttttggtcaggcaaaggaatattatgatgagtattctaacatctttggttgtaagtttggctctccctgttaaatatcttggtataccaatgcatgttagaaaactgaataatagagattggaaaatgattgagaaaagaattgagaaaaaacttagtagttggaaaggaaaacatttatctgttgggggtagactggttttgattaactctgtactttcaagtttagctatgtttatgatatctttttttgagataccaaaggggttcttcaaaaaattgattattataaatcacggttcttttggcaaggagatgaccataaaaaaaagtatagacttactagatgggatatcatttgtcaacctaaggatcaggaaggtttaggggttcataacttggaaatacaaaacaagtgtctcttgagtaagtggttgtttaagttgattaacgaggaaagtgtatggcaaaatctattgaagagaaagtatctctacaatcagtctataacccaagtgaataagaaacagggcggttctcatttttggtcaggtctcatgaaagtcaaagataccttcttagatatgggttcttggattgtaaataatgagaaacaaataaggttctgggaagataaatggctaggaaacctggcttttaaagacaaatatccatctttatactctattgtccgaaggaaaagttctactattgctaatgttatgagatctgttccactcaatgtttcctttaggagatcattagttggtcagaatcttgcatattggcatgaattgtgtgcttctattgtacatattcaattgaatcaatcctctgatagctttagatggaattatcatcagaatggaatattttctattaggtcgatgtatctagctttaattaataatggttatatttagagaaacaagattatttggaagcttaagatgccacttaagattaagatttttatgtggtacttgcttaaaggggttgtgctaaccaaggataatttggcaagacgaaattggaatggcagtttaagatattttttaatgaaaaatgagactattcaacatctttttatagagtgtcattatgcaaaatttgtttggagagcagtacagttctctcttggtttataccttcctactaccatatctaatatatttgatggttggctcttgggggtagacaagaagaagagtaaactcatacttgtaggagcttctgccatatgttgggctctgtggttgactaggaatgatatggtttttgacaaatcaccatctatctcatatatgcaggtaattttcagggcaacatattggctccgattttgggcacagctgcaaatgtgtgaagatgatcgagagcttatgaaggttgcatgtcgtagacttgagacaacggtcatgcaactccttgcaaactatggatggagattcacaaatagacttgaataaatgtgctctccttatcttagtttgatcttttattttgttgggtgtgtttaattcatttgaactacactcagtgtttgggtgttacttttataataattggctgtaactctgatgagtaaaggccgggatgttttatttcattatctaaaaaaaccaagggttaataaacctagaacaagttggtgactattagagtgttgacaatataaaattagttatattattaaatttaacatttaacatatatttataatatgtttgttccgtattgaaaatattaatatatttttctacaaacttagttaaacgtataaaattttgactaagaaaatattcaaaagatttttaatatgaaatggagcaagcatgagagagtttatcagttcagacaaagaaaaaaaggaaaaaaaaacattgttcagtcggcggccatctccttcctgatgtcgtccaggagatcgtccctgtactcggcgaacgtgccgtcgtacggcctcaccgtgccgtcctgcaccacccacagcgcgctcctctcctcgtcgtcgcagacgcgggacaccagcctcgagtcatggctgacgatgaccacgccgccggcgaactcgtcgagcgcgtccgccagcgcgtcgatgttctgcnnnnnnnnnnnnnnnnnnnnnnnnnnnnnnnncaacacgtgcggctccccgagcgcgacggaggcgagcgcgacgcgggccttctgcccgccggagagcttgccgatggtggtgaggtggctctccttggccagcccgaacctggcgagcttggcgcgcgcctcccatggcttgctcttcaggtggggatgcgtgtcgagacactctcggtgacattctggtgacattgagtcactgacatgtgggtcatgggggaatgtcactgaatctacgtccgtgctgcacggggctcttctcctccggcagcgcgtcgcagaagtgctgcgagtagagcccgatcctcagcttggggttcctcctcgcctcgccgctcgtcggcgtgagctcgccggcgaggagcttgaggagggtggatttccctgccccgttggggccgacgacggcgacgcgctgccccatggagacgtcggcgtcgatggcggacagctggaatccgccgcgggtgaacccggcctcggcgaggcggaggaggggcccgccgccggcgagctcggtgggcgcggcgaagtggaactcgacggtgtagtcgtgccacttcttgggcgccctccggccgctcttccgcgccgccttggccagcctctcgctctccttcatggccttggccttcttctgctcgtagctgccgacgaaggagtcgaagccgccgcggtaggcgtgcagcttcttgtcctggaggtgcacgacctcgtcgcagatggcgttgaggaagccctcctcgtgggagacgacgacgagggtgctcttgcactgcgcggtaaggtactcctccagccacaggacggcgcggaggtcgaggtggttggtgggctcgtcgaggaggaggagcgttggctgcatgaagagcgcgccggcgagcgcgatgcgcttgatccagccgccgctgaaggagctcgccggccgcgcctggctcgcctggtcgaaccccagcccggcgaggatcttggccgcgcgcgccggggcggtgtcccagccacgctgcgtgagctcctcgtacacctcggcgagccgggcgccgttggcggcggcggcggcggaggaggcctcgagctggtcacgctcggcgcgcagcgtggcgagctcctcgtcggcggcgagcaccacctcgatcaccgggcgggggtcgcggttgtcgtcctcctgcaccacgagcgtgacgcggatgccgcgcggcaccgggagcttcctccagtggaggagcttgagcagggtggtcttccccttgccgttgggcccgacgaggccgtaccgccgcccgtgcgcgacgcgcagcgacgcgccctcgaacagcgccaccccctgcacccacacgtcggagtcctccacgacgacgtccctcacgttgtcagtcgcggcgtccgcggtgccggcggcgccgcgtcccaggacgcggccgccgatggtgacgacgtacgagtcagggtcgtcccagagattcgccgccgccgccgccgcctcgtgcttgcgccgctcctccttcttcttcgtcttcacctccttgcgctgcggcggcggcggcggcgcggcggcgttgacgtcgaccggcgcgaacgacgccgccctcggcgtggcagcgccagcgagctcgtcatcgtcgtcgtcgtcggaagggggggagatcgatcccagctaggtacgacgagggctcggagttcttcgtgggcctcgatctaccggccttcgccttggaatccggcggcgcggcggcggaggggttgggcttgcgggcggcgtgtaccttgtgcaccattgtttcgatcgtaagttcgtcggttttcctttcggctcggacttcgggggatttcgcggggctcggcttttggtgttcgccttgtctgtccctactatatctaccgtctcgcctattcagattcgtaacgagtcttctctgattggattcaccaaactgcttcttcacggtaagacggttatcggtttcatgaattgagaaaaaggttatcgcaagtgatcaagagcggaggcaagcctatgacaactagggcttacagcccaagccctagggttgtcttcaaaatcatgtataaattgttttaaatcaccatgtagttttaaaaaaaaatcaacaacttattagttgagccttagcctagccatactctttaataatttctagcttcgccgctgcacgcgataatagtgatacccgcatgataaccgggcggttttgtaaaccttgctgtgtcgctataatttaagaaagtggaaccgatggattatatataggtttgggctactggattgcgcgcacttgggccagcctgagccttcttcgttgggccattggcggatttgggcccattacggatttgtaatgggccggtggaaagcccaaaaacgtgaggtgtccttcactccgaccgttacagataagccccagcgccgtacgagacggcacaacacgacggccgctcgccgatcacacgctgacgcgcacacaccggcgatttctcagccgcaatcgccatggccaccgccaccgccacctccctcgcctcctccgccgcgcaccgccgcctcccgccctcgcgctcagccgctagctccatcctgagagcccccaaccggggccgcctctgccccggctccccgtcggtgctccgcgcgtcgtcctcgtctccgtcgtctccccagcccaccgccggcggtgatgagggggaggaggaggaggaggggcggaggctgtcgaagcagtcgtcgtgggaggcgaaggactccgagggggatgactacctctaccgcctcgggaaggaggccgacaacatgaacatcgccgtcggcgcgcggagcggcatcgtcgacgacctcttcgtcggcaacttcctcggcaaagactgtacgcgctccagcacttggatgccccgttcgatccaaataccatcttataataaaatgtcctgaattgtttggttcctgaacatgagattctgtatactaacttcagcagtagacgatctttccttggttacagctctatatatatagttacttgtgaaatgtgtttgcagcggatattgtgttcgattaccggcagaaagcgaccaggacgtttgagtacctgcaaggagattattacatcgcacccctcttccttgtgagtgtaattttagttcatcttcagctgatctttttttttttactgcatcctcgtacttttatgctgttctaggtacctgattgacaaagatttgacactgcagattcgttgtggtgcaggataaagttggtaagcaatttaatgtaggaggaagcacattgttataatcaggtatctcactcttacagtttgaagagactacatctttcgtttcacctgcataaacagtggctactgaagtatcagtgtccttctgtataagaaactgaacaagttatacaaaggtgtaacagttgccgaataagcttaccaccatataccaacagtccctagaggcctagactgaatatatatatttttgggtcaaactatcaaataatggcatgcaatgttggcagcatgtgaaatatatgcaaatcttacatttacattaattgtgattatgctaaactcttccttaataatatcttgaacttttatatggtatatattcttgtggctatagtgtgcatgacaaatttattttattctttttctccaggcacacatactaaaaggactgcttgatgtttgcagcatgtcatattgtgaagaactaccttgcacatattcttactatcaagattccccttatacttggtagtgcacttctctttgtttctctctgtgtaattgggatatgaaataatacatggttgtagttcaatattattctttagttcgttttcaatatttttgaggaacattgcacaatgcaggaatctggggtggaaaaggccaagggaaaacattccagactgaacttatatttagagcaatgggtgttgaacctgttattatgtctgctggagaactagaatctgagaaagcaggtcaaagacacttgaatttgtgcttactgtttacatgctttatgtactctgctatattttgcaaggttgctatcaatgtggtgctccgtagatcatcaaagggtctcacgttcattagtttctcatgtgtgtttctgctattgttgcaggagaacctgggaggcttatacgtgaccgatacaggacggcttctcaagtaattcaaaaccaagtaagcaggtgttttcggctactcagtttcagatatgtaccttcaaattcagttctcagttttgagcacaaaacaaaataatgtctcaatttttaaaacttgagtgttatttcacctgtttgagttttttttttttggtatgtgtggaaagctccagtatctgactagcttcgtaattgacacttgaaatcataaaaaaagattgtcgaaaattctattactactgtcactcagttctgaatatggcaaaaatgctccttacatattttagttttctattaccatcttttcaaacagctgattcaatatttggtgtttcctttttcttttttatacatcaagatagcgcaaatgttcctgaatgacttgatgcttgtccgttatgagaaatacaagtgctctcaactctgtagtgctttactcttctgtgttattactgtattatcatgataaagttaacagattaatgatgcctgtgggttttgttaattttcagtttacttcaatgattcctgttttcacaatttttttcatggtataggggaaaatgagtgttttgatgatcaatgacctagatgctggtgttggaagatttggtaagttttgtaaacatattttgtatggtaattgttgatcacagtgacctaggatattttgtttatgcttcctttttgagagcctgtcaacaatactacaatagtgtattcatctggtgtattaattattttccaaatattcttcagaagaagagcaccttttgtaggaagagatggatcttagagttttatttttcatcgaacatatggtgatttctttttgacagcaaactaagtgctatatatcaccgttgttttcaggtaacacacaaatgacagtaaataatcaaattgtgattggaactttaatgaacttggcggataatccaaccagggttagcattggccagaaatggagagaatctgatgtaacacacagagtgccaataatagttaccggaaatgatttttcgacactgtatgctcccttgattcgtgatgggaggatggaaaagttctattggtatgttcgttcttgcatctgaataaattttgttgcaacaaagtacagactgaattttatttgcaacaactagtcggatttaatttggcaaaaaaacttcaaagaatgatacttgaatgtgatatgtgattaataggcagcctggccgtgaagatataattaacattgttcaccgcatgtatataaaggatggtttgtctttcgaggatgtatcaaaagttgtagacacttttccaaaccaaggtaaccatttctccagaactgtaatttcattttgcagcatatgaaacaaggtctatgtttctttttatacaaacatacttagatgatatgtagggaaaagaaaaatagaagaggaactagaacagtaacatagccatcattccctcaagcaaaatacctattctttttttccttttctcaaacttcattattttccttgttcagttgctggtggaaactagttattattattatttagcatagaaagtatccatttttcaactacatttgaaaagtatattcaagagcgaactcaacccactgcagctctggacttttatggagctttgagatccaggacatacgatcgggcaatcttgcaggtacctgtgttgatttaggacagagttcgcaattctattttccagttcgttttagaaaaaaaattcacctgattttttgtatgtgaaacaatgtcatgtctgttactctgtttagttgttgaagatgtacttttttgcaaatactgttgaagatgtactggtgtgcaccaaacagcgtgtatggagacagcgtgcaccaaacaacttgacaagcagacaatttttttccaaaaagttttaacagttgtatttccgataaatgtaccattagggtagtagttactgtattgtacttcagacatacttttctgtaaactggaaatctcctgggtgcagtgggtagaagagattggtggtcatgaacaactaaatgaaaagcttctcaagcgaaagaaaggagaggagcttccaacatttattcctccaaaggtattcagtttttcaggccacataactggcttgcgttgtactgagatttctttgtcataatcagtttgctaaatgtctttccctaaaaaaaaagtctgctaaatgtcaaaacagcaagctcacatactgattcttcattactctactgaatatcatctaagtagtaattgttgtttctttcattgatatgtataatatcctgatgttattttgttcatcagaccactgtagatgcgttgattgaatctggggactctctggtgaaagagcaagaactgataatgaattcgaaactgtcaaaagaatatatgaagaatttagatgattagttcaaaacaaaaggtctaatagagaaagtactcgaggtgcctatctcaacccgattttgtatatttttgcatctctgaaaactgcacctttctttctctctctctttggtgcccctgcatcctacattctacagaacagttgcatgtgcaagtatacgatagtgtataaaagaacatgaaaaggtatacaagaattttttcggctgtgttttatgtattttagatatctttatataatcgtttgtacaatggtttgcaactctgaactatatataatgaacttcatatattatagtgaacttcagacagtgtttcgctttcagaagttgcccacaatatgtggtttcagatatccacgactggaagaacagatgtcatcgtcgtctagctctcattattgccagaaagttgtctggtactccagtcgacttgatagactttttaggctatggctatggcacaaggatacaaaaatacaaaatggtccatgtattccagtgaaacaaaagtgtccaaatgataagtcttaattactacctccatctcagaatataaaaagttatagagttgaatagggttatcaagaaagtagtaaaattaaatagagcaaggttgtgattggttgagaactgaaggtgctgagaaatttgaatggtggatggttgtaattggttgggaagagaatgttgatgaagaatttgttatatttttagacaaattttaagtgcttaaagagttaaaagtagttatattttgagatggatgaagtatttctctagaaaggatgtacataattactcacgtgatctacttcgtatttacaaaagatgtgcttatatggaacaaagaattcacatgaaaattccatgtccatgctaaggtaggttagagaattcacatgtacgctaaactgaaacccataccaatccttagtgtttgtgtccatcagtggatattttacaagggaaagtaagaaattaaggtaaggcctcctctaaaatgaaggaattttgtcgaaactgaactaatttctatctagaaaaaaccaacttctaggacgaatatgaacaaatgcatatctagattcatccctataagtttaatctttttggaacggatggtgtaagtaatatatagacaactcaaataatatgttgtctatatattatttgatagttaaagatagttatattttaagacgacgccattccttatgtcctatataaaggagtctaatcccatcaattaaatagaaataacaaagaaatggaaaacaaaaaacaaaatccagttttgcaccatgtgtccattcggcgggaggagatgcctgcctgcctgccaaagtgccaatatccttatgaaaaatactataagtacgactaaatttgtccgactttagaacaaccttaacgccgtgagcttgtgacgttaatctccgtataaccaagccatgttgtcaccatactcagtcacgtattgagttgttttaccgtttgatcgtacgctggtcggacataccagtcgtacgtatagtattgttctattcttatcttggaatactaaacactagcaatactcgatttaagattattcacgcgggtattactagcatcgaggggccgcaaccgcaattacaaatgggctgctggcgctgccgccgaggcaacgtggagcgcagccaacgcgattaggtggcatcatctcatatcacatcacatcatatctcatatcccctcgctacataaaagaaaccaaacactcactctctcctgatcttactctgctaccgctattccctccctatctgtctcctctctctctctctctccttgtgactgtcagtagtccgtcgatcgccggcgactagccggccggccgccggcggcgtcgatccatggagtggtggcagagggcggtcgtcgtgccggtcaagcgcgcctgggtcgtcgtcgccgcccggctgcgtcgcaagaaacaatacggtaagttatccattaattctactgaatctttttttcctggttcatgtcttcatgagagaagaatcgaattgtttctgataaaattcgccgtcatgaagcattctgatcttctcctttttcatcgttctgcattaaaacaaaaatcacggtgggatggtaattaccgctgaatgcaatggggagacgaagtctgaatatatttgaaaatgtttttcatcccaaacatgggaaatcgcacctttaataataattaaattagtcaaatctgttcttcgcccaaaaactgaatgcatgtacacgtatggagccgaagcaaatagccaaatacacgtcgttgggggacacgtacgcgtggcggccgtcgtcgtcgtcttctgagcaacatgccaagccacgcaatctgcatcctagtacacaacagtagtgcagtataagatcagatgcatgcgtgcaaaatgtagaaattatctgaaactctgcgtgttatttttcttaattcgagcgagaaaaaaaagagagattgttttcgtgtcacgtggctgcatgtcggttgtcgtacgcctcactgggttccactccacacaaacatcactagtagactactgctgcagtactcatcagcatcactagctaagctatattggttttcgtctgcttcttctgctcgatctccacgtgtggaaattaatcaaagcgtgcctgtttatgcttgtaagatagtactgtcatgataatcttatttgctctgacattaggaatgtagacatacattgattataattactccctccatttaaaaaatataattggcttaacctatgaacctggacatgctcatagccagaaattcatttgttttaaaggacaatgttcatgagattgatcaaatcaataaaggtttctcggttccaaaataaacaaactcagtataaaactaaaacgtgagatgggggagtaggagtaggaggcgaaatggcacatagtgtagttgcacagtgatctgagtagcattttaagatcctgagattaaaatcttcgtaggagtgaatttcagattgagttatttgagagactaaggctgtgttcggaggagggggttgggaacccctcctcgacggcacgcaaaacgaagttcgttttattgcatgattaattaagtattaactatttttttaaaaaaatggattaatatgatttttttaaacaactttcatatagtaagttttttttttgcataaatcacaccatttagcagtttgataaaggtgcacacgaaaaacgagagaggtgggttgggaaaatgagggaagaacacagcctaagttccccatttaaaagactgtaaatattcggttagatgtggagaccgagtaaaaaaatacccttctaaacaaataataaaaaaaggaggttgtcaagcagcggcgcttaaacctggaatttatcaggcaaataaagtaatggacagcaactggcacttcttgacatctagtttgtgatgagatatttcagtgtcgtattatctacctccatgtcataaggaatgcatatatataattaaattacacgtagacatatactatacatatgggttggtacttggtagaggaaccagccaaattaggcagcgagtgagtgacatctgcatgcagtatatactctcaccaaccaaccgcccctgctctgctcactctctcggcaatttggacggacactcatctctgctcatgcttaattgccttctagaagcgtcgacgtggcatgcttatgcacttacatttcgtcctggccatgattaatccaggatacgcatgcccgattagtcataactatctgcagactggctgtgttgtcaccatgtttgtgctcattcaggtacaaaagtgattagctgccattgcatacttgccttctgctcttgctaattgctatatacatatacttcgttataaaaatataagaatttttaatttgtttagtaaaaacttaggttgataaaataaataatttctttcggtcataccattagtggtcaaattttgaattgtttaggttggattttcgtacattaaaattagtattctagaaatatttgtataaaatttgaatcctactatagtttgaaacggagagtgtgatgataccatgatatgttcaggcttctgggtacacacgtgtagggtgtcgaccgccgatctagctagcgacctcttgctatttgacaacagtgctaactgacagtgattgattagctttgatcgactttttaattgtgcaacgtcacccatgcatgcatttgtttagtctagctatcatattgtgctactaccacatgactaggtaaaccgcttacttatttctcatgccgatcgacgaggtacgcgtcgcattgtggacgcatgtatacgatgcgttcatgcagtgtcatcctaatccattacgtcattgacaagcaatgaaattaattaaggacatgcttaattaccttaattagcctctagatagcaccgtattaatgatgagtatgtcaggtgtttgtgtatgcatggagcacgtgcggtatcaattcgctcttggattttcatcagtataaaaataggatttgctttctgcatggatccaattctgcagtcggctaaccacccaatcatacatatagacagcatcacatattcattttttgcaggaaaaaaaaagaaattatagacaagaattatgactggttattagctcatctagattctcaagattcagaattccttcagagcttgtgtgttatcaagttctgcagtttcaacaaattggacttgagaattgacactaagctaccttttctgtaacaatttctaccatggtacatttttttacagctacaaactgtagcaccaatgtactctctccaaattcataaccataaattagtgcttcatttaatttggaacggccgatgaaatgcttatatttttagaatcaggtggaatataatactctctccgtttcaggttataagatgttttaactttagttaaagttaaactgctttaagttttgctttaagtttgatcaattttctagaaaaaaaagtaatattttgacccaagataaatttattataaaaaatatttaattattcatttaataaaactaatttggtaatgtatattactatatttgtctataaacttaatcaaacttagcagtttgactctaatcaaagtcaaaacattttataacctgaaatgaaaaacattttataacctgaaatgtgaatgaagtactacgtaggtagttgaattttgtttgctttgtcagatgggcgcggcgtgctggtgaagctccacgacgacatccagacgtgcgcgtacgaggacgtgcaggtgatgtgggagatcctgcagcgctcggagacggcgaggctggccaccgcgccgccgtcgccggggagcgcccgggcgctcatctggcccggccgcgccgcgccgcctcgccgccgccatcgatgacatggacctgcggcggcggcggcggtgctgagagtgagtgaacatgccattgccgccggccggtcgagcatggccgtctctcagctaaagctccggccagctctctgccattgctaatgcgaatcccctttcttgctgtatagctctagatgcttgcatctttctttacttatgtaaataatatttacagtttcaagagaaagtaccagttttgtattttgctgcagtctttctcttggtttcagaaatcagaactgctatcatcagcctatggggctgtaggcatatcgctctcacactgaaaaaacaaaacaacatattcagttcaggagagggcagtaagcaggctgagaaaacattggagataccttgtaaaaagaaggaaagtaccggataatcaacgatgcatgcaattaaaagatctgcgtagggtatcagagcttgtgtcagccaggtgatctgaatttaggatcaaagaacctgaagtggaggtctaaaactgacatatggtacaatgagcactctgagaagcagctctgcaatcggtgaaatggtagtcatggcggcttctcaatcattttttccattcaaacgaccatatattttgatagtctcgtttcattcatactgttctttccatcagtgtctcagctgccaaccaaatggatgtcagcacaagcataggatagcaaatcaaaatggcattgtagcgtcccagtggctcagtgaatctcgagctgtgctacagagaacaagattttacctatcagagggccagaaataaggttcacaagatgctaaacccaggccgcgtgtatcataacttcaaaggtgacttctaacagttttctggctttctgcttgaaaaaaaaggtgattatgcaactcaacagattatatttaaggatactcaaacgaaactatgttcacaagtaatcagcagaagaaagtacaccagagcaaaaccaaatacaggtatgaattgtccgatccttgagagcaagaagttttgcatgcacccaataatctgcagcaaatatgcacattcttatacatcatattagcacgccatagaagaagttttgcattcacaggcattaagcattaacggaatccagtctaatttcccccaccttatgatgaaaaaaatatcactccaatcaacaaggcaaacagctaaaaaaattaatgacattatgcagaccaacattagggaaaaggaacaactaaaaatggagagacagttcaggcttaccatctacagcttcttgactaatccctccgttccatctggtactaggttcttatattttgggacggagggagtaggtctccttcaaagcaacattagatagaacggaagaggaaattcagacacagcatacttgcaggttgcaacatgtagctgtcattgtcaaaatgcttcctgagatatttctacaaattgcctacacatacagatctgaaagacattcttctccccattcagaatgaatgtggaacaagaaattttagattaaaaaaacaaatatatcataattttcatcaggaacccattcgtttaaggtgataaagtgaggatcacaatgatagtgcacagcttggccataaacatatctacgttttcatatctggagtgaagatggaaacatctacccactcccaagcagacaaacacatcaagggagaggagaggtcttagagatctaacatataactttcaaaaacacagttacaaaagaatttaaataaaattaacgttcaacatccctgaaattagtactgaagatacctagaaaattttggaatcaataatgtacatcctgacctagaaacttacagaacattttcctataagttacaggacagctcttgcattttgctgtcttctgtccccttatgccagatgttacatagaagttgggacttttggatgaacagtctccatctcaggagagctaatgaggtctaagcaacgtcaacggaagatattcttctttatgagggcatttatcaggagaaaagaattggctttctttcgctgcaaatctgacagcagaattctgccttatccccaaatgcgcatcttctgttgcttgactgcagtataatcgcttcagctcaaatgtacattagatgggcaccaaaaacacattggtacaaaaaatctatttgaaatagcactttccatctgtcagtcatgttcttctggtgaacataagcatatcttttaaaggaggactggccagtcctccccgagctgttgaggatttagctgcatagctaccttgaaatcatcaagggagatcaagtggtgatttctgatatcattcgttgctccggatggtccactgcctgattgcatctgaacatgatttggcaaccaaacaccattcatatgttttccatatgcatgctgcttgtacaattccccttttcttgcatcactttgaacattagctcctattaactcaactgatgacctaatcaggttcttcaagtacttgtccaaaccgttattcagaaggtcagcacaatccaatgtgacaccagctaggcccagtgactctgctgttttctccatccgccgatgcaatgcctctgtatttaacaattcacgatgctcacaacagctggtacagtgatcctcacctgcactaattagtggtggtggtaatttccttgccccgcccacactcgctgaacaaaaaggaattccaagtggtgcccgtacagggctattcgatgcttctgcagaatgatccgagacattgctcatgcttcttctcaacttgattatgtttccagttggtgactgctccacacgttggtgctttgccaatggctctgcagattcatgttgaaaatgcactgatctcttgaggtcagaagaacttagggtgccattctctggtactgccgcaccaccgtgagtaatctggctgtgattggcagaagcatctaccctacaactcaggcccgtgcttttcatccgatcttttgactgatgatcttgcattgtgctcatatgccttgacccctgcatctgtaataacctgatgtccccattgcaagaattcaatgcttcgccgggctgacaaaccttcttcactgttgctcccacagacctcccaacatctggtgctggtgttggaggtggacacttcgcatggtaggcgttgtagagaactgagcgtatcagctgattatgcactcggaggttctctctccccaatgtttggaggcacaccttgtcgaaatccgccttgctgagcctattcgacaggtagcccttcaagtagctgaagtacctccttgacctgtcaggaccaagcctcttctccagctgaagcttcacctcgcggagatcgatacggccattctgctgctgcgcctgcggctgcggtggaggagctgatggctgctgctgctgctgctgcggtgcagcgagcggccacgcctcctccctcaccatgtccataaaatcaccaccccggcgaaccccaatatcggattcagagcacagaaaccacgaatcggtgacagcgcgccgcaccaacccagctcggatcaaaccactatggcctccgtcgcctcctgcagagcgcgagcccgtagcccaattcccagctcgccagccatggaggcgatctcatctccgccggaaccacaccaatcgccgcggaagcaaccacccgccccgggagcggtgcggctggcccgaatcaagcatccagggcggcgagtcgtcgggcgggagccaaattggattacccacccaaaccctagcgcaatgggggcatgatcccgaccccggcgagctccgccccgggcccgcgccgcctggatctccggcgaggagggcgaccaaccgcctcccactccacgaccgaatcgaatccgagaaaaacagcaagaattggagctgacctcgccgaggggggcagcaattgggattggcggaatcggattggaggacgccgccgccgccgcgaggaattccgcttctgctgctgctgctgctcccccgcgcgcgccggagtgcgcggattgctgctgctgctgctggtgggggaggtgggagatgggttcttgcttccgtttggtttgcttctctcttctcttcgtgttcgtcttggcttgggctggctggctgtctctcgcttcgtgtttttttttttttggtttggagtttttttttttttggttgggagggttttttttttgggccgttgaattggatttgatcgcggaggcgacccgagagggcgggagggggggggggggggtgcaccgcagcgaagaggggagagccttttggctcccggcctgtctctcctcctctttgcggtatgttgtgtgccagtgtgcgtgtattggtcagtgattagttgctgatctgcttctgcttgtgattattcaatttcgttgtttttgactttttttcaaagttaaaccacttaagtttgtagaaaaaacagtaaaattttcaacggaagataaatgtattatgaaaatatattcaattattaatttaatgaaactaatttgatattgtaaatattactatatttgtctacaaacttagaatagtttgaccttgaccaaagtcaaaccgacttataatctgaaacggagggagtactcatttaaaatatactccctccggtttcataattcttgatgttttggacaaggttaaggtcaaatttttgtaactttgattatcaataactttaaaagtatttagtttaaaaaaactagaacaatatatatagatttgtctttcaaagtattatgagaaaagtaagcatgcatttatttattgtgtatattataatagaaaaataaagtcaaacatatattttggagaccgtatcattgtccaaaacgttaagaattatggaaccgatgagagtaactatttttacaattaatattttatacaaaatataagtattatatgatgcattggatttaatgcacagtagtccaaacatttttagccctagggggagagtaagcaattcaaaattttaccattgtgatgattaaaagagaatattctctcttatatttatttttttatccaacaacatagaaatatatttataggagtgtttaggaacgaagggaatacttgtcacttcaaatacttgtaaccagtaatcaagttgtttcaactttcatcactgataatttttaaatggtcaaattaagatggacgaaagcttaatgtttatatttaaaatgcaacataatttgatataatgcaccttttctaaagtatttatatattgtttgaataaaaatgataaacaatcaaaattcaaatataaataatggttggaacaattatttaggaagtgaggggtatatcttatgcgcaatgcagtataagccgatacaagttttgatgcacttgctgtagctataccaccgaacacacccgggtatataactatatgatcatttctgattctgaatgggagcatgaactgcaccggatagaatttacatttcagaacagtaaaattgtttggagtatatgtacatgcggtacatgtatgttatggtaaacgtaattttattgtttgactaactgtatatcttttaatcaaagttgtaaaaggagatacagtattatctaggagtaagtacgactcacgtactaatgtactgctgtactccatcgcgtttatttaaaaggagtctaaataagtccatcgcgtttaaaagaagtctaaataagtccatcgcgtttaaaaggagatacagtattatttaaaagaagtctaaataagcccatcgcgtttcctcttaaggttaaaggttagaaattgatctgttaaacggaattttgtatcacaagtcatggtggatccggataacaacatatcatacaactccatattgaagttaacattattctcaaccaggcaaattttggctattaatgtttatgaaaatggaacaagcacgagaaagaaaagagataatcacataattagtctaaccataatttaatttggttcgacagaaatttgtggcaattcattttacaaccgcgttttcatatcaacttggaaaattaatcaaaacacggcgatctggagctaactctaaatagctgacgttgataatgtccagcttcgctaaacaccagatacttcattttctcctactgcaataacagctaccctgaagcatcaaggtgacttcacacttctgcatccatctccatcaagaaaaaggtgttcaaaccaaagtacaagcacaggtaaattatggatccaaacaagtcctggttttaaccaagctcagaatgtttatacctcatatgcacgttcgtaggacaggtgactacgttttgtaggtgtactattttacttgatattagaatggaaaaggtgccgatcaaaaaagagatacagtattgatttttattttacaacccaatgagatgtttctcacttcaaacatgcatatacagggtattaataccgacccgtccccttacgttatgtagatatcaaaacgtaaatcaattttgaaattcctcagttcagatatgcatgccaaaaaacaacaaagatttgaatagaatggaataaacgttttgacactccttgttgccaatgtcccttatgcatatgatataatagtctacctacaacaaaagaacatgccaaggtcagtacaaagcaagtaaacaaaattttagcgaaatgtgcggtgaaaaaatacatgtacatgcccaaaaggccaaaagtgcagagtttacagcatcacttcattcacaactgcaagcaaataaaacaataatgcgcactatttggcatccccagatagtatgcagatgccattttaagttagcctcgagtctcccctaggccctaacccctgattttgataccctgaaggggaaaagactgaagggtaggtaacccatgaacatgcaccattccttgctgtttgagattggtgcaaaatgccccccatatatctctagattgcagatttaactccaataggagacacttgatgatagcgcaacagctttcttcactgttagcatttccaaatattctctgtctccttcaaacattacaaacgctaaaatttcaaaaatttgcaggtactggactaccaattatgcatgaaaatcacattaaaaggaaaaagtcaggcatggttttaaatttccgaatctcaaagcacactctacagtacagatagagagagtacccaccagctcaagcacaagagctttttccttgttaatataacctcctcacaaaaaaaactggtctgcttgccgtcaaattctgggtgtttatgtatatgctactgaccacagaccactccaaagccggacacttgaactggtctagatatcacaattacaatgcatactctggcaatctggcacgtcacctaagaatttctataaataatggcaggcttccacaagaaaacagtacggagatgattagattaaaaaaaggattctcgtcaatataatatgggctatgcatggtacatgcctattttctatgtaaactatgttgaaaactttatgcaggaccatcatacgtcttctagtctgcatgcaatactatgtagacattttttacataggaccatactactagaagaatgccgcttacttgcctgcacagaaatttactaatctatgttcacaactcaaagacaggaccaagtctgatactttagtagaaatgttacctggacaaatatccactaaggactagctgattgagtcctccgggacacttgaatcctgaagaacacgatcaggatccagctgaccactgtaatagctagatgggacagcagacagttccaactttccagtccactcctcaccaggcttcaaagtaatcggcttttctatagcagctgcctccacacagaccatgcgtttatattcgtcatccccaaagtctgacatagccttagccttcttgtcccaagggttccaaacaactacaaccaggaaataaccaacacaatccatttttttttcatttattataacaaagatagtttattatggttgtaacttgtaagcaaataaagaccatcattgactgtaccagcatcaggaaggccacctttcctcacaacaaatgttcttttcttctcatgatcaataatggcaatttttgacggtgtgcccagatatattctgtccaactgtacaataagtttgcatttgcttccttagttagaatgcaaagaaaaatgaaggatagtgtaaggttcaaatgttttgttaacgcacttcagattcaaaaacaattgcatccccttgttcagtgtatcgatttctctcttgtaagttgtctaggtaatccagagtttccaggccttctactcgcacctcgctgaaatattagcataaagttatgcacaatgaagaaattgtttctgtatgtctatggaaatacatttgaaatggaaaaggaattcttcattgtggataaacatacagaaacattttccattaattaagcccacattttagacaaacatattaggtggataataaacatgatcacttccaatactgcactgtgcctttgaaatgaatttttcagaactgatgggctttgtcgagagttaaacaagtgtacctgatatcagatattgaaaagtatgtgtgatatgcaaatgtaaatgagaatggctttccatctgcattggtatttcttatacgtgaagtcagcatcagatctccaccaggtccaagtgcaactctcagacggaactcgtaactgaaataaaggatttgcttttactgatccatgtgaacagctaccttgtcttctactaaaacaattatatgataagaaatagagggaaaaaaactttcaattatcttacaatggtaattaatttactattaacatgtaattatttagtatatgcccacctatgtggccagatctttagatcttcttcagtatgcgtaaggattaaatcgacgtaagctttattagaagttggtactggaaatggtggtggatcattttcaacactccaggtcctgttccttgcaaagccatgtgggtccagatttccgaagttggaaaactagaatacgaagtactgagcaaaattaaaatttgagaaagcggaagagattacgagcaaaaaaaaaatgcaggaaaggaaaagcacggacctgaggaaaagcagatggtatccctncacgtatagcttnttgaggtttgaaaatagcctgagagaacacaggcatcagccaagcaactcttaggcaattaaagaaatacatggnataaaaaaatccagtaagattcataatcaaattttattgccatgtcgaggtcaaatgagtagcagggatgttgtaatacaatctttgtcacatcattaccacaaaaacatagggtggacgataacaaagaggtacatggtttatgagaataggtatgcatgtctggatgataatgaaattaagggtaaggatcatattctaccagttgaattagcctagtatcagtctctcagacaggcttatggtacagccaaaacaatgatggaagaattttagaggcactgagatgtgcccaattgcccatactaaagataggaaataatatcaccttattactaacaaaaagcagctcctctccatgctcatctttccatgatgtgacatggccgccatacaggtacacctgaaagcagcaagagtagaaatactaaataaccatatgtttggactttggaacaggatacatacaagaaaaaagaaataagtcctatgtagccaggacagaagcaaagaactagatatatataaagagatgagtcacaaaaatgcacatgtggagttctaatgagcttattatgctgattagcttttggggcatgtccttctgatgcccatccactaactatgtttctgataatcaataactattcagaatgatataatttctagtaattcatattcttgatacccaaataaaataaatatgttcagtggggatatctcctattgttcccataaaaaaatcgatagatagatgtattacaatatctttgaccaatagatagatgtactatagtatcttcattttaaactcaagaatgaatagtttagcttactgttattttgtcaaaatcaatgtggaagtcttggcattgagcttccaatagtcagaccttatgcaatagcactatagcatatatgcccatgatttacttagctccatatgccttcttggtatacatctgattcaacaaacaacatgggcttcttgttatacatctaattcgccaaaaaacatggggctggcctagttaatgtcaacaagcgaacatccaacatccaaattgtaggtgaagcaagttttaggatgagttctggaaagtctaagtgggataataggtatcggatgaatataggaggatatttcctcagtaaggccgactagttgagtcacaagaagaccaggaccagtagcaaacatgaccagttagacaccggcgtatcgtttctccatcaactcaaaccatcctctggcgttctcacctctcttctaccagtgttgatccatgagcttctatccgtattggactgaaaataataccatggcaacagcacaaatggtggccctgctactcatcatcagagatagcataaagcaaagtatgcaactggaggaaaaatgaaagaggctcctcaagtgacgtgatgaatggtagcatgggctccatcccaccagtttggcctgataacatccataatttctatggaatttgcgtcaaaaattatttctatggaatacggataatacgattttggaatcttgtactaagcgtacaccaaacaacatagtagctagatatttgacccacaaatccagaagctacaataaaacgcccatgatatccataacatcagccaaagaaacaactcgcttgccaaaatcgctatgctaagatcgagcaggctgtgtcactatcatttttatatacctcctcaggtaaaattccatcatttattgtctcctaaaaggccaagtgcatgaggtcccacaatccactcttcagactctttagtctttagcagctgagataatcatgaaaaaacctatctttcttgggtctaccattttaggccaaaagagcactctcaggctgtaaccaatatgaggcatccgcgtacccaacaacaagaagtgttgattataaagggtcactagcaagagtatgaagattttcttatgttgctttttaagttgactaaaaaaaacattttattgcaactgaagtgtataccccctccctgctaacctggattttcctcagaccccagatatgagtaaattacccctctataaagagaatgttcaccaccctcatgtgttcaggggttatagaagcaccattgtacactgtattgagccatttttataatcctatttgttactcccaccatttagtttataagaaacgcacataattcattgtatctgttgatcaacgggtagttgaaatatttatatgtctatggataagacagtggtaccaacagnatcatcatgttctaaagtacttccacgtttcgcacaatcaaatatgttgcaggggaaactagaggtccaaggtcaagttttgacaattgcgccnttacaaannaaaataaatanatggatgatgtatttccaaccacaactcgtcaatggaggcaaagtgagaaggcaaatactctccactctgaatgcaagagacccagactgatttcagaacaccgatctgtcgcctacaacgagtcgaaccacaagcttcccggcaatcaaaccactcctatctctcacccaaaaaaaaaaaaaaaacactgcaagagtagtacttgagcatggtaagcgatgggaacagcagttgagcaactacaagcagcgccatggatctgcggcgagatctgacagctgaatcgagagagtggagggggcagtactagtcttacctcggcagagctgcctcggacctcccggaggacgaccttgtcgagcccgttcacgcccttgcaggtcaccaccggccccttctgctgcggctgcgcggcggcggcggcgccctcctcgcctgcccctccggccgccgacgccgacgccgccgacgacatccccgcctgagcagtggaggtggagatggagatctctcctggggaatttcgcgtcactgctcgctctggggacttaaataattattctcgagatgccttttcctgatcgcgattttttcccctcctcctcccaaactccacaattaaaaaacaaaaaacgcaagctttagtctcaaaaacgcaagctttactttctcctagaaacgcatgcttgcgacgcggggaattagcgttgctttaaccgaagcaaaaaaaatattcctcatcgagaagcagcagcagcagcgtgtgaggtgtgagtgagcgagtgagagtttatacgtgtctcgctcgaagaatttggcgagatttggaggaaaaggatttgattgggttttgctttgctgttgcgttctgatgcgctaaccgctaaaggcgataaaaaaccttggcgtttcttcgacgcattttgtcggtgtacaagcctttttggtggtttccatgctgtacaatcgcaacctgctggtttcccatgtagcatatgctgtgaacatcagggatacacccccactgatcgcttgttgtatatgcagaattaacctgtattcagataaagaaatgtcttgcaaagtaattaactgatttcagataaggtgccggttgcctgaatttggctttggtgttggaaggacataaaggaaagccgaatggtacgtttgatttggattattgaacggactattaaagcggattatcgatttgatttagaaattttaagaaataaacatgatgaatagtttaaagtggtccaagtaatacagtagaaaatgttttttagaatgtatttttttcaagcatgaaattaatagttaaataatatgatgaacaagtaaaaaaaagtatcatatgcacataaatctttttgtgtgcacaccacctaacaaatttcactaaaaattctagaaaaaatatatatctataattttagtagtattacatatatgtataaagtttcatcttcaaaatcattatatttagtgagtaaaaaaaacaaaattcagatacatttatactcttaaaattgtcagaattatcatctttttattaacgttaaaatataataaatttgaggctaagtatttacacataggtgtagtactggaagtacataaataattgttttaaatttttgataaaatttattagttgatgtgtctgatgtgtacccgagaaagattctgtgagtaggattacaaataaagcatatatagctcttttccccctgtcttgtaaattagttatgtaagacgatttagcacactagctttgaccagcaagctgtgtgcagtcataggatcatcgattgttccaacatcggatgataataacagcgtgttacttccagtaatctatatactccatctggctaattaagacagatagatgggttttgatccagtgatgttagcggtgactgacgcgggcgcgccacgccgccgtcaggtgaccgatcgatcgattgctcgtacgtcgccgtcgtcatgatgcgccatgggtcaatcactgcctgccatcatggtggacggccggcgccggcgacggcgacccgtagatctcgattgaccgattagccggacaattagtgcagtattcagatccataagcccatttagaattttcgcttatatttatacttatcagccaaaatttaaatttaaatttttaattttaaaataattttaatgttttttcatcataatttatttttcagcaaattttatttttcgtttgcgatacgccgtttgtcttattcctcgaataagccagataatggggctgtttgtagggggatgaacagtatttcgggcattggttccagcttaaagtgattatctaattactgcaattccttgtgcaatctgactgctgctcccggtatatggcagacgattattgcacggataacgctgaagttttttttttaagcaaaggataaagctgaagtagtcgagtgggctgttggcctagggccaatgggcatctggtcaggccaccagaagatgggaattgggccgatcctgaaacataatgggcctaggaggccataattactttttgggccacttaaatctcatcgtttggcccattcggacttcggagtgtactccgctgccgtgggcgggccgcagggaagcactgtgaacctgtttgtttgggagaaaagtccggagatggtgagaagtcgttgatgagcattccgctggtgaacgccaaaagctaagaaattccgattccaagctgctagttcaggttttttggattttgtagctagaaattcttaaaatatgaacggaaatctgattgagttcctccatgagatttatttggaattgtattttcaggtcaaaccaaagtcgcaacaaagttatcgatccagggcagctattttctgcaactttgaacttgccaaatttcaatacaaaaacggatgagatggaagaccagtactgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14308 - DNA, 607 bp, Oryza sativa
ctgaatcgggctctttttttctttttaccaggccgcctgttcagcccatgcttgtacacattcagggatgtatcagcaggcacctcagcttgacctcaaaagaaagaaattttggttcttttgattttttttattggcattaacaaatatcgctataatgttagacagatatattactagtttataaaatacatgaagtaagtcggaaactaaacatctctccttcaaagagggtgtgagagggatcaagagtatcctaattatcgcaattaggaatggatccaattctgttgagtctgactcattgtggtcatttctcttttaacaaaccttagttataaaaggattgaacttggatccatttatggatccaattctatttagtctgactcattgtggtcatttctctttaacgaaccttggttataaaaggcttgaacaatcgggatccaattacttattacttatgatacctagttgatattaatagctcgagatttacgtcttggtcaagcgtgtgtgtgtgtgtgtgtgtgtgtgtgtgtgtatatatatatatatatatatatatatatatatatatatatatacacacacacacacacac

SEQ ID NO: 14309 - DNA, 13839 bp, Oryza sativa
ctcccccctccctcccagatctggccagaggagggtggggggaggtcggcggctcccggcgcgggccggcgattttttttggttcgtttcttctattttcgcaggtgggccgttgccccgactgcgaagatggatgattttcgcagtcgttgtggtgcaggcggacctctctcccgcctgcaaaaatgctttttctagtagtctgacccaaaagaaaaggtactgcaaaaatggtggagaccgtctcatggtcatagggtgctcaatcgggggaagtattagtgcaatcatgataagttgctgtaaaatcaaagttcgtttgtttattattttgtgatgaacaattggcatataagattattggttttgatatttttggagattatcggcgaagtggttttggagatgattagttttagattgtgaacatgatcaattctgtcagattggaccgagaaggacaagttggcagtgataagttcaaacttttcaagataatggaaacgttttaaatccttgaaaagtgcaattatatctatgaaattagatagacacacaaacacgatttataacagatattatattcacacaaatgttctacatgtgtcgccccgtgctttttaatatggcaaaaacatacttcagtaaaaatcgcatgagttgtgactgttttactcccctaaaacaatgaaggatttttactgcagttgttgtgcagtttttatttgggcataaaattagctacccacactctagaacttagataataaatagcatatatatagcaggttggtagatgattagtatctgattagagaattatggatagtgggtgctattgcaggtgctaagttctaatagtggtttttagaaaaaacaaccacaaatttagattgtacattaatactaatataaagtttcacgtaaaatctagaatttagactgcatacttatttactccttcattttataatataaaataattatgaaataacagataaatatataagataaataagacaccatacgtgaagaacattgttttagcattccagcggtccaataaagtcaacagcatactgctacaaagaaaccagattacttctgacagccacaaaccgtcgggaaaatctattatcacgtcaggaaaatatatcctgacatgttaccgtcagggaaatcccgtcgggattggcttgtcagcgaaattttaatttacctgacggatcctcgtcaggataattaatcctgacgtgggtggccatcacaactaatttttctgacgttatgtgtgccatcaagaaaataaaaataatgatgacgtggattcaacccatcagccatatcatggttttgttttgacagttacaccacgtcagaaaattaaagctggaggtccagcggctacacccccagcaatgctcatgatacaaagcacgcacataaatgctccaaacgtcaggatcaatatttcataagaacacaagtatcaatggtcatacatgtatcaagtgttaatatttcattatatcattgatatgcaaataccaagctcaggtttagtattacaatataacacaagtttagtattacaacataatgcacaaaccatcaacatctagaatttacttgacactaagactacaagtttctagagatgctccggccattgcttatttaccacttgagattatcatgcatcctttaattcttttcggagatgggtaataacaccagcactgctccttgagacacaacaatgcaaccttgctgcctatctacaagtccgatttcattatacattttttgaattgaacaatgtctatcaaaacaagggatgcaagaaagtacatagattcaaagcatggagacaaattggcatccatcggttcagtaatatctagaaaaattaccgacagaacataaaagcagctatttcaacctcagcagcccaaattgacatgataatttcaatagaatttaggcatatgaattattatcaattcattcattataaagacctttgccataagtcaaaccactctacatcaactcaaaacttgcctcagtgtttaaaatcaagattaaaaatgtcagttgttattttagataaatgcctatgatgtctgttgtactaatacccactaatcaagttatggagagaaaggtggctgctaatatcctaggtaagaataaacagaagagcacaagttgtactacaattagcaccgcataaccaagttccacaaaagaaatagatagtcttaatgcaaatgatccaaaataatattcattgatttgttagtgatatgccctagaggcaatcatagagatgattgtatcacatactatgtttacatatttatccgacattgttccttgaattagataactccttattggttaatgaatatgtgattctttcattaaactctttatgttgtttgttactatttctaaaggattcctgatcaaatatcatatgtggaacaaatatgtttatatgatcagcacatgtattaattgatgatcatgtctcatggatcatggtatagagataccaaattaataatgtggacacatgttggtgaacatgttgttggatagacccaacatgagacactacaaaagccatatgtgttgtgtcatcagtgatctcatttagtgttggtgttgaatccttagacctgagattatcatggttctcaacatgtgtagcatcttacttagggactgctaaacgctactccgtaaatgggtagctataaaagtagttttcgggtatgctatgaaacatgtagtggaatatgaataatcaagatgggattttaccctcctatggaaagatatctctgggcccctcgatgtcgcagattatggatgtgcatggcccatgccgaaggtgattgaggagtcaatcacaagttatataatctatcaacaggttcgagtgaatgattgagctattaaaggatggcacatatctagccttgagcttaatcgatatcgtgaggcaaaggggttcatacaagtatacactagaggttcagccgatatgatctttatgtatacccggtgggtcaatacgttctgctaggagccgctgttgacgcgtggaccgaaaaggaattttcgggttacagccgagtatgtatgaacctacagggtcgcacgcttaatgggccggaataaggggattggatagagatccaatatgagcttaattcggatagggatccgaataggagtcctacgggccttggaggcccgagtgatagatcctatatattcgtgaggggtgtgaccggcgaaggcaattgcatcacgtgagaaaccctagccgtcacctccctccccgagcaaaaccctagccgcgcccgggtgctagcatatctgcgcgtggcgttccgtccctgtacgtgttgataccggtagaggcgccgctggtttgcggtgctgatcggcttggtagtacggcgaggagaattcacgatgaggtgaaggtcgagccggtgcgatcgactacttcctctacatcgacgcgcgctacttcgctagagttccttcgacttctcagcatctttttctgctgcgcagcgtgtcgagtggtaacgatttatgatctaatacttgcatggttcctggtttacgcgatagaaaattttgatttatgctattgtagcctacgcgtatcccaacatgattatgatcattcatgatttaatttaatcaagtctgagtacatatttctattacccaacttaagttgtggtaaccattcttatcactatagaatcaatatgggcaactgcactaagaaaacaacaagacacattggtatatcatcaaacatgcgtaacagctaccattgtattgcttgtaacacaatagtggacagtaaaatcatcgacaattcagcttacgaaagattttctctggaaggacaggaagaggtggacaccaaaaagcctgcgatactgtggagattaatcctgcacaatcatgtaaaggtgtaactgacactaaaagtgcagcaattttcaaccataaaaattgtgaaatcattgtctgcagctgcaaataaattgagccctctgagaattttctggaaaaacctaagtttagaaaatttgctgaaactagcctttgaatggtagaagagaacgggcattggttttctttacaaatcgcgtgaaaatatgataagcttcagatgtattcaaatctgccatcataattctctggagaagatattagccaccattttcattttatatatctaaaaggcatagagaggaaaatatagccagagcaaataaagctacttcacatctcaggaagagacaaatcttctacagtcctatagcaaagcaactaattaaattaggcaaatagcagagtatacaaacaaaggcctaataaaagtactgaaaaattagcccatttggaagcaatcacatatattgactttgctgcaactatatgaacaaaagataagctgctgatagaacgtcaaacaaatcaccactagattattttcaacacaatctgctacagaacaacaaaaaataaaaatgggggcgctaggagtagtaagtttacctcatattagtattccctagccttttacccatccttattagcgtcatgcctatgcatctcctgttctcgaaaagcatccactggaaggaatataataacaaaacaaagtcaagctagggagggtatagcaagaaataacaaaggggtttattcacagctcacattagaactttgctgttgtagatctaacagttaaatttaccaacagatctagggtgcatcaacagatcaacttgcactgaaaaaagaaaaaacaagaacatagaactcaccagattcaaagaaaaatgacagtaaaagagagtaacttaccccaggtagttcttggttttgatggagtagattcagcctcgaacaggaaaaggccgcaggagatgctcgagcttggcagagactgcaacttcagatctgaacggagagggagacatgaagtccaccgttggaacgggattcagattaggtgacacagtgtatgcatgtcacaaagtgacatatagtcgatctcagccctctaaaacaaatccaatgactccattgcttgggcccgcctgcatgtccaaaataatccccaatccatccattcccgtgggagacggcgccccaatccatttcgcgcgcttcgcatcgccctcgttcggctgccgccatgagccaactgggaggtgcaccgttgccatgaccggagaggcgccaggccaccgggctcgccgcgagtggggaggggaccgggcgaccgccgcgcgaggcacctgagctcgcctcgcccgcgtccggccattgccgcgagccagctaggaggctcgtcgccgccatgaccggagaggcgccaggctgctgggctcctcgcgagtggggaggggaccaagtgaccacgcccaaggtcgaggctggggccctgtcgtgccaccacgggcggaggcgcgtggaggcggccggccgctaggcctgacgtgtgcttcaacaatacgatatcattagtgattttacccagcttgtgacaccaccaagttgtgatgatgatattctctgtgatcaagatctgtactaatctttgcaagatggttacatggcttttggacaggatggttaggtagcttttgtacatgatggtttgattgcttttggacaggaatgattaaatgccttttcgacaggactaactatagtattttgtggtctctgtttagtattttggacagggccgacggtaatattttgtggccaaattgtacaagtgaacatggcctacccttagaatagttgttctgtatgctccaaataattgtttaaatgacatgtatgatccaaaacttatctcacaacattaccaacttctatatggttgttttcaagtttttgtgttttttgaatgctccaagtttaaagtttctacatattgcaattattttcatctctccatccatcaattatggggatatatatgctgtcaaattttttagaaaataatatcacataaactctgcatgcttcttccaagacaaagatcatggccaaacatatattagctcatgtgcagttgatgtacaacgtaaatactcatgtttgattgggagattaaggtgaaatcataagcaaagagaaatatgcgggtaaatgaagctttataacttctgcaagtccaggaataggatggcatgatgacatgatgtaacacatgaactgaaacactttgagatcagaaaacacaagagttcagttgtagtttcaggtttaacaagagaacataagcaatgtatgcgtttccatctgaatggaatgcaatgctacagaagttaaatagtactagtacaaaatctgatttgtctaggactgactacatggcatcagctaatgtactcttttgagggtacattattgctaacagaactgatcaaaacaacggtggaatcctcttgagacagcaccatgtccatttcattctgtagaactaattaacaggaagattgcaagtatgtatacatctcaatgtgctccgccaaagccaggatcttgagatgcttctttttcctgagttcgtagggaacaggacgacttcaggcaggggggccgcccgcctccaccagcgcgctgtaaggcctggcgaccggccgactccatgggaccctggtcgtggtggcagggcagggcggcctggcggctctccggccgtggcggcacagcagggccccggccccggcctcgcgaagcggtcgcccggtcccctccccattcgcggcgagcccggtagcctagcgcctctccggtcacggcggcggcaagcctcccagctggctcgcggcgacggccggatgcgggcaaggcgagtgcggtcgcctcgcgcagcggtcgcctggtccctttcccacttgcggtgagcccagcggcttggcgcctctccggtcacggcggcaacgcacctcccagctggctcgcggcagtggctgaacaaggacggtgcgaagcgcgcgggatggattgggagcgccgtctccctctgggatggatggattggggattattttggacctacagatagggcccaagcaaccaagtcgttggattagttttggagggctgagatccaccctatgccaccttgtgacatgcctttactatgtcacccagtctaaatctgttggaacgggtgccctagttggtgggggagcaggaggatgccggaggtagtgttggaggatagctggagcctgaagattgcaggggagagcacttatgtgctgtgtggtatgggatattttaccctatgttatttgctttggccattcccagtgtcctgactggtgaaagcacgtcaaagaaacttgttgcccgcgtgttcggtgaaatttttggcgcggcagcaaaactattggtgcggtcacattttttttggcacgattttaattcaacatgctagaatcctcgcgggaatccaaattttttcaattgacggcaaataacgtcagcaaaattggtgttgtcgtcacggtgcaaagagcacgtcaggaaaattcaattcttatgacagctatacacgcacgtcacaaaagttcttgtacttctgatagttcaatatatacacgttaggaaaattttaggccgtcagggcttgttgagtttcgggtagtaagcggtcgcaaagtgctattgtgtccgctatcttaggtccgctagcttgtagtggtagcggtagacattcgctactgctatgaacactgtttattgccttggtctaagtataacttggtgctttactttttcttaaatttctgtaggccaaacacaaagaaagatagatcatcaggacaggaactattagctcagtatgaaccagactgtagctagtagatcaaccattaattgcaactcatttgatttcccccctcacagaaaactcattttggtacattttaacgggaaatttaactatttgccatttttacgtttgacaattaaccaaatgcccttcttagatttgcagttaagaatttgccactggagagagaagcttttgtaattttttgccactttaatttctgcactgtgcagcgccacatatacatgccagcatggagcaggcacgcgaaatgactaatctacccctgttagcaattggctgtaatataagctgaatcaggaataatatttggacaaaattgctttcgcaaaatcagttgcataggtatggatgctgttcacttttatgaggttactgtatgaaagaccgagtacatccacatcagataacaaatcaatatttgaaggaatagatccgctgagatggttataaaaaattttaaaaacgatacttaggctaagttcttttgttcactttcacaactaatctctctcgttttttatgtgtacgttttttaaaccactggtggagaaaccgtttgtagtcccggttggtaacacctatttagtcccggttgtccaaccgggactatgaatccgggactaaagatagctatctttagtcccgggtgaaataatcgggactaaagatcgatctttagtctcggttcgtgttaccaaccgggactaaagaacacgaactgggactaaagatcgatcagccacgtggccgatcaaaccatctttagtcccggtttatgttaccaaccgggactaaagatcggtgcaccatttttttttgcatggccctgtttgctgcatggttgattatatatatatatatatatgttacaatacatatatatgcataatatataggcatatatatatatgtgtgtgtatgtataaatcatatattatatacacacacatatatataatttaaagcacttaacattttatgtgcatatatatatgttaccaaaatatatattaacacaaaagtaaatgtgtacatatataaatatatatatatatatacatgcatatatagtacaattcatttgctcggtagccgctatagctacgacttcgacttcgacgccggcgttatgtcagaagaggaaggaccgacgttatgaattgtcgaacagtcgtagtagaattcaccgtcgagattaaggacttcttcgttgatgaatcccatcagttgttcttgaacagctatgataaaatccttttgtgggagattatccctcatgtgaatacgctatcattcgaaaaataatgacgtatcaatatatgaaattaataaacaaattaacaaatcgatacgcaatgaacttttgaatggtttatgtatacgtacatcgagctctcgtgttgtgcatatttggtttgataggcagtgggcatactcgcatacgtagtagccgcataagttagttctctggtcctgctatgcacactacatgagaaacgatgagagatttaatatactctttatattaactgtaattagagattcaattcaatataattttggatcatgcatgtactcactggaaaatgaaacctccgttcaagtttttctttccaagtcctgcggaccaattgatggaaccgatcccaagccctacatatgcagttgcaagctatgattaattaaatattacctgagatcaacataatagcaatagattccccacgactttggaatagatggcattatattacctgtctatcagtttgaagaccttgtcaaaaatcttctcctctttattcattgagtcgtacacagtgactctgcatgcatccaagtcgaagaataacaggaccaagtggaatctggaatatgcgcgcgcgtgagatgagatatatatgatcgaaaatgcacatgctatatgtatgggaatgaaatttgttcgaacgacaataaaaactcactctgtgttgtacggcagtagtatgtatgtcttgaaatgctgctgcgttaggagatggacgagattgtcctctgtgtctttctcgtacttgtcgaccatttcggtgttgattctctgagggtcgatgaacccagtgtcgtagaccctccgccgtcgggccctttgaatctccattctacaacgatgaaaggaaaatattattgcttacatatatgccaggagctaattattgaacgaaacaaatcgaactcaaagatactcacaaaatccatgcgctcagaagagagacgtcgagggcgtccaactggtacagatcgaagaaatccttgaaatggatccagagaacatcgtctccttgcaagaagtcggggtttctgatcctcgctctgaacatctctctaccgttggcgctcatttccatgtaccgttcatggaatttgtacatctgtgtcggtagggactccacctgttcaggtttgacaagcggtttaccgagttcaaacttgtttgccacttccgcctccgggattggtgcgcctcgaaccaactgatccaaagttagaccggtgtctgcaatgaaatccgttatgccaaaatcttcgccggtcaccaacggctcgacctcttggtttggttgttctccaagctgagggactggtttggacttcttgtgctaggctctctgaagtgttcggtcatagtccgatatctgtaacgccttcttgtttgttgtggacattcccttgaagaagttcttcacgctcgggtcagtaggtatcttcttttcaggactccgaggcttgagttgcctcttcacctctcctgccacataagcatcaagctcctcttgactgcaatcgtatggtggctccttgtttttggtggcgtcaaccttcgccttcttcgttgcccttgtgcgggcaggcggtggagcttggcaagaccttgtcttgggaggtgcaggcggacacggtggaggcggaggagccggaggagatggtgcagcggcaggtggcggaggagccggaggtgatggtgcaggaggacgtggtggaggaacctgaggagatggtgcaggaggagatggcggagccggaggagatggtgcacgaaatgcctcttgtcacccaggaaggatgatgtaccgcttgcgccatagtatgatggcgtggcttgtgtctcgtagatgcatctcaccgtcccctcctgggtagtccaactcgaggtcctcgtacgcggcttccaccagctcaacttcaaccctcgagtatcctgctggaatcggcctgtagtggtaagtcccggaagggtctgttgggatggccattcccgacgccaccttcacgtgatgagaggttatctattagtaatcaacctaagcagcaacttgcggaatgtacaagtcaaaaatcatcaaactacgagcataccttgattgataagttcttgaagggaatatgcaactcacatggtgtccgctgcgtgacctcatcaacggggcaggtggtttcatcctgggtttgcatggcgtccatgctctgtgatccgacctgccccattgaggcgcagctgctacgattgcctgatgggctgaccattgcaggatgaatgtacggctggggatcctaggaccgatgtgcggccatacgttcatccaccttccttgccacctcctcttgcatgctgagctcgtagctcgataccctgtactcaagatcagcaatcttcgcctcggtatctctcttactcctcatccgactcctgtacgtgtggatgtcctccttaaatccaatcttccagggaatcacgcctttccctcgtgttcgtcctggatgctcgggagtctgtagggcgagtgacagctcatccttctctctgtcgggtcggaatgtgccctgagaagtggctaccactacgtccgttagtcgactggaagcctcgcgtatctaatcgctgaagacaagggagccatcaactgggttaagcattccaccgtgagcatagtaccagaacttcgatcgatctagccaattagcggtggccggttcgatacccctctcaagcaagctagcctccatctcctcccacttcggcctcgcgacgctatatccgcctgaccccaagggtggtgatggtacttcttcttggcggcattttctttgtttttggccatcatcgcttgcccttgttgccccgtcttgtaagcaacgaactcgtcccaatgatcccttagctttgggaatacgtcgaagttcggtgttagtcccttcaggatgtatttcttgtagagatctcccttgaagctctggaactgttctgccattttcttcagagtccactatttcactatgttatccatacccgcgggtagcgtgaacgtctcgagcattgtggtccacaacatatctttctctgagttcgggacaaagctgtcatcatacccgcgtgcccttgttctgcgccagtaaaccatgctgacaggcatgttgtccctcacaacccaaccgctgtggtgtacaaaattcttggctgcttctgctggggcactaggtcggccgtcttcgtccacctcagttatgatgtgccaaccctctatcttcttcgcgtcacctcgttgtccgcgtgcccttttctgtccagcagagggctgacttccactagcctcctccgcatcgttcccctccttgttcccctccgcatccctctccacgttcccctcctcgttcaagtactggtttggatcatcgttcccctcttcttcattccagtactggctgcttccctctgtgattgtatcgtatagtatctgttcctcatcgcgatcagccatctatgcatacaaaaaatatttgttaagtatgtaggatgtatttgctaaccgtaatattaaaactctgctaatattaaaattgtaatagtcatatatgctaagtctaataatcttatattaaatgactactaatctcatattaaaattgtaataatcatatatatatatgctaagtctaacaatcttataataaatctctaacgatcttatatttaatctctaataatcttatattaaaattgtaataatcatatatgctaagtctaataatcttatattaaatgactactaatctcatattaaaattgtaataatcatatatatatatgctaagtctaacaatcttatattaaatctctaacgatcttatatttaatctctaataatcttatattaaaattgtaatagtcatatatgctaagtgtaacaatctcatattaaatcgctactaatcttatattaaatcaataataatcttatattaaaagtgtaataatcatgtatgctaagtgtaacaatcttatattaaatatctaacaatcacttatttacatcacttgcctgcgcgaatttcttcgatggctagctaccaattcggcttgagggacgatgccgacgtcttctctgcaacattaccaggaaaatgtattagactaaacggaccaagttacatatataatcatatatgtattactagtaaatcgtattagtataaatgcgtttgttctcacaattttagtacaaatgcattcacgttcgtaagcgtttcgtgcacgttcgttcacgtttcgtaatcgtatcgttcacgttcgttcccgttcgttaacgtttcgttacgttcgtccgcgttcgttaacgtttcgtgcacgttcgttcgcgttcgttaacgtttcgttcacgttcgttcgcgttcgttaacgtttcgttgcgttctttcgcgttcattaacgtttcgttcgcgttcgttaatgtttcgttcacgcccgttcgcgttcgttaacgtttcgtgcacgttcgttcgcgttcgttaacgtttcgttaggttcgttcgtgttcgttaacgtttcgttacgttcgttcgcgttcgttaacgtttttttcacgttt

SEQ ID NO: 14310 - DNA, 6437 bp, Oryza sativa
aagtgttggtggaaaagaaaagggcgcactggcaatatatatacccgtggatctttagtctcggttgttgtgatcaactgggagtaaagatatctttactcccggttgttctcaccaactgggactaaagatcttttcccgctatttccaaattctttttaaacccggttagggttaggaaccaagagtaaagataatagcagttgtcttgaatttcattccatatgtgtttctaaattagtaaataatgcattgcaattatttaaagtcgaacaattaatgataaaaccttcgaaaaattattgttatatgtagtagaatacgtggataatatataataagcacatgaatgatttaaaattgttaaaaattctaattaacatatgtaaatagcacatgcatgatttaaaattaatacaaaatctaatatcatatataactagcatatcatgatattaaattgttaaaaattgtaattaacatatgtaaataccacatgcatgatttaaaacctttagaaattctaataatcatatatatgtagcatatggattatttcaatttgattaaaattctaataatcatacataattaacaaaatatctaataatcatatataactagcatatggatgatttcaatttgataaaaattctaataatcatacatatttaacatatgccatacaacaattgatttgtatagatatttggtacatccaacatagtttacatcgtgtacggaacaattacggcaatacatcggcggtgacggttgaccggacgtactttctcctcactattgttccttccttgtgatcgctacgtgagtaaggggtgtcttcatttgataggaggatgctagggtcaatcgtcactgtgaaagggggttgcccatcaaactgatcgtaatcctcgtcagtcttgtcctctactccgacgatttttctttttcctgggagaaccacgtggtgcttctgctcgtcaggccctttgcccttttttcctttgctagacatgtccttgacgtaaaaaacttgggttacatcattgacaaggacaaaaggttcgtccgagtatccaaccttgttaaggtcaactgttgtcatcccactgtcattaatcgttacacctccaccagttaacctaacccattggcactggaacagagggaccttgagaggtccatagtcaagttcccatatgtcctcgatggcaccgtaatacgtgccagttgtaccatcatgtcctatggcatcgatacgaacagcactgttttggtttgtgctcttcatgtcttgggccctcgtgtagaatgtgtacctattaatttcatatccctggaatgtcgcgatcgagccagatggtcccctcgccaagaaggctagttgttggttaatcgtctcgttacccatgagatattgtcgcagccacgtggagaaagtatcaatgtgatgccttgtaatccatgcatcggacttaccgatgtttctggcgcgaactagagccaagtgctcctcgatgtaggaagccaccaatgaagattgttgcagaaccgtgaaatgggctttacggaataaattgttgtctaccgtcattattgctttccttcctagagtcccctttccccgtagtctcccttcatggcgtgattcaggtaccccgattgggcgaagggcttcgataaattctacgcagaattcaatgacttcctctgttccataccccttggcgatgcttgcctctggacgagcacggttacgaacatacttcttcagaatgcccatgtacctctcgaaaggaaacatgttgtgtaggtacacaggaccgagaataccgatctcattgacaaggtgacaaagtagatgcgtcattatattgaaaaatgaatgtggaaatatcaactcaaagctgacaagacattgcaccacatcattctgcagggcttctaatctatcaggatcgatgaccttttgcaaaattacgttcatgaaagcacatagctttgttattgttgcccggacattgtctgggaggatacctcttattacaactggtagcagctgtgtcatcaacacgtgacagtcatgagactttagatttgtgaacttcttctccttcgtgcttattattcgctttatattcgtggagtatccagacggtaccttgatgctctccaagcatttaaacatactttccttctctgccttgctaaaagtgtagctggctggactcaagtaatggcttcctttctcctttggttccgggtgaaggtcaccgtgttgttccatatgcttcagatcattacatgcttccagtgtatctttcgactttccatataaacctaggaagccaagaaggtttacgcaaagattcttagtgagttgcatcacgtcgattgcgtggcggacgtccaagaattcccaatagggtaactcccaaaatatagagttctttttccacatcgccgcgtgaccatcttcgctctctataggctggctgccaggcccctttccaaacactactttaagatctttaaccatagcaaacattgttttcccgctgcgatgtttaggcttcatacggtggtccgccttatgttcaaagtgcttgcctttcttccgtaccgggtggtttgctgcaaggaatcgacgatgacccatgtacacaaccttcctacagtgcttaagatacgtactttctgtttcatccatacagtgagtgctagccttgtaccccttgttggactgcccggataggttgctaagtgcaggccaatcgttgatggttacgaacagcagcgctcgtaggttaaactcctcctgtttgtcctcatcccacatggggacaccttcctttttccacaacagtttaagatcttcgaccagtggtcttaggtacacatcgatgtcgttaccaggttgcttggggccttgaattataatcggcatcattatgtacttcctcttcatgcatagccacggggggaggttgtagatacacatcgtaacgggccaagtgctatggccgctgctcatctctccaaaaggattcatgccattcgtacttaaaccaaaccgtatgtttcgtgcgtcctttccaaagtctttaaattttctgtcgatgtttcgccactgcgaaccatcggcggggtgtctcagcatcccgtcctgttgacgctcttcagcatgccattgcatcattctagcgttccccttgttcctgaacaaacgccttagccgtggtattatagggaaataccacatcaccttagcaggaattctcttcttcgttagctgcccgtcaacttctcctggatcatctcgtctaaacttttatcgtagcgctttgcaaacagggcatgcttctaggttctcgtactcctcaccgcgatataggatacaatcattcggacatgcgtgaatcttctgaacttccagtcctagagggcagactatcttcttagcctcgtacgttgtctcgggcaacttgtttccctccggaagaatgttcttgacgagtttcaataaatcgccaaatgccttgtcactaacaccattttttgccttccattacaagaactccagagtggtatccaactttttgtgcccctgctcgcaacctgggtacaacgacgttctgtggccctctaacatcttgtccaatttatgggccccattttcactttcgcaatcctccttggcgtcctgcaacatctgaccaagatcatccgcaacgttgttaccatcagcatccctttcctcctcgcccgtttgatttccttcaaatccagcgtactgagtaaagtccggaatattgtcgtcttccacttcatcttcttccattttaacaccttgctctccgtgggatgtccaacaattatagcttggcatgaaccccgactcaaacaagtggaaatgaatagttctggatgcagaatactccttctgattcttacacttattgcatggacaacaaataaaacccttttgcctgttagctttggccactctcaaaaaataatgcacgccgtcaataaactctttggaccaccggtcagcgtacatccattgccgatccatctacatgacatgaaaaaaaatcatacacacataattattcgtacaataatgatagtcatacaataattataaaataattacaaactctttcaacagtcacacaataatgacatcattattcatacaaatattatgaaatattacaccatataaattatatatttactatttataaagttttaaactaatattaatatgttgtacttattttaatttttcattatactttgttttctattattcaagattaactttcactatattttccttctcaacttttttataaaaccttctttagcaaataaactaaatttctatctattctttcttctccacacaaattttctctctcatcaactaacaacaaaattttggagacaaaaaagtgtgcaaaacatagctccaaatgtaatatgaaaaaaaaacattggaggatgaagttgctaaccttttaggcacctccgatttgtatataatcaacacaataaattcactagaaattttggcatgacctcccctttttttgaagaaattttgaagcttgctcgggctggaggaggaagaagacatatatataggggtgggactttagtcccggttggtgttatgaaccggggctaaagatcgccgggatctttagtcccggttggtgttactaaccgggactaaagttacgatatttagtcccggttggagttattaaccggaactaaagatcccggggggcctgacaggccctgacaacatttgaaccgggactaaagatcatctttagtcccggtttttgttgcaaccgagactattgtacgaaagatggtttctccaccagtgaactgctaaacagtattacattttggctagtattgttgggatggtgccacctagtgtgagctcgattaaggtgtacaatagcatggtttggaaacatttatctcttcacgtaaaattgagcaaagaattagtgcatgactaatttagtttgagctttaaaaaataaaaaatagattaatatatgtttataaagtaacttaattttaattaaaaagttactaaagaaatgtgtgcgaaaaaaatcagggagtagaagttagaaaaaagagatccaaatgcagcctaaaaaaaattaatgaattgactgtaacaatggtgccattgatgttgttggcttataaatttaaaataggaagaatgagcatgttgccgagtatctttccggtgaatgaattataactaagattccatgcgttcaggctttagcaactgagaaacatactactagctagcaggggtagattggtcttttttcacattggtccatgttggcatgcacatgtggcacttcacagtgtaaaaagtggcaaaaaattacaaaaccttctctctacaatggcaaattcttaagtacaatcctaagaagggtatatggcaaattcttaagtacaatcctaagaagggtatctggttaattgacaaatgtaaaagtggcaaatagttaaattcccccattttaactgccaccaaagaccgagggcaacaactaaaatgaaatgcaacgattggccatatggcaaattaacttgatcccctgcctataactcaatgaaagaatggatcaactttctggcataaactaataagaatttaatcgccacatctaccaaatttgtcacgctacatgttcccctctatatatatatatatatatatatatatatatatatatatatatatatatatatatatgtccaattcgttccgtctgaaatatctttcaccatttaattttccttcctagctcgaacaagaaattcgccctctaataagcaatctcgctagtgaactatgaatgatcggcatcaggcattgatacatcatactgaactgaaacagttctgtgtatctgtttgctttcccaagattatcaaggagctgccggaaggctggaagctaccagcagttggaaaacccagccaaaaggagatggatcaacactgtgatgggacataaatcaataagactgtcagtgattttcttcatcacaacaaactatcaggaactacctgcaaacatatattgcttgttggagaactattttagggctcattttcttgaattttttttatttataattttttttattaaaagttttacaaaaataatttttaaaaatcgccctcccagagggcggcgaaaatgacgtggcagacggccgttcgctctcgggcgacggccgtcaacgaaatttgcaggcggcccccttgccgcccttcgcgagggcgattttgtactgtgcggggggccgcctgcaaatgggcggcgagggggggcatggaattttgcaggcggcccccttgcc
